United States Patent 7,868,149 (PLANT GENOME SEQUENCE AND USES THEREOF) - sequence listing, part 31

SEQ ID NO: 15640 - DNA, 11250 bp, Oryza sativa
  unsure (1)..(11250): unsure at all n locations
tcattattgtttctacgcagtagtacaatttgacatgttaaaatcacaacttgatacaggcatcacgaactcttttgtgatcagcaagaaggggacagaaaattcgaaggcacatagtgctccctcaccagagaatcaccaatttctgtnnnnnnnnnnnnnnnnnnnnnnnnnnnnnnnnnnnctgcgaccaagaaacaccactcactaacgtcagagacatttcatcaaacagattgccagcgatagaacacatgaagggagcagtcaacagctaacactctacccgccacggtcgccagcagcatggggcgctggcggacgagagagcacctcgccgcggcctccaatctcgctccacgaatcgctgccttggaaaccgagctcccgcgctcgcggggcacacccacgagcacacccgtaccaggggacgaggaggtggagggcttggaagcagcggcctgcgccgggcggcaggggcggcaggtggaggtggtgctactaacggggcgcgcggccatggcgacgcagagcacggaggagtggatggagcgaaggataccggagaagagggagaagagacgcttctgcttgggtcaaagggagaagaaggccacacgcccgcggggagacgtgtagccttcgatgggccggggcccacgagtcagtgtgaagctatagcagcttcctctttgggcttcatttaaagctatagctttctccggcaagccgtcgcctcagctcatctccctgtttgcgaaattgcggcggcggcgcccaatctcgcggtgcaggggcggcgcctagttcttccatggcgagatagcattccggtttgccggaggagattgccgtcgagagcgagagagagcatcggcgaatcattttgaagttgggtgttcctcctcttcctcccggcgatggggaactggaatcaccatcggcggccatggcacaggaggagccgccacgaacgccctccgcctccgccttcacctcctccgcatcccggtatggatgactgatttgcttgttctgttccctttgtttctatggattggattgcgtttttgtatgattcgatttaagttcaggtggtgatttgttaggcaagaatagggttagaaatttttaaatctaggtatctagtcagtaggtctggtaatgtcggttaatgctttttctgtgaattggaattttaggaatcgacatgaatatcattctacttcttgccatcctaagaatgcacaaccgtcatagatagtggactgtctgcttagaaccagagttgctactgcaactttctttaccaataatcttattgtttgtctaattgtcttaatatttcaaaatgtggtgcttaaatgtcagaaagttctagttttattcaactaccaagtatcaatttgtcgtttgagctgtaatggtattgcagtttgccatctactaatgtgcaaactttgtatatacgagttggtcatttgatccaaccacacagtaagcacagtgtgtcatctgttccgacaagaatatgtaacggaaatagtggtgatgcatttctagattaggatattctccgcttcccgccaaagtaatatacaacggcctaatggaaatagtaataatttaggatggtcttttcttcccaccaaaatttaaaacaccgcctctccttatccactagaagaaatttttttttgaacgaatcactagaagaaatataaatgttgaaacataaccatggtgcaccacttctgtacttgaatcttgctagacaccaacctgccacctagcacggttgccattcaggccaactattgctaactaggaactagacaccaccatgttaccccgtcactcgcctagcatcattttgaacactactaaattgccctagctcatttcgttattacatggggggttccaactcacctggaccttaatgtggcatgactaggagcctagcctaggaattttttttagagcaagggccattcccagttcccacatttccattaacagaaatgtagctacagatttcaggaaaacataaaaggaaaccaccaactatcctgatagagttttcattggtcaatttgggttgggtgtcaacacacaacctcctaattgccagcagccagcacaaagtaaagacacagggagccactctagggactcagccaaacagaacccagcagcccaacctgatcaaaagcccaccctactgagagacttccagttttttgtcaacagtgagaagaaccgggtcagtgcttcaggtgaaatcaaactccagagtgaagccttctagctggtagccgcttcatccccaccctccacccgaaccttgtgttgaagatgtcatttacaaattgctttaggagctggaccccccacagcagccctcttcgctcttcctcctgcatctgcaaaccagctcaacatgtaatccaatgacaagcataataaatcaaatctgtgggatctccaggaagttgtttcttaaaacaagcagaattttttgttttccaaatgacccataaaatagcagccacaccaacccaaatgggatgtttcatgtttttctgaaagctctccatccaactaccaaaaagatgatttatatctctaaaaggtttcaagttgctacaaacaacattccagatcacttttgcaattcggcattcgataaaaaggtgttgcattgattctgctgtatcacagaattgacaaaatttatcccccttctgccaacctcttataattaaattatcttttgttagtatactgtttctcaaaagaagccgcaggaacactttgatttttcaaggggatcttgaatttccatatttcctatgtgaaaaataaatgcgtattttcatatctttgtaaaaagatttaacagtgaattactctatctgcttttgacccatcaagagtaagctgatctgagtaagcttaccctaggagatggaaggcagagttatgttattatgatcatacaagttatttctctaaaattaggataattctagaagcttcaaaagagcgttgctttgcattagccatatcacagtcatctggttgaggttgtacttaatggagaaaggaaacgaagcgctgtacttactgcacatttctttagaaaaatgaggagccacaaaatgttaagttggctattgataacttcttatgtgggcgtaacatttttttcctcaagcggcagtatgcttaatctatgatatacttgaagaaacattgttagtacttgctattaaaataaactattaggtaactgacatagccatgaaaggtgcagttgtgtggcgacaaaggagcatccattagaaggaatgctagtattttaggattgaacccttttatctagtactttgaataattcttctgtttagtctgttatgaaagtaactgttgggtgtcttttttttccatacttttagaagagatgctgctatttcaggcgatttctaaatctgtacagtggtgttcagatggtaatttgttagggaagactcgggttggaaaattttcgatctagatatctaggtctagtactttcttgttggctgacgattttcctgtggattggaggtctcggaatgggcatgaatatcattttgcttcctgccaccctaacaatgacacaactgttgtagatggtggactgtcctgtactgtgtgatgcggtcaatttaagcttagaaccagagttgctactgcgacttcctttacaattaggcttattatttttggtctaatttgtcttactatttgaaaaggtacccaaatgtcagaaaatgctagttttatttgactaccaagtatcagttcatagtttgaactgtaatggtattgcaataagcaaactaatccctctgtttttttatttgactttggttaattcaacgtcaaataaaaaaaatagagggagcacttgtgtgcacatatcttcagaaaaaatgaggggacacaaaatgttaaattggctattgataacttcttacgtggccattacattttttcctcaagcagccggatcctaaatccatgatatgcgtaaggagacgttattaattgctattaaaaataaactattagataactgacatagtcatgagaggcgcagttgtgtggcgacaaaggagcatcccttagaaggaatgctagtgttttagtactgaacccatttatccagtagcctgaatggttcttctgtttagcctgttaggaagtaaccgttgggtgctttggtgtctttgtttcccatacttttagaagggatgctaatattttggatttgacccgtccaaaatctgcaggcgatttctaatctgtacagtagtcttaagcaatctaaccagaatttttttgtatatgttatttgtttgtataaacattttagaattcatcatctccttgcatttttatgctgctacaatgaatctgatattgcttttgtatttacaggacacaattgccacccagtcccattatgggaaagggaattttgcatttatgttggcggcatttcttggcacaggttctgtgacaacaagagatatgtctgcatgtataagaacattgagcaatgggatgactcagaagcctttgataattttaagaatgcaaaggctagattctgggctaattaccatggccaaccttcagacatatctttgccagaccctgatatgtatattgacaagattgaccacaatagcaagatcgaccctgagttgatagctgacctgaagatggtacgcttaccattcgagagggatgatgagttactcccagctgatggattgggcagcactgatacagataacaagtgccagcagaagcagaaccaatctggaaactgggacatctatgtagaaaagcccactgaagttaacaagtgggagcaagattcaagatccaacatggactggggaacaaagcatgaatcttggaatgaatggagtaaaaattgctctggttggggtagtgccttggcggattctagtgccttggcggattctagttggggcaattggaataatagtaacaatcatcattcatcaaataacagggatagcttcaatggggtcaacaggaatagataccaggacccaaacagcatatctggaaggaaaaggaatagtggtgggcacattcagcaaagaaacagtagacagagaaaccagactgagggctaccaaggaagtactcctagatggtgagaccatataagacaagagaatggtctccatttgataatagtgtaaagggggtaaatgaccacacaatagaatgtggcctcttagtagtgcgaaagattggatcagaatgaacttttgtctggagactacagggatagcttcaatggggtcaacaggaatagataccaggacccaaacagcatatctggaaggaaaaggaatagtggtgggcacattcagcaaagaaacagtagacagagaaaccagactgagggctaccaaggaagtactcctagatggtgagaccatataagacaagagaatggtctccatttgataatagtgtaaagggggtaaatgaccacacaatagaatgtggcctcttagtagtgcgaaagattggatcagaatgaacttttgtctggagactagagcagttagcaatagttggcagttagaacaaatgatctatgtaaagagatgctcgagttttttccttctctagaaagaaagtttcttcatgtcgcttgagacatgatgtttttgggtaatggaagcagaatgctgccatttcgttgtaaaggtgatcgccataagttagttgttttttttctctttctttctttcaagctccatgaatatgtagtttgttcaagtgaaacatagaattcatgtactggtagcatgttagtactaacatatactgatatattgataattcgtgtctagtgctaataaagatactcataagtcataaccagatgaaagagtctggtacagtatgtgttactaacataaattttgcaactaccaaacataaatttgtgtgcaagtgtactcaaccataagggcatttccaacccaagacactagacataatttccataaactccacatcatcaagaaactagtactagacactactctttcaatgcaaacactactattccatacttaaatttaatgctacttatctcacatgatatcttggacgttgtgtagaaaccatatctcatgcaatatatggtttccttctcttttctcatttattcacttgccatttcattttttatcctaggtggcagcttatttaatgctatggacatcatcctagtcattgggttgggaatgccctaagtcttctttcatctgattaatttgttaaccataagcgtactcgcaactgtcaagggttaatactagattcatcacaaagtgtttttcacactttccttaaataaaagtgtttttcacacacatacacacaaacttccacacataaattcgcttgcaaaaaaataggatctttttttaatgttcgatgctgaaacaggggctttaacaaaaataatacttaaaaaccattttatattatacaagtcgctttgacttttcacttagtcaaacttctaaaagtttgatcatgtttataaaaaaaatctagcaacatttctaacacaaaacaaataaaatatatttaatatcatatttaaagaaactaatttggtattatagatattgctaagtttttatataaatttagttttatactaggaaaagtatcaaaaagatttataatattaaatggagttaggagtgttgtgttaccttagggtgaaaacaaaccgtaaggggtgttatgcaaaaactaggatcaccttcatgacaaaaatagcccgaaacaagggcctttttgtaaacattactgccagtccgtcagcgcgcggaacacagcgatctctgccgttggatcgatcatcaacgctccatcggagcaacgccgccccgtcaacaaatgcggcgcctcccccctcccccctcccgacgtttcccgtttcccttccttcgcgcggcgctgctccggtagggtttttagccggcgatctctcccctctcgcgcgctcggcgactgagaatggtcgaggtggaggaagtcagcaacaagatgcaggcgcagatgcgcctccaccccgcggcggcggcggaggaggaggacgccgacctcccgctccctgccctcttcgacaaggcgtcccacctccactccctcgcctccagctcctccctcgatcaggttttccctcgattcacccccccttctcctcatccccatcaaccctctcatggcggtttcatgcgagcgcttactgtggctgcttggtttggtttgggatatttgcaggaagggatccgcaagggggtcgacctgctgcggcggtgcgacgagatggtcagtaagctcggcctcttctcctccaacgagaccaaggatgacgtctccactgccaacctcaaatacctactcgtatgcttgtttcccccactacatctgcgtttagttccgtttctcttatcatatcatgtttgtgcatctgcgacatgtggttatatctgtgatttcgattgattttcttcaggtgccgtactaccttggggaaatgactgaaagggtagcgcaggaagatcggatcccagtccttaaggcgtcgcaggatcatttgaaggttatatcagtttgtcctgtcacatttagttgatttggtgcatatttgtcatgtctttcttatgcccttttcaattgggagcactctgtcatcacaacactcatgttttaatcactacggttacgcaggaattcatttctatctgtgaagcactggagcttatatcagaggatgagcttgaattgtctaggcagaagcaacctgataccatggcaaatcgaagagcacagaaggtgagccttggcaaaatattttttctcgaatatgttaaagccttaaaggggtcatcaatcattctgcaatttacaaacacaataagctgggatccaaatctcttattgagactgcaaaatctgggactcataatctgcttgaccttttccaaagtcggttaatttccactctaattttcttgtttgaccaaacctaggttgcacggttcaagcgccaaaaggctgcagaaacaaagctcctagaaatcaaggagaggaaagaaaggcgtaggcggtcattgagagcagctgctttatcagctcctattgaagctggggaggaagatgcttttgaggatgatggagaggaagaaagagaggttagcagttagcaccagacatttagaacccatttacgtagcaaatctgatcttgtttaccaaatggaaacatcatgatatattcttaaattaccacatagcatatttgaaaatactccaaactaaaattagctacaatgtactagaagtggaagaaaaatatttacttttccagaaaagaaaaggaaaggaaaggctttgttctgttcaatagaagatggaatttgacaaatttgatgattcaagataggttttaaaaatctcatagggaactgatcgcatttcctgaattagcccatttttgtggccatgaaacacacaacagatttgttctgtagtgccagattgtcaccaccaatcttttttcctgtaacaatatgatgcttaatgtctttcctatgctttttatatacaatctcttacttttgtgggcaatcaaccttttgggatctgtcgatgtgtgcttccaaagtttgggctccatgcctgtcataactttactttgatgtacaaatgacaaacggttatgctgtggttttgattcttttttttggttctatgttgcaggcatggttagctactatctcattggctctatgcaaggtttgtgttttgtgggcaagaatgattctcttatactgcttggaatgtttatttgcattcttttaagctactgtgctcgctttgttatcctgatcatcagacgtactcatttctacttcattttataggcttttgaccttcttgacatgttaaagaaggaagaagaaatgcttctggcagtaaaagaaaggcaagcgaaggtaaaacaaatgaataaactttgccaatgtcttgtcaatagtatctttggttgatcctttccagtatcatattgaccttttaacctttcttctgtaaccgttctgtaaccttatacaattattgaacttcgctttggataagccttgagcttatgttgtagtagggcttaccttcaccaagtagatagctggatagttgtatacagtaattccgtttgaaaaaaaatatacaccggattctgagtttggacatacaattaaattaattgtcataatatgataataacttgccattgcaagtatttcatcacacttctctctctctgtgtgtgtgtgtgtgtgtgtgtgcagagtgctgagtgttttgttgttactacatgcaagtaatattagatatttgattttgttttcatgatccttttgtagcactcgatggtagatattctaccgtaagaaaaaaaagaagattttttttatctttgctcccattgtgttgcatatctgtttcaataaactctgcacttacatggaggtttcctttagtaatgaaataattgcctgcttatgatgttttaggatggtaatgcatttgctcgtgaaatgcttgatgaacgtacaaaaaaggctgaagcatggcaccataatgctgccaaccgtgcaccatattccaagccagctgatccaatcacttgtgcaacatttgctcaagatgtcattgaaggtagagcaagtgtttcacaagcacatgagcacaaacaccagccgctgatatttggccctgcaagtcttgttggtggaggactaaccagtgaaagagagagaatggcagcacaagtttttcagccaagttacaggtatgctttaaaatactgctacgtacctggctgaaaactgcactgcttcttttaatatttgtggagggggcattatttgtggcaacttttaatgcatcatattagtcatactttgatatatttgtaggaactttgacctcctattccattgagcattactcgatgagcaaattatttcttggtaaatttgtaaagtggttctttacattgtatttgcttcaccacattagtatgtgactgtgtttattcaatcgtaggtgtttccttgttctattgttgtatgttctgccataagtctgtgacaaatttgtggtttacattgttgatatcattctttttttttcatgctggaaaggcaccatgttaaatttgctactcagtgcaatactagattcactgacaataaactgttgtcttgtactctgttgtgactacgaacgcttggtgcaatcgtatagatgctgagatagtgatttgtaggtgcgaccttatgtttagtcataatccatgaaaaattccaagaaatggtactattctgcaattgctcataaaaaacattagatttcccctgcagcaactaagtgttgagctgtagatcatctctattaaagtgatattgcattgttcagtaaaagttagtgaaaatatgcatatgagactatcctttgatccaattattctgtttccatttttcctgtatttggactattaggttgccaacgatgagcatagaagaagctggcttacgtgagatgaaaatgatggagaaatggcaagaaagaactgctaagatgattcaagaatcaaactccgcatggcacaaggatggcagtcggtcagcccaagaggatgaggacgctgaagaggagaaagcaagagcatgggatgactggaaggacgataaccctcgtggtgcaggcaacaagaagctcactccctgtggctagattatatgctatggcaattctattgaacttagatctgaaactgtagctcttgtaaaaatatgtggttttttactttccttactgcggcatttgttgactgttgagtaataatgtgttccatatgcctattgtaatggtgcatggttttcttctgccaatatattgggaagtaatgccaaaaaaaagctggtttgagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15641 - DNA, 1113 bp, Oryza sativa
  unsure (1)..(1113): unsure at all n locations
cgcgccccgttagtagcaccacctccacttgccgcccttgccgccggcgcaggccgctgcttccaagccctccacctcctcgtcccctggtacgggtgtgctcgtgggtgtgccccgcgaagcgcgggagctcggtttccaaggcagcgattcgtggagcgagattggagggccgcggcgaggtgctctctcgtccgccagcgccccatgctgctggcgaccgtggcgggtagagtgttagctgttgactgctcccttcatgtgttctatcgctggcaatctgtttgatgaaatgtctctgacgttagtgagtggtgtttcttggtcgcagnnnnnnnnnnnnnnnnnnnnnnnnnnnnnnnnnnnacagaaattggtgattctctggtgagggagcactatgtgccttcgaattttctgtccccttcttgctgatcacaaaagagttcgtgatgcctgtatcaagttgtgattttaacatgtcaaattgtactactgcgtagaaacaataatgaattgtagtcaacagtgtagttatctgtcataggaaagagaatatcatatattcctttttattacattgtgatggcatatagctaatgcgtgcataaaattttattatgatcagttagggtcatctggacttgctttggctgaccttagcattggagattggtttggaaatttgctttattcagcgggtcagcaagccaacgaggctgttcaggatcagctctctgctcttagtttcactaggtaagcatttttttcccctgcggtcaattgcctatggacagaatctgtttacttactttctcagattatattttatgtttcatgtccatatttttttctgacatgtttctctattctccagcttggctgtaattttcggtgctggacttgtaactagtttgtctccttgtacactcagtgttctaccattgactctaggatatataggcaagtatagcgattgccttttgagatgctttttttttgttgcccaggatcagttacaattgatggcactgatctgatgacatattctttaaaatctttcaggtgcttttggctcgggcaaagatcgatctgaggtatattctattattt

SEQ ID NO: 15642 - DNA, 731 bp, Oryza sativa
aaaaagtgacactttgctatggcaaacccatcacttatgatcacaaccgtaataggtgcaattattggaagagcataaattacacttaatttttctgagggaatctatcctactatgtcatatcaaatatataacagcaataaagtaagatagatataaaaaccccaagcgaaatctaaggggcaacgcacacggcggtcccgccatgtgaaaaccttaacgacataatcaaattatgccgaaaccgagtcaatctcattggctcatttttctcattggcatgcggttccagtggacatcggactattcgatgaacacaatcgcgctcggccttggtgagtactagacattccattgaagtcaccaacacacataccgactgatctcatcaacccatgcggctattggttcatctcatgttccgatcacctaagaactcatatacaacataatagatctcatctactacatccgcatatcaattatatgcaatgatctagatcataaactatacaacgcggctctgataccactgttcggatacgcgtaggctacgatagcataaatcaaaattttctatcggggaaaccaggaaacatgcaagtattagatcatagatcgtaccactcgacgcgctgtggcagcggaagaagacgctgagaagtcgaaggaactctcgcgaaagagcgcgcgtcgatgtaaaggaagtagtcgattgcaccggattgacc

SEQ ID NO: 15643 - DNA, 42248 bp, Oryza sativa
  unsure (1)..(42248): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaaccaatcaagcgccgaaccaggtcgccatggcttggacacagcgtacgttcgacctatccatggcggttccccaagcgtcgccgttcgggaccgggcaaccgaacacgatggcccaacctcatgcgcaagtcatgacttcacccttcaccacaccatatccgcagctggtgccgaacaagccagggggtgagaaggggctaccgctgagcaggggaatcaagattcatccaatcccaccccagtttaagttcccacctgttccgcggtactcgggcaaaacggacccgaaggaatttctgtccatctatgagtccgcaatcgaagccgctcacggcgacgaaaacaccaaggcaaaggtaatccatctcgctctagatggcatcgcccgttcttggtactttaatttaccagccaatagcatttactcatgggagcaattgcgcgatgtttttgttattaactttcaaggcacctatgaggagccgaagacgcagcaacatctactcggcattcgccagaggccgggggaatcgataagggagtacatgcgttgtttctcgtaagcccgatgctaagttcaggacataaccgaagcgtctgtcatcaacgctgcttcggccgggctgctcgaaggcgaactcaaaagaaaaatcgccaacaaggagccgcagacacttgagcacctgcttcgtatcattgatgggtacgcaaggggcgaagaggattctaagcgatggcaagcaatccaagccgagtacgataaggcctccatcgctgctgctcaagcccaagtacaagcacaggtcgccgaaccggctcctctcaccgttcgccaacctcagctgatgaaccaaggacagccgccgaggccaagtcaagcccccatgacttggaggaaattcagaactgaccgcgcaggcaagaccgtgatggctgtcgaagaagtctaagccctccgcaaggagttcgacgcccaacaagcgggcagccatcaacagcctgttcgcaagaaggtcggaaaagacctctactgcgcttaccatggacgttcttcgtacaccatcgagcaatgctgaaacattcgacagcgtggcaacgctcaagatccaaggcctcaacaaggagcagctgtcgaagcacctcgcgaggctgctcaagaacaagtacccccggccgaatagcgccaagacatgaagcgcagagtaatccaagtgattacaagggctgactcgccagcttagccgtcaaaactgcagaagaagatgtagctgcgaatggtgcacaacattgcttcggccgacgaaggggctccacggtacttgaatcagcaaatctctttcgggccggaagatgccgaaggagtgttgttcccgcatcaagaccccttggtgatcttggccgaagtagcgggcttcgaagtccggcaaattctggttgacggaggaagctcggccgatgttattttcgccgaagcttacgccataatgggcttgcccaccctagccctcactcaagcagcagcctggcttcgtggtttcggtggtgaagcagttcaagtcctgggacaagtacaactggcggtggcgttcggcacgaacgagaacaagcgcgaagagcaaatactcttcgacgtcgtcgacatcccatacaactacaacgccatcttcggccgtgcaaccttgaacaagttcaaagccatctcaaaccacaactatctcaagctcaagatgcctagtccggcaggcgtcatcgtggtcaggggcttcagccttcggctacatcatagggcgatttggccgcaattagcagggcagtgcacaatgtacaggccgaaccgcatgaccgtacaaagcacccgcccctcatggcaaggtgatcaaggtgcagatcgacgatgccaatcacacaagatttgtttcgcttgggggcgatatgggcgaaagggaagttgaaaacatcctggaggtgctcaagaaaaacattgacatctttgccttgggacccgataaggtgggaggtgtttcgacagatctcatcatgcatcatctggcggtcaagccgaacaccaaaccaaggaaacagaagttgcgcaagatgtccgccgatcgccaagaagtagcaaaagccgaagtgcaaaagctgctcaaggccggggtgatccgggagatcgaccaccctgagtagttggcgaacctggtactggtgcggaagtcaaacggcaaatagcgcatgtgcgttgatttcacagacctcaacaaggtgtgcccgaaagacgacttcccccggctcagcaagtgggcggcggagttatctcccttcgatctgcattttgtcgcccgcactgctatcaagtcccaagtcctagctgacttcgtggccgaatggacgccggcattcacccctgaacccaagcctgtcgaacaaccttgggtaatgtactccgacggttcgtggtcacaaaagggggcgggtgccgcggcagtactcattttgccaaggggcgtgccgattcggtatgccataaggctgtagttcaacacgaccaacaacacggcagacgtcgtactgnnnnnnnnnnnnnnnnnnnnnnnnnnnnnggttcggcgcttgctcatccgaatagactccaaactagtggcaagccacgttgacaaatcttttgaggcaaaagaagaaggaatgaagaggtatctggaggcaagtcgatctatggaaaagtgtttcaccggcataacggtcgaacacttacctagaggccagaacgaggaagcagacgccctggcgaagtctgttgcttgtggaggcccacattcaccgggcatcttttttgaggtctttgtacgcaccaagtgtgcctactgagagcctggacatcatggcaatcgaccaggcagaactgggcgaggacccaaaggactggcgaacaccgttcgtgaagtaccttaagaacggttggctccagaggacgaagcagaagcgaagctcctacagctcagagccacaagatacaagctgatctcagggcaattgtatcgctcaggggtgctccaaccctttcttcgctgcatctccttcgttgaaggcgaggaaatggcgaagaaaatacaccaggggctgtgcggtgcgcaccaggccgcaagaacggtcgcctccaaagtgtttcgccagggggtgtattggcccactgtgctgaaagtctgtgttgagcaagccaagaagtgcgaaagctgtcagcggcatagccgaagccaggcagcaccccagtatgagctgcaacctatcgctccggtctagccttccgccatatgggggctaaacataatcggccctttcccggtagcgcgaaatgggtacaagtttgcaattgtagcaatcgaatatttctcccgttggatcgaagccgaaccacttggtgcgatcactttggtagcagtacagaaatttgtatggaagaacattgtttgtcatttcggagtgccgaaggaattcatcactgacaatggcaagcaattcgactctgacaagttcagagagatgtgcgaggggataaacctggaaatcaggttcgcttcggtcgcgcacccacagtcaaatggggcggccgaacgtgcaaatggcgctcaagaaaaggcttgagggggcggcaaagggtaaatggctagacgaaatgctatctgttctctgggcccttcggatgacccccactaggccaaccaagttcagcccgttcatgcttctctatggcgacgaagcaatgaccctaatagaactaggagctaattcgccaagggtgatgttctttggaggcgaagatgcgcacgagttgttgctcgaactccttgaagggataagagtcgaagcaatagaacacatgtgcaagtacgctacaagcaccttggcaacttacaacaagaaagttcgaccgatgcagcttttgcctggccatctcgtcctaaggaagaaggcgaacccagtggtggtcggaaagcttgaatcgaagtgggaggggccatacctcatcaaacacaggtccaggacgggctcctttcgcttggcgatgctggaaggcgaagagttcgaccactcctggaacactgcttctcttaagcgtttctatatctagaaagggtggcaccccattcgccaacttgtaaaaatgtacatactattgtataggcctttcggcaactctcgttatgtaagcccttcggcacaaaaataccaaaaaaagaggaaaatgacaaaaaaaatggatgtagggctattatccaacctggaggcctgaaccagtataaaatccttgtgtctttcgcctttttacttatgtgaatgataaatcgtggaaaaaccctaaggcaaacgcctgatcagcgaaagcaccggggggcgaaagaaatcggccgaagcatcgctcaccgaacgttgaaaccgcgacagcttgtttcgggaaataagtaaccgaacaccgcaatactcgagttatgtgaaaacacaagcgcttcttttagcgcggaataccacagatcgaaagcggaagtcgaaagctaaaaagtcagcagacctatttcgctaatatacgcaagggggccgacatgtttcgacctaacgaaagcacgaaaggtgactatgcgaacaatagcgaaaaggaaatgaaacacatctttattaacttcaaaaaatatcaaagaatacatgccatacaacatgctataggtgaaagaaagtaacgggctttacagcctagcttacaagaaaattatatcttcgcccccaaaacaccctccactcccaaaggtgtgatttggcgaacttggttcgtcatcactactaatattatacactaccctaagaggagaagggggcgaaacacaaactaagccatagtggcgctgggcgatcgcttcctagcgatcagtccttcggtgatttcgccaaaagcgggccatgtcctcctgacgttccacatggacatgatcgtagtcgtccagggttcacccggggtgtgcccgcttttggcgtttattatcatctcgcgacaggaatacttaatcttcggcaggtttttaaccgtgacgaatttctcacattcttgttccgccaatccccaaaaggaggccgaacatacacctttcggcgaaaaccctgctaagaaaacataagaaggccaatggcaaagcacatggttaagacgaggcggagcacataaagtgggcgaaaaacgtcgtctcttttttgtgcgcagaataatgaaagcatacatatcaaagccgaagaaacatgataatttactaagacttggttcatctatctcatatattaaaaagggccattttcggctacaatacgaaaggggtagggccaccggccaaatttacatcattcgcccaccgcggcaagcgccaagagaaatctacaaaaaatctaaagaacgggtggagagcctcacacctcggggtgattttggctgacgtccgccccaccgcccacatccattccgccttcttcggccgctggctcttcgccctgctccgcctcctctgcctttgccaagtgttcgagcaggcgcaccttggcggtggatcggcgttctttttgccagaactatttgcgccagccacgaagtgtgagcgaaatgtcctgagagttgacctcccaatcccccttcacaaacttggggagctcgacgatgtgttcgctaccgttctactgcaacaggcccattgtaaaggccgccgacacacgcgcacaacaatcgccgtacgcagtggcgcaatcggagaccgcaccaccagcctgttgtgtccactccgagaaggtgaaggcagaagcatcttcgccagggactcctcgcaccctcgcccccatgtcagtaagggcaaggcgaagcgtacggcacacggtcttggcagattcagtggctttcgacatatcctgcgtgaaccgctgcgcctccgttgaagcggtttcctctgccttgctgacctcttggcaaagagcctccatcttcggctcggtgagattatagtagtcggtcagggggcggaatgagcttgctccttcttaacctcggccttgagacgctcgatctcggcctttgcctcgctccctttctcaagctcagcttggagccgcttgttttcagccttcgcctccttgagggtgttggcgaggctctccatttcaaggctcttgcgacccagttcgtcgtccttagctcgaaaacggcctttaaaaccgtcaagacgagcccgcacggttcgttcggtcgaacaatgagccgcaagaatctatttcgacaaagagaaagagggcgaagatgaatggcatacccgaaacaacagctaaaaggaaagaaatatgaatagcatacccgaacagctaaactcttgatggcggaacagccctcgtcgaactcgttcagctcgaagaataggctcgggctcccagccagagaaacgagattacttacccccttgacgaaggggataaggtccgcccgagtctcgaagtcaccgggggcgaagtgtggcgccgcaagggaatactctgaagccgatgtttcggcaaccgtctttttccacttctggacggcgagcggcgaggccaccggtttgcgcacagggcttccgaagagcctggccgcaaccttcacgacccggtcagcagatgctgaagtcccaagggcaacactccctcccaccccgccaacaccgaccgcagcaccaggagcggtcgaaaacccaggctctgaccagcaggcgaagtaggggtctcgtccgaagactcgtcgtcgtcgctgaaaacgcgagcgacatcgacgagccccatttttttagaggtctttttaaccaaacccctcttcgccaccttgcccgccacaaacgaaaccagcgccttcgccccctccaaatcctttcggcggaggggggagctgttcgactccacccagttttgacatggtcgaggcttggagttggggtgtacccacgcgtctcggtgcggttgtcggcgggctcgtccgcaacctccgtctcgtcctcttccccttcctcttcgccgtcatggtcatcgacagtgtcctcatcatcggcgtcgaagttggtagtggcaggggcccttcgctccggggagccagtttaacttgcctgcgtgtccgcttcatggaagtcccttcatcaccgttggccttatacggcttcgcccggggaggaagattgccatcgtacactcggttcgcccggtcggccgcctgccgtgtaagtagctggctgtattcggtgaccgacacatcaccgatcatcttccgagcttcggtgtcggcctgagcaagagttaacactgcaaaaacgaaacgtgttatcttattaggcgccgaataggaggaaagagcaaaatacagacacatataggaaagcaaaaactcactgtttgccccctctggcatgacgagcttcggcaagccatcgacctcctcgtctgggctcacctcgacttgccacgtctgggagagagggaagatccgaagcatacagaactcttccaccaggtcacggcagctaaggcgggagcagattttgcgaagcagggcgaaccgggcttccatggcaccatcgacagtgaccttgggcttcctattcggcgcgatcgccctgcgacgccatcggagagctttcgccgactcggacccagcctcgaaggggatggattggtaaaaccacttcgatatccagtggcgatcccacttggacatggtgccgttgatcgggcatagatcagagcgctcggggcgaacattgaagttcatgatctcgaacgccgtctttttcgtccctgggggagtgaccaccgtcttcgagtttatggtggcgtaaaaaatagcaccgaagagcccggcgctcgattcgaaaccagcgggccggcacgcctagtcgaagatggcaatccggacgagagccgatgggctcagttgggggagctccacctgaaaaaagcgaagaatctcaggcaacaacacgttgcacggaaaccgaaggcccgcttcgaagaacacagcgaagaccaccgtccggttgtcgccgggcttcggcaccacagcctttcctaaggcgaaggcctgcttctccgccagcacgccggaggtgaccagcttcatcaactcatcctcgtctacaagcgaaaccccgagataggcggtggcgtcatcatcgatcctgccgagatcagggcccgtcacgtaagatgggttcgggttgcgaggggccatggcgaaaagtgcgagcggtggcgaaatctgccgcttgtggagaaaaaaaaaggaacggtcgaaaggcctagtgactcaagaacgccgtgaagtgagagagcggagaaagagaatgctcgcggtgaaaatgacaggggcgtggcggtgaaaaagggtggggggatatataacccacccaggcgtcggttcgccttcccacccaattgtaagccgccacgtgtcacaagggttcgcgaaagagataatccattatatgccactgactttgtcgcacgtctacgatttgccactgactttgtcacgttctacaatatgccatcgacttttgcttaacttctacgatttaccatcaccgttcggttagccaccgttagtactgtacaaatttgtcgaaatgaccaaaatacccctatgacaaaaacttccaaaatttggataaaattatcaaaatattatattataaacataagattgtaaacatccaaaatttgaccaaaaacttgaaatatgatatttcataatttttatccaaattttgaaaccttttctcccaggggtattttggtcattttgaaaaatttgtacagtactaacggagactaaccggacggcgatggtaaattgtagaagttaagcaaaagtcgatggcatattgtagaacatgataaagtcagtggcaaatcgtagacgtgtgataaagtcagtggtaaataatggattctctctttgcgaaatggtaaattcccattcattgagccgcacagtgctaagcccatgagggaagcccgtcactgttcattgcggcccacaaaaagagaacggcttcgctgtttgcaaaaggcgaaagataggaaaatttactaaccgtaaaagtacatatgcacaaagtatacacatttcttgcaggactccagtataggtttcggcaggagcgtcggtcgaaagggggcgcctcatgccataccacatggtttgcacggtctcggccgaagctcataactcacccttgcccgtgaggggcttgttggtggtatgtcatgagacccttcgaccagacctaccgaaaccatgcaacctgtgaggattcaggcccatgacgataagatcatctgggcgaagtcccatggcgaagactatgaagtagagatggcgaaggctgaagaatcgcgttggtatctggcaagaccaaatgcatcattgggcgaagggtgtatgctgaaggatgggggcttcgccataacaagcccaactttgaagaggcccaaggggccatcccagccgcttaggcctgttcgccaattggcccattagaggcccatgtatccaaattacactgtatacccaatcaaacgtccctttcataagggcagccatgtaaattcccctgtaaagcctaaaccctaatgggggaacctgtaataggattataaatagccccgtagggacatgtgaagtggggatcccaaagaaaaatctcaaaatactacatttactttttccaacactgttgagtaaccacgtccttcgacgtacgcggttgtcgcttcgacaacagggagatactagtcctttgtaggacaagaaaaaaactttcctaaaaaataaaaggaaaatataaaatccttataggacactgaacacacttttctaaagataaaaggtaatgaacaaattattcctaattaatagataatttgtcatgtcgcatcctcttgaactacttctgcataagcttcctttaatagattaatttccttaaccgaatatagcagtaatccgactgttgacgatgtgataattctctcatgggcctaccaaattttgtcgttaacaggaaagcatcatattcatttattacttgcatgcagattccagacagcaaagcaaccgcagattcgccagtgatggacagaggtctgctgaaagcagccacatcgggtgtgaagccggctctgcatgacccaagccttctgcttggaaggacagtgcaggggaacacctgcctccacatagcatcggcccatggccacgaggaattctgcaaggatatcttgatgctgaacccgtccctcctctgcactgtaaacgcggatggcgagacgccgttgctcgccaccgtaaaaagcggcaatgtcgctttagcttcttttcttctcagttactactgccgccgccatgacgatcttgatacgagggaggcgatggtgaggcaagacaagcaaggatgcaacgcgctgcaccacaccatccgcaggggacacaggaagcttgcattcgagctgatagaaaaagagcctgccttgacgaaagctgttaacaaacacgatgaatcgcccatgttcatcgcggtgatgaggaatttcaccgatgtgttcgataaactgttggaggttcctgattctgctcacggtggaacctccggatacaatgctctgcatgctgcctttagaaataacaatactggtgagaccctcatcgatctagctatatgtatcgatctagctatatgtgcttgttaaccattaatattatccatgccttcacatttttttctcagatatcgccaaaaagattattgagactcgtcctaaattggcaagagaagagaacagcgcacgggttaatccaatgcaatttggtgtgcttgagaacaagattgacgtgctaaaagtattgttggaacatgatttctctttaggatatataatcagcacaagtggtatccctcttcttggtagtgccgcataccagggccatgttggtgttgctatggagattcttaaacattgtccagatgctccatttctagttgaaaacgatggcaccacatgtctccacatagctgtacaaaaaggtcacataaagtttgtggaatttgttttgcagtcaaaggagctgcggaaactcattaacatgcgagacagaaacggtgaaactgcccttcattatgcaatccggaagtgccatccgaagatcgtcgctcttttactgcaatgtaaagcccaggatgtcacagtgctcgacagcaacggtaaccccccaatctgggtaccaaatgatgccgccgaccatgctaagacgctcaactgggtacgtacgcatatgctctccacaacatatatagcgtctatatatatgtcatcgatttctattctaatatattaaaaaatagtaaacgatgctataatgttgaaaaatatctcctatttaagcaatttgcaaggtataattttcagtcgttaaagagaaaagagtcccactacattcctacctaccagtactataaagcaatcttaaccgttgatctcatttgatcgaaaggtgcagatctatttatacaaccatcccagttagcagtactataaacatgaatgggtattattgtctaagaaaatagatgcggagaggtataatcatcatttagcagtgactaaacctactttttcttcgatgttcgcatgcggttggccgacccgtatgcgtgaaaaggtttgccaaaatcgttattttcccatgcgggttaggcaaccgcttgccaaaataggatttttgcatgcaggcacctaagccagccgtatgcaaaaatattttcgccaaaaaaatataaattcaaaaaaaggcagaaaccctagccgcacaccgcctgccacgccagatcctgccaccacagccgcccgccactggccatgccagatccatgctgcctaggccgccgtcgttccccgcagccgccgtcgctcacagccgtcgtcgatccgcgacctctggccgtcaagcctgcagccgccatagccatcgccatctccgccgccgctcccaccgtcaccggtgctagatccgccgtcgtgcgtggggggtgggagcggccgccatcgccgatgttggcaccgccggatcagccgccctcaccggccgcagtcgcgggggtcgtagccgcaacaaggtgtgacagaacccccccacccccaccccccccttcccaagagcgccgctgccgtcatcatccaccgtcgccgcccaccatcgccaaggtcacagccgcacccaagggtggcagatcctccccccccctcttctcgaaggcgaaaccaccggatccgccaccctcgccgtccaccgtcaccgcccgccgtcgcgaaggccgtagccgcacctgagggcggtggatccggccctcccgagggcgccgcccgctgtcatggaggccgcgcagccgcccgctgtcgcaccctcgccatcacccgccgccacacctaatggccggcctccccatcggcgtcgccgcctgctaccgcccacgctgatttggaggaggagaggagttagaacacgaggagaggagaggagagaaatatcaggagagggagagaggagaggggtgaaaaattttgaagtggtgaggagggaaagagagagcataagagaaaaaaaatagatttttgcatgttactccttaagaggaccgtataaaaaaaaatcttttttttttttttgcttacggtccccttaaaagatccgtctggagaaatcgatttttgcataagctggcacttacgggccgtttggaacctactgggagtctggtccagaaaaacgttttctgtagtacaacatgtcagtatatcatgccgagcaccaccgtagaagacttaattagcttatgtgcaggaagtagagaaataactgaccaaatatatatagaagaatattatgagagaaatttattcacaagtggagaaaaatacactcactgttacagaaatgagccttcgtgacaggtcatccatcataggtgacttctctcattgattaagggcctgttcactttaatgacattttcaatcataccattttttttacaaagttacttaaaaaaatagatacgtttaatttgttgccatagtcaatacataagaaatcctgccaaaattttactaatattatcatcttgctaaaattttagcattgctaaaaacttggtaaagtttattttggctacaacctaaacatgtcctgaaaagtaacccgtttgataaaattacttaccagggataagctgtagaagacttaattagtgatcatacgctgatatgagttcatctgacgggagttataacccgtcactgaccacaataatgataagttttcgatgacgggtatagaatctcttaaaaacaagagattgtatatttcgaaaaaaaaaacagggggttgtgcgcatcggggtttgagttggcctttgctcgtatggatttgttgtgcaccggatttgaatggacaagttgctgcaccgggacaacagatttacaagttattgtccctatttacacaccccacccaccattatgtatgagcacaattcccttttcttaactagcagacattactactcattaactatattgacattaattaccaaaatggtgcgttatcactcaccaaatgagcaggcaactgctgctaacacgtagcacactctcaaaccacaggtagagccatcgacttaggtctgtttaaggagcttaatactagaagcagctggttggttgctagtttctgagaatttggaaaaagatatgttttccagcttctggctttagttcatttctggattctaaaactagttctgttatattcaacatggtataggaattacatcgatcatcagtaattcaaggacacttcaaattgtttagttttattttaaatttgcaaacatttgtggcagacataaattgaaacacaaaggtcaagggaagtgggcaagcaccaaaattgtgtgtatagttccatgactatcaatcatattactaccatggccatacataactttgtaataaattaatgcagagtgaagtctccatgcgtatgttgaaagctgacccggaagacaaaggtgaaatctataatcttataaaaacaatcaaagatcaagtaactgagaaagcaaggaaggatataaggacattgactcaaacatacacaagcaacacttctttagtagcaatcctccttgcaacaatcaccttcgccgctgcttttaccttgcctggaggacacagtaataatgctggaagtgaggggcttcctaacatgggtagaaagcttgcatttcaggcattcttgatatctgacacctaggcaatgtgcacgtcacttactgttgccttcgtatgcatcatagcaaggtgggaggatcttcagttcttgctttactacagatcttttactaagaagctcatgtggtttgcatattttgcaaccactaccgcattcgcaactggtttatatacagttttggcccctcaccttccatggttggccattgcaatttgcgttgtgtcagttttgttgcccattctcactaagcttattggtgaatggccagtcctgaagctcaggattcgattgcttggatctttcgagtccgatctcattgatatggtttgatctaaccatcttgtgttgtctagtactttatggttgatagtgttatgcatttaataaattttggatgccgtgaaaagcaaaacttatgtaacgaactttactaagtcaagcttgtactcattaacagtactgttaaaaactgtcagtgttgtttttctatcatttaagtttgttatgatctgctgtatggaacatttcttgaaatctgaggaaatattttgagtcattactacaagaaaaatactttgtagagacatttttctagtactgtagagaaatttttcaaatgcttttacaatagtgtagaggcattttaaaaaatgtctaataagtgtcttatggtaactataagatggtagaggcattttctagagacattaaattataccacaaacatatgaaaccagtccaaaagaggactttcggtgttgtttttctatcatttaagtttgttgtgctatgctgcatggaacatttcttgaaatccgaggaaatattttgagtcattactacaagaaaaatgctttatagagatatttttctaagtactgtagagacatttttcaaatgcctttacaatactgtagaggcattttaaaaaatgtctaataagtgttttatggtaactataagatggtataggcattttcttgagacattaaattgtaccacaaacatatgaaactagtccaaaagaggagatgcattttaaaaaatgtctaataagtgtcttatggtaactataagatggtataggcattttcttgagacattaaattgtaccacaaacatatgaaactagtccaaaagaggagaataaaatagtctcattgcttctgtcaaaccttgaactcaagatctcctggacaaatcattttttttatcctcaatgcactaaccaactcaattccatgtcattagttgcatgtttgtgtctttagttatttatattcagtcgtttagtacacattgtcattttaaaaagtatctttacatagtttaaaatgtcacaagaaaatacctttacatatcaggcgcattttacagtaccgaaagaatgcctctacgagataaaatccaataaactgagctgaaaatgtctctagagtaaaaattttctaggcaatttataaagtgtctctacactataaaacttctgatcttagaagcaatttagaaaacgtctcaacgaaagtgcctctatatgaggtttttattatagtaacatatgttttatgatgtatcaaataccactagaagatgaggtgcaccaatggtgcgcctctagtaatgtgaggaggaatgaatagcaataaaagttaggaagtgatcatttcttgtgttgaggagtcctgttcagctaaacctgaccataagaatggtaatgcccattggttcattgttgcaatatagttcaatgacatatcttattattcaccatatgtaatggctagacattagatacatctgctgattatgaatctgaaatgtgtggtaatacaacttctgatccttagtgtcaacagctctaaccataaacaatttctgcatctttgttcttgttaaaagattgcatgatttcaatcacacaacaatcctactatttatatcaagtatatatacctgtcatttatatcagttagtacattatgaagttgggataaaaaatatgttctttgttctgttccaactcctgatcaaacatacaaaatactaaactagatcatctggcagcacatctaatgattgtgtcctccatcttaactagctgcaaagtatgttaagatcagcacttgatgccacaaattttaaaatattataacatttcagaaaaaatcattgaacactatcatggaacaaaaataaaaaaatgacagccagtcggagcaaagggctcaaaattaatcaattaatctgtttgcatgctgattgcacagccccactcacaagcttgctgaccaattcagattggtgatggcaagagtatacagtaaatgacagtttaagggcatgctcaaagtgcagctataaggaacttgaaagtaccaactcaattataccaaacaaaacaccatatcccaataccacttgcttacagatctaaaaaaaaccaaaaatcaataatgtgctcttgcaatttctggaagccatcatagaacaacaaaattcaggacagcatgtccaagtatcgacttcatagcaactgctctgcttgaatggattatggcaaatggtgatgaggttctaatcttcagattctgcaggttgagaaaatgtgattaaaaatgaattacatcaggatgcactcctaactgaatatttgaaagaacaaggtaaaaacaaaactttcttaaggtagacaaactcatctcttcataatacattcaagatatataatggtgctaaatacaacaattatataggagttagatcacctgcacgcattctctccacgagacatcctttctttctctaattgatagaaattagcaaatccttaaactaggtacataatctattagggaaaatagaaaatctagctaaagaagaagactccctaacgttttccttgcacagatgggtacacagtatctggacactattgtgcatattggatcaagatggagagcccaaaactgacatgacaacaggtttcagttacagtattgcatttagacactccacatatgaatacattatagtactcgaactgatattcttttcctttgcctattcaattcatcaatagcctgaattacagaatctccatttgcacaccaatccagcccatcacgccatgcttcatatattgctacgagtaatcagatctaattattcttatatgcacaatttgaagcttaactatatgacaaaaccaattattttgcttctaactgctcacaccataaggtagcgacaaatcaaaatcagaacatattgtcattatgttcacttgttagtctgaacaatctaaagagactaaatttggagacagtgtgctcatgccattagtagctgattaatagttgccaaaactccaggttatactcaagaaagctgattattgtttttatgtcttcgatagcaaactttattgttgtagtcgatagcaaagatcaaataccattcaaccaatcatgtgtttctctatcgatagcaaataacataaacttcagacatgtctttctctattctatggcagctagctatagcacatccttaaaaccttaagctaggacggtaattaatcgattagggaaataaataatcttgctagccttcctaaagtttaccctaaccatctgccacattaccttaaccaaatggagagttggtgatgactccgaatccaaatcagatgggtcggtgacaacacgcacaacaatgacaggtagccggtggggaactcattgagaatcccggcgggggaaaggagagcggctggcgggagttagttaaattttacactaaatttttgtatctcgcggtactaaattttacagaacctcatggtaccttcttaaggatggtaaaattaccctctatatatacctatcttgagacactcaatatatcagttcaacgaattccatcattctctattatttacactatttgcatccccaatctgccattttggcatcttgtgctctctctaaaatcaagttggagtgttattttcccactctttcagcttaaaacgatgtgaatccaaaagatttatctcaagaattacagctctgcaatacttatatacatgtagttgttgttttcgacttgggagacatcaggagatcacagtttatacaagaatggctaagggctactttggattgaagggactccattggaaaactagaggaattcgatccaaacgagaaattcctaggagagatcaataaatattgtgaaattggttcaaaataatttttaaggatagtaaaaattcctccacagtttggaggaattctaacatatggtcttgccttacaaatcccctcgagaactccaatgcacttcttctctatcttactcccttctctctctaataaatcaacatataaatcttattaaatttcctgtattttttttccgtgaggcatacaaacagcattctgtacaattcgtatggcattcaacaagtcatggcacctcaattcctgcatttttctattccttggttgaaaattaaaaaaaaaaatcctgtgttcaaaggatgcttgacaatcaaatgaagctttgtatgaatgggtctctatgcaccagagggtgacgacttcatgactccattcttggggccagaaactggaagaaggcattttctttggtattgggccgtacatttgattatttttttccgagaaacagcaaaagaggctcctattacagtgtattaaaataatgaggtttatatgcaagaaactgtacaggagtaatctcattattgttctttttccggttgaacaatgcataatggatttcagcattcagagatttatctgcttgaacaagttgtgaagcggtattctcgtaggaaatttggttcgcttaattcattatgtactcgaaggaaaatgtgttttgctctttgtgggttggatagtgtataggaaaaacctcccttcaaaacttcaaaatgactctttttaggggcttcaggcagagctcatctactggacttcagatgctactgatggcactggatgggtgtaaatgttcgtcaaaattaacacattaaaccacctagctactttgtattcattcaaaccaatccttctaacgaagtgacaccattttctaaaaaaaaaaaaaaaaaaacgaagtgacacctactgacctacatatatttcatatacataccctaaaataaatagcacaatagtcacagttgtagaaccacagaatccaatccttctaacgatgtgacacctacatatatttcatatgcataccctaaaataaatagcacaatagtcacataggtgtagaaccacagaattaatcaagccaccataaaacattatctgaaataagataaaagctgtcagacctattgcttttgtgcagtcgagaagcaatttttttctgctgttggcatgagatgcaacgggaaaaactgtgtgatagagtgtagagaagcatccatttgaggcgatgactgaacaattgacgggtgattgcatcccaatatgttctagcaagtgataactccaacacagcaatgtagggcgtgcgagttttcggtggcagagaacaatgtaagacctgcttgggttaactttcaagtatttgcaatttgccttcaaccatcactccaagacaagccactagttcattctttgcacaggtcagttgcaaattagataagccactaatagctaaatacatattgatccatcacttccacgattcaatcagtactaatctctgttaaatcttgctagagatgattaaacctaacacagacacaggtgttagtggaggcaatccttcagttaagtagaacaaaacgatctattactagttgttgggatgatatttgcacagaaatgcatgcttaagataaattgttgcgagggcactaattgacatccttgctaaatagtatccctcctatatgcttcaatgctttctcatactctgccttctgaaactcatcaaaccttgaagtgtctgccagcaacagctctgtgtatttcatgtaaagtgctgtttctttctttacattcgcttcatcctgctttattctggccaattcaagctgctctttcgagaggcggagctgtacctctgacattttctcacgatcattgttaagcatggtctgaagatataatgcatgtttgatgtcttcctgcacctcacatgaagaagatgatgccttgcctttacgtttccgattgacctttcgcgccttgaaaccttgatgaggctgtgtttcttttttaggttcatcttcccttgccactctctcattgtctagcacctcaaaatcttgtgggcccgattctttttcaagcatttcatccctcactgccaccccctgctgatgttcgttcaattttgatgttccagtcatcaattggtgcctcccaagctgaaattcaataggccacgacgcatcagctggtcaatagttctaattgcttttttgatttgagacagaccggctggacttctgtcatatcttcatggttcttgggaagcatgtccagaggatccactaagcattttccttcttgcatatcttcagagtcttccgaagatgacacgtaaccaccggactcagatcgcatcactctttttgcggagaaagaagagatgtattctttccacttgggttggtcccaaacagcgttccagcaatggccaaaggtgaacttatgcttcgcttcttcgagatacatcacatgtgcttccttattatacatcagccaagttttgtccatctgttgcatgccctctgactggccactaggatattttgccatgacccggcaccaacaatcattgaaatgtgccaccttattgatcatcctctgccagcggttcttcaaatgcttcacttcccttctccgagctccgggggttgcactgttgtattctgctgcaaccttatcccagtacttgtcagtcttgtagttaatcaaccaagtgcttatctgtagttccagcacggagatgttaggataccatttgcaatgtccaaaaattagaaatagaaaaaggaagaggaatgcttaccaatctaatgtcttcctcttctgtccatgctagtcgcctagcagtcctctcaggttcagcatcgtcatcatcttgttgtcctggaccagttactgaatgtggggtgccttgatcagagggtgccttggatggcataactgtagctggtacatatggtgatggcatagctccatcaggtggcggtaatgagtatggagcatattgtggtggaacagcatattggaaattttgcgagtatggaggatagtgaggaaacggcgggaaagggaaattcattgcatatgctggatgtgaaagtaagtgctgcggaaattgtggatggcagaaactcgtggagctgggtttttctggtgggacattttggcaagtttttttatctgaataactactaggtgggtgaggccccattgcaaatgagtggaatggtgtgaaatgtatatagtgggtatgtcaaacgagcagaaagcacatgggtttgaactttgaagccaattctgagaacctatttggttgaagttcccaacagataaataagaatacacccaagagatatcttgttcagctctaatttcatttactgttccgttggatgccacttggaggagagcaacaaccctgcagaaacatatgttgtaaaaataagatttcaaatcatgtaaacaatcagatttacttcgtccgtttcatattattacacttactagcaatgcccacattcatatatacgttaatgaatctagacatatatgtgtactagattcattaacatctatatgaatgtggacaatggtagaaagtcttataacctgaaacggaggtagtactacaaatgataagaaattgtaatacagtactaatgaaatagttcaaataacttattaattcctttggcgttgaattgtattgagttaggatctattttctagagctgaaagggcaaactaaagaatcatttcccattttcacaagggccatggagagtgaccaaaatgctgctcccatcgagaagtcaagaatcagtcgaggcaagcataaaactgcccactgagttggcaaaaaactatctgcctactgttgattaaaacctgtgatgcacccctcccctctgccaactcacaccccgttttttttggaaaaaagaatgatctcagcaattttttttgttacactagcaaaacatgcgaacttgaacagtaaggtcaaaatgaatttagtctgattccagtggtggaaaacaaatgtgatgcacttggaacaaatgcatatgggtcttaagtaactccagacaacagattcagggaaaagatttgtcagataaaaagtagaccaaaaggtacaattatatggaacagaatctgctatttcttcttttcaaaagctaactgtgacattttattgaaaggaatcagcgttaaatataaatatagaacttgatgcaagatcaattacaccggaaacgtcactctcaaaccaaagtagacgctgttggagtcttgatactggttttcagttcttttcacagtaaggcttctggaaaaaaaaaggctatgccatttgtaacaagaagttcttgcacaatttctacatgacattctcgttaatcatagaagaacataaacctgttctttacaatgataagatctagctcacttgtgcaaatttaatgtcaaaatattaaggaaaactaattacctcatctttcataaaggacatgctaaacagaacatgaactagaaataatcacctcctaaattatttttcccagttcaagtgtggcatatattgtggtaggaccagagtaagagactggatagaaacatcagttctaaaaacaagacaaatcaagggagaagaggaaggtcaagttattttagaaagtagcaatccatctccacaactcaattaactaaacatgaaaactaataagatgtgatacaagaagaaaaagcactggctgttcaacaaagcaggaggtgcatgatgctatcactcaactcaatattgactatttatcggttttatgccaaacataacaattaattagccacacaacatccaaaactttagtgcgacctgtttgaaggagcttcctaatagtctgtcctacaggccacaatgtcatataaacaaatgtcgtataaaagaaaacagttaccataaaaacatgacatggatggttcagtcactcaaaaaaaaacagaggaatcaaaggtccattattcactctctgacggtcttacaaagtaatattctcccaaacaaaacctgagatgtacatagaccacaatgagaataacctgcagattgggggaaaatacatgcatgtcatctgccaagttgggaatataaatggacatatagattggttaattgcacaatttaaccacattattttgcctactgggacaaatatgtatcaaacagcagcaagaaaaaacacctacattatcataacaaaaatcgacacgcataatctgcaaaagcgtgcaatccgatttggggaaaaaaaaacaaatacctaatccagcagaattcttgtgttctggcctcctgttgcgatccctcctaaagaaaacaaaaacaaaaactcaataagatcgcaacactgcgagcaagagatttacacggcaacgggaggagagatctctttgagataaaaattaagattgggaagtaaagatgccgtttccggaataccaaccgacgtcgcgcggcggcggaggtgccggagaaacgaagggccgccggtgctcgggcgggcgggcgggcgggcgggcgctgcgtcggagagcggaggctacgcgcggacggccaggaggacaggggagttctccggtgccgaggtaccacgcatgcagccggcggcggcggcgagggttttggctgacggcggaatccgggtgtggggttcaggcggaatgtggcactccaaagtcaaaagggccaaatttaactaattctccaaggttaggtttggctattatttacaactcccatacaagatattatttactccctccgtaaaaaaaacaataaaaaaaataaaaaaccaacctaacaaagatgagaaattacatagtacaataaatccatatctagattcgttgtactgtaacgtcgggaaaaatgttttttctagtagtgactcttctctgtggtttacttatatgcaacttgttcttcatttagttgatgtatattgctggcttaatgtacgatgcacttgatcaaatggtgcaaacctatataatgcattttcttctgacaatataaattggttgtaccacccacaacagggcagtaatgagatgtagcttaatagccgaagatgtggcagaggtccttgacaacaatgatgagcacggcgttgcttaaccacaaagatgatgggaaacagatcctccgactttgtgcagcctgcagttgtgcgactgacatgtgggccccatgtcagtggcacaattgtaaactgcacaacatcaggggagtctcatctaggacgatgagtagtaggatgcacgctttgcggtgctcgagtctagtgctgtggtgtggtgtgggagatcaatcttatatatcttctgagataagagggtttgtagtacaagtggaagttgcccttgccaaatttacacatgaacatcctctcgcgatcaacttgcaccgaaatgcctatttctgatgtaggcatgtaaacttggtggactgaatgatcctgatgcctcacaatcctatacccgcctccggtataaacaaatgaaaagcaatattccccttcaaagggttttatcaaggacaagcaaatttgctttactcgaggagtatgtaggtcgcccacccagttgtgcatgctttctgtgaatctcgaagcgagcttacaagatctctgtgcttggagagatagctgtttgttactctatttcttggtttacttatatccagtcttgaaatgtttcaagtgaatgggacagatcaccatccgccatccgatcgatgatttgtggtgcagattgcgcaggagttcttgccttgtgagttagcagttttgggcctggagatccttcttggtccctcaaatcctagtaattttcttgcttccattgatgctttcccgtttgctcatgcacccgatttgtgtggtatcggtgtgaaacgtttgcatatgctcattcgcttggtaataccaatatgccatgaagtttctactgctgaatttatacacatgaatggaatctgttgagcagcttgcacccaaatgcccatttataacgttggcgtgtaaatatggtgagcggaactctcccggtacctcacaatcctacaattgtttacaggatcaacaaacaaaaaaaaccaccgtacggtagaacacccacccaattgtgcatgttcttttaaccatcacagcaagcttacatgatctgtggatgcagaactgtttgttgcatggtttacttatacccagtcttgaaatgttgcaagtgattgggagagatcatcgtacgccgtccgatcaacgatgtgccacgcagattgtgcaggagttatccctgccatattgcaaattagtggccgtcgctcaagtaaatctgggccgcaacttctggacctgaaagtcctcatggcccaaagggcgtctgctcatacacacacaggcctgcatgtctctcctcctcagtaacaaatgaaaaaacattgttaattcatatttaatgggattttgcttggaaacctagctcaaacatttatttaactgatggtgagtatggtactatggtagaatctcgcatgcaaatttgtaacatgtcagctcacttaaattctgagaaagcaggcaggtcggactatattcaaatttagtatgaaaattcctagtttgtgtcagtgccatgcatctgtagaaattaaggtagaggagagctcagtgatctctatagatgattgacaatttgagtcaatggactgaacatcgagcggatctagtttgcaagggaaattttcaatgaatccaacattccttggatattaatttcctggatgtttgcgacattggagccttccatggcaatgtaaatagctacatatccttctcctaagtacattaagaaaaatgactccccaaatactaaaattctattatatatatatatttaaataatactatattccatattgttctatcaacagttgtcgaataactatatgaagtagaatattttcacctagcatacccaagcatttctagatcaattgatggtctataggtacacgacgtcagtctgctggcactcttttttctttacgccatagccaacgcgaagacgtggcatgtacctctagcctcccacgttggacgcgaggtcaaaaagcgcgcgaacctcctacatacgccacgccccctgtgcgaggcgccgatctaaggctagggttcgagccgtggctcacgttgtgcagcttgaggcctctcggttgtgcagcttttcattgaacaggacacacctgtgggtattgtcttcattggagaaataaggtcccttgtgtagccttagcccacttagcaaacggggctacggcctgcgttggccatggcttgatgtgcctacaatccggagtgccttaacactgctctcacatgatgcttcaaccatatatttaatcaagaaaaatgttgaggaagcctttgtaccaattactcctgatactacacagtctaatatgcattagacatgtataaacgatatatagcaaacatctctatgctggaacaagggacatctgctctgtttatggtacagtgggatagatcactacctcacgtgagtttgagccttgagcgtattcacctttgccgctcttatataagcatagacacacattgtatattcatgataattaccttagatattttttccttttaacaaactagcttgctaatacataaaaaatgcacccgattgattgaattaataataacaaatggaagagttttttttttacatcctcgatgtggtgtgggcaggtattacgctttccaacattatttggtatatactccctctgtttctggttacaagacgttttaactttggtcaaagtcaaattgcttaaagtttgactaagtttatagacaaatacagtgatatttatctactaaattggtttcatcaaatcaataattgaatatattttcataataaatttgtcataggttgaaaatgttactacttttttctacaaaatcggtcaaactttaaacagcttgactttgacgaaagttaaaacgtcttataatctgaaacggagagagtatatgaatatttgagattttgaactaggatggcaccacaatttaaacatgtgtggtattgtagtactaccttctcaaggatcattaaaacctgaaggcagacttcaaaaggttctgagagttggtgtctcagttaatgtgttaattgtgtatgggacattcatccatcaattctcattcttgcagttgcagttgcctgatccataactggcttattaattcaaccacaagacattggaactatcaaacatgacagaaatagcaaatggcagataaaaagtctttgaatccagcagaacaaacttgtgtcatgtatttggtttctatcagtgtatcatgcttctctagaaacatataggagcatggtgatctgtagttgattggcatttcgagccactggactgaacaccagagtctctgatttgcatggaaagactaataatatatgaattcaacgttccctggatgttaatctctagcagaatattgtttgaactgttttggaggagcacaactcaatcaaatttcatacgaatgccttcgtatacagttccagttcaacaaacatgcacttatgcaacagagtcttgctgttcatgttccacgttctccctacgctcttctgctgttcctcgctgtgacaagaaagaggacggccattcgattggagggctgatcagaggaccatccatcaccggatgcaaacaaggcgaagttcactgccactgcgatgcaaagcagaagaagaggccacaatcgctaggctatagaggaaatctattcagtttgcataataggtgagtatacttccacactcagcccatcctcagaacatggtgaacctcgcaagcttcagccgtgtgctgttcgcatgctgcacatctcgggtgcagtatctcctattgatgtatcctgatagtggctcctgatgcttcatatgcctatgctcatgcagctgatatttgagagattgaatggcatatgcactgtttaggtttttatgggagtttttggtttgtgcaagtggagggggtcacttgatagaactttgtgacctatgagactgaggctctctcttacatatatgggcagttcttcttgattgaacgaatgtatagttggtacaaactagttagtttatttgcttcatattaaaatatagagcagcaagagaatggacttgtggcttcgcattattgttgataacacattattatttacatcctgattaaatggactgttcttggcatgggttgatatttaataaatttatagaaaaagttaattctgtaccattaagaagaagcacacactcaaaataaacaccatctattatatactaaaaatctattaaacttcctcaaaacgctcttaagccgtcagttagcgctctaataaattaaagaaaaacctagaaaatcagagaaaaaaacatatatctttcgattttcacttaaatcggtagttccaatactataaatagttagattagatttcttaaaacaaatcgaccaaaactcttatatagtctttccttcccttcagtaggaaaacgtacaaatattgaaacattgaccttccttttttctttttccacgtatatagttgagacaataataataataattattattagtgataatattttttataaaatagttactttacaaacatttaatatattatcatatcactctttacaaacagatgcaaataaattggctctacaatatttaaaaacaaagttgatacccattattttatattgtgtacacattattttagactaattttaataaaaatatttgtccaccgatttttacttaaatcagtattaaaccatcacaactatcttttaaataaacaaagcctcgaaatcacaaagattttgagaaaaaacacacattcactaccagagagtgtgaagctatcgagtgccacagtaagttaccgtgagtttttgttggaactcggtaaaaaaacaagaataccgagtgtattcgagaaaaactcgggaagctaacaaaaaataccgagtacctacctaataaacttggtaaccatgggacccaccatttttaccgtggcacgggcggactattttggcttggcgcgcaaaatttccgttggcgggtggacggcacgcgaaatttccgttggcggggtggacggcgcgcgaaatttccgttggcggggtggacggcacgcggaatttctttggcgcctgacgatttccgttggcgcaggcggatgatgtgccacgatttttggctgcacagtaaattttcgagtgtttgtgtctattcaccatcgggaacagactggcccagtagaaagttggcccaaatagcaccgcaaaaccctacccatgaaccgctcccccttctcttctccattctccgagaaaattgacattgtgccactctgcaaaatgaattcgataaaatgccactatcaacaaatggttacacgctaaaatactatcttgggccaaattaccctcctctcatcttcttcctccctccatcaccatcagctctcgctggcggccaccatccgccttcgcgtgagctctcctccatggagaaccacagaccacaggcccctgcggggacccctcccatggctcccctccccgtgcctcctcccatcgcccccatcccagccccacctccgcgggcccccgcacctatcccgaccgccgccgccatcgcctccacctccgatgaccaccgtgccgcgccttcgccatggccatgcccaccaacgactccaccgtgcgggcgcgccttcgctgcctggaagaacgggagcggcttggacggcgggttggcacgaaagatggagaccgccgacgtcggcgtcggcggcgtagatggcatggagcatgaccacggggtcatcggttggttgcggtcgaggcggggaggaaggggagcggaggtgtaggcggacgaggcaagggttgtcggggaggaaggggaatagaggtggaggaggatgagtcgggcgcggtggaggcggggaggaagggaaccggaggtggaggaggatgaggcggggaggaaggggagcggaggtggaggtggatgtgccgggtgtggtggaggcggcgaggaagggaagcgcaggtggaggcggatgaagcgggcacggcagaggcgagccggcgaggcatcccttgtcagaggtgaaaaaaggtagtaacaggggtatttttgtccgtttgggcattatatatagcgtgtagtcttcgattgaaagtggcattttagcgaagcccactcccagcgtggcatttgggcgaaacccacttttgaggatggcacaatatcaattttctcccattctccgcctccgccgccgcctcgctctcctctcatcgcctcctcacttttccctctccgctggccttgtcgcaggcagccatcccagccatgcgaccgcgcgtccccatcctcatcccttcacaaggccggcaagcgtggccctgcacgtccacgtccatccactctgtggatttgtctaccattgtctagccgttcagcaaggctctcaatcatcatcgagctgggcattgaggcctgctgcaactgcttcctcccaatctgtgtggtatgcgcatgttgagtggttcttgcatctttatgcgaatatggttcttgatttatgaaaatacacatcattttctctttggatctagtaatatagtaatatcctaatgggtactctgctgcatccaggcctacgacgctgtgacgcgccccatcgagttggaggctgcagctggtgccattcatccactttcctcctggagggatgcagcatttttcaggttgtactaatttctctatgtgcctgcaattttaatttacacgagagatgctctgagcgacgcaacaagcagcacaggcatgctgcggcggctgcagttgcgaggcttgcccctggctggctcagggagttgttgtgtgaccgctgtgctaacgagcagagcaaagtgatattcgcacaagtctggtttctaacagcaaaaaaggatataattcttctcctcttttttattttctattacttaatctttggtaaagtgtttctccggttagcaagtttagaaattatggttagaaatttctagttctgtagtgcacatatgcacttcaattatcacaagtgaagttctgaattctagctcatcctatttcttagttaatactcaattattatttctcagtcatcaaaagaacgcagctgagataatttccgactaaaaaatattattacggcaaaaagaatagtttatttttcatccatatcagaaccatacattcttgatgaaatcttaaatttcacatccatatactttgttgatcaagtgcggacaatgcacaatcatgtccctcgatacaaatgtcactgcttagcctactggtggctgtagaccatgcatatcctcatatcatattaggaaatctagctagcttcagttctgaaactctagaatagtaatacaaaccaattaattacttgataactttagttccgaaactcaatattttcataataaacagtgccttggtcaagaacttgacaatgattttgagaaggttgccactagcaggaatactgaagaaatttgcaatgacaaggagttgaagattctcaatggatcatctgttcaacatgatgacaatgactgcaaaatcctactgttctgattcatccatagaaatatcttgtttgacgaatatttctaaggtacacacttcacttaattggagatcacactgcaaaattattataacctgcctcccaagtcccaaatgaaaatttattttgtgaactatccacaagtacgtagtgtcctctaaataatctagttgtgttgtaatcttatttggcactaaacatgttttttttttataatttcaggcatataacaatcatggcaaaacactaaagagttgatttgtgctgtcaaagcacacatttggttagtcggccactagcatttgtctatatattgtctcattgcgagaggttgtaagaattgagaatcatatatttctattgcatcatgtgcagccagtttgtagatctattaatattttattattgtaccatgatgttcctattaatactgggagaatttgcagctaatgttcacatgacatgttcctgtgatgtatccttgcgctctgcctttcatgtttgcttgttgctgcgtttcagtgtagtacgacaatgaatttatgaaattcctagaatcaagtattcaatgttacctagtgttaatagctctcggtaagttatctaatggtaccgtgtgtttgactacaacacatggtaatattttattccttcccgtgagttagtacctctcggtaacacccccattccgttttcgcaacccatcctgtgccggtcaatacattgttaccaagaaagtgctttcacccagtaaattttcttgtcataccgagtgtacaagcgtagtctcacgtgaaatattgcacggtaaaggtgtgaggctgctgagtgtctgttcccgacagtctgctctcgggaagctctgttcccgtgttttttcgctgtgttaccaagagttattggcacacggtagcttcccgctccctggtagtgatttccctcgatttttcagttaaatcgatatatgaccattggattagacttgaaaaatcttgctaatcacccctcctgatcattccggctaatcactcctcttatctctaatacgtaggtacttacgtgttacatgtaaaaagaatacatacaaccgccaaaccctctcattggatatgattagaaaggactaatcccacattacctcattgggttccatttatcatatagcatggcattatgagttgctccgcatattgcatataaaccatgctaaggtagttggttgaaaagctatatttgttactattaaatttaaattgtaggactgcttgttgattatgtgtttttcttttcaaaaagtattatatagatcacacatataacaggaaagcgagatcaatgatatgtgtttgttaatttgtatgtaagtatgtaataaattacatcattgagactttccctgcatataacagggaagcgagatctatgatatgttttccctgtacatatgtaaatttggagtcttagttgtaccaagtgctctctctacttgttaatttgtatctaagtatgtgataaattgcatcattgagactttcccttacatatataaatttggaatcttggttgtactaaggccctgtttgtttcagcttaagattattgtaatctagattattaaatcggatcactctaagctggattataatacgctgatatagaataaggccctgtttgtttcagtttatgattattataatctagattattaaaccagattgctataagctggattataataagctgatataaaataagctgtgagttgtttgtttgtctggattattggaggcatggattattgggtttgaaaggctaaagtctataatgccctcagctatctgttcggttgatggcataggtgggtaatttttctcaagtatgtagaggtagtgggtctttagccactcaataatctgaaaaaagtttctttagagaagcttattagattataataatatggtttatagattataataatctgctataataatctacttgtttgtttcgcttactcctaataagcaagattataataatcctaagctgaatcaaacatggcctaagttgcagttgtttgtttctttggattattggaagcatctaagagtagcgggtctttagccactcaataatctagaaaaagctcttccagagaagattattagattatactaatctggcttatagattataataatatagcataataatctacttgtttgtttgaggttactcctaataatccagattataataatcctaagctgaatcaaacagggcctaagtgctctctctactaattaatttgtatctaattatgtaataaattgcatcattgagactttcccgaatttagcccggaaacaacctaatctgaaattcactcatacggagatttgaactcaggatattagagtgctactcaggtcactataaccactaggctacttgctctttcgcctctccagtgaacctaaaacgtgtaaattataagcagcttatgtaattatgttaattatggcaataatcagtatgagacacgcataggactgagagacatccggagaatgtgacaaccatttgcataggttcctagaacgagtgagctaagttgaagtcctagttatcattctgttcctctgaggtgcatgttgttggatagtataggaagagaggatactgcgaatattggaccactgtattgagcctcagggggctgatatatataggagtacatagggaagagataaagaaggattacagatatgaaaggaatccaaacaaaccaatcctatcctaatgtggctctaactaccatatactctaacatccccccgcagtccaagcgtgagcagtgcgggcacttggagtagagaagaaaccggcaagagtgctcaatacggatgataaccctttgtgccatagtcgacatagccaaagcgaaggttgcgagggagccatggtcgaggtagccgtgcgtacagtagccgtggtcaatgtagccgaagtcaggaagctgatgtcgagatagtcgagccgcaggacgcgcatggggcgccgcagagtggtcgtggacgcacgggaggggcgtcgtggactaaggtgcgtgaggacgcactggagacgaagacggtgacacaatcacggtagtcgttgaggaagatgacgccgaagagccgatgtagtcgaaccgtgaaggacgagacgtcacacagggtttgccagacccggggacaactcgggacgaacgcacgcaacagtgttgccaataccgtgcggcgagacaggagaccaccatgaatcatacgctaatgtcggaggagactagcagggaaggcctccgagacggtcgcggcgcgagaacagcgtagagggagaattgccggagcagcacacagttgctggagaagagcgaagtgtagtcgaggaagatacggcgacgctggcgatgaatcatgttggacgaagtagaaggtgatgtagcgggaccaatggcctggacggcgatgtcggtagccatgtagaggtagctggaccaccggcctagagtggcgacagtggcagcttggagatgcggcggcgatgctcgaagtcgatgaagaagaccctgagcggccgacgatgaccagtgcggacgacgaggttgtcgatgcgcgaacggcgatgaagacgacgaaagcggcgaagctacggtccgagaggacaacacagctacagctccatgtcgatgtagcggcaagaagtccactggtgatgtagaaatgctgaggagggcgcctctcagcactgcaacaaccagtggaggtgtggaccacaggcagcggcactgcgacccgaggggggcgaacgcagcggcaccccaaagcttgatggcgtagacgcgtgctcgatgacgttcaaatttcaaacattccttggatatatattagtctctcgaatatggtccaaacaacaacaggaggaacaacacaactcgatcaaatttcgcatgaatggattcgtctgaagattctagtcagacaagcatggagtcacagtgctctcaaatacagcacgatctttctgtttatgctacatgttctctctgtagcattctcccgttgttaagtaattaagggaagcgagaaaagtaattaagggaagccatagtcaactacaggtctgagggcggatgtacagtatatctatcggtatcaggtgacaccgatggtatcttacaaatacaacataatcctctgtgtttttagccaatgacaccatcgattaaagctcactgaccccggcagactaactaatttactctagcccacgcactaacagctagtaaacaatatactccgtattttgttgtagggaaagccagaacaattttgctgttgttagtattgcacgtgcaacagttgcttaattcacttctcgtatagtatagttctgtttatatataggtggaattaacctagcccgttgatttacttagttttgacaagttaaacaattaataatctagctagatgaaatgctacattactttgtttttatttagtttatactttaacaatgtagaataattaggtgtagaacaaataagagctttatggagaaacacccaaggtgttccggctagctccacaaggtggtgggctagatgaccagggtttaaagcctcaccccttctaatttctaattatttgatattaaatcattccctaatggccgtgtctttttaataagagctttatgtatgtataaaagtttgcaaaaaaaaatgtttctttatactcgagaagataccataagttacactctcttttttttcattaatcaattacatcattggtatatcttaatttttgtgagaagaaaccacaaataattagctagaaagtatggtgtcatctagtcttataaatgctagtaccgtaaagtatgtattacgttatgaccccgatggctccaaatccttgatctgccccgtttgaccagaggaaccactgccgcctgccgctgtgatgcgaagcaacgaagatgccagcattgctaggctgccagtacttgttcctctgttcgcataacaggcgactggacatatttttagagtccatcctcatgaccaggttaacctcacaaggttcagcgttgtattactcgaacaaccttccaagagtgtaatacctccaaccaatgtgtcgtgagaatggctcctgatgcttcgcatgcctatatgttcatgcccacgatatttgagaggtcgaatggcatattacattgttttggttttcatgggagtttttgcaactgctttgtgtaagcggtgaggatcaattgatagacctttgctatgaggcagtggtgctcttatatataggcaacttggttggtaggagttagtcagcttagttggttctcatcaagatgcaggatacttgggtacattgatccacgcagcaactgtaggattaaatcataagaactaagctaaccagaaaagggtgaatagttggtatacccaaaaaccgaaaaattttagtggaaataaaagttatcctcgaattcgacggatcgcggtctgaccgaagttgtcctgccggtctgactgcctggttgccgtcggtctgaccaagattagatctccggtctgaccgccaagattagctcctgtcgcctgttgccgaagccggtctgaccgccgtgtccccgccggtctaactgccggtgcgccgccggttagaccgccgaaactcggtgaaacacaaatcgaagaactcttaaagtggatgacgactttattgattctctctgtgtttacaaagtgcaccaacaacactccttacaaaaatttcgactaaacatgaaaccctaactaaactctcaactctcaattgatctcaaaagcgataccgggaagcctcacgctcctcctctttttatacccaaggtaggcagcctaaagccacgaaccaaactcatactagaagtcctaaacaccttaggaaaccctctagtacaagaaacaaactttacataaccactcataccaaatttggactccttccaaattcgactccgcatcccatacacacacaatacctctatcgtatgccatatgaaatcatcaccaaccacgtccatcaactctagcctaagtatcccgcatgatctctgaccaccacggacgtcgtcttatccccaagccgactcctgatccattaccgcaaatactctcccgaggcatcgagtcacctacacatgaaataaacaaagaaaccatattccgagaccaagctatctccaacttgactcattattagcaaacaacagtattacatacgcatagtatccatttagaagccataatcatgaaacaatcacggatatccgaacaaacaacctgaaaccgaaaccgacacagagttggccggttagaccgcaggctgcgctggtctgaccgcgcgatacacgccggtctgaccgacacacactgtccggtctaaccggtcacataaaataacaacacctgttactcacctgtaaatccaatcatctccaaaaccacttcgtaaataaattgcaaatatcaaaactaataatctccaatgccaattgttcatcacagaataacaatcaaaaacatctttgattttacaatctcccccttgatgaacacattggcaaacccatcaaaaatgttttggtgtttggaaaaataaaacaaatgtggtaaaaagcacacttcatacaaaaagtacacatcgtgctcgaaaatacaaaagaaaacttctcttacttttgaaaagaaagaaattcccaatcggaccaaaaacaacatgctcttctcaactcatttgcttctccaagaattatgttcattaatgttcaagagcttagcatacatatagcatatcaagtcatgtgttgtaataaaaagaagatgaacccatctaaaacataacaagcatgcattaaagtataaccatgaaccaaagattttacaattaagcttgaatcaacaatcaaaattcatgatttcatgcgatttataatgcaacatcttaacaagcacataggttgaagaataaacactaaacacatatacctattgcatttatcactctttctaaaattacctttagcacaaaacaaccaagagaatttttaacttttttttttcttgagcctttttgctcatatttttttctcttttattccgggtacgtctctgtcgtcaagactgtttctagggatttggcacccattattttgctcacatcgaatacgtccttgtcgtcaagactgtttccaaggattcggtattcatttttttcatatttttgttctcttttcacagtgagcaattaaagctatttgaggaataacaattcaataaagcatatatgtagagcatttataaaacaaaccatatgctagcatcaacattgcatatttgcttaattcaagtgtagaatttaaatgtcatgcatcatctccgttaaaagcaaaatctaaatctcatgaaaagactagaatacatacaagctatgctaaaaacaaataaaccttcaaagtattgctagcatgcacaagaaaataccatatgtataaacaaagctctctttttcaattttctcattgccatatttttgcttgataaaatcatcaggtataaactccccctcaaaacatgccaaaaggatgaattattcccaattcaacatgaagaaaagcaaaatgattatgaatccaaaggtttagtgaaaatattagcaagttgcaactttatgtccaaaaactgcaattcaacatctcccttctcaacatgatccctcaaaaagtgaaaacgaatatcaatgtgctttgtgcgtgagtgttgaacaggattcttagcaatgttaatagcactagtattatcacaaaagagaggtactttctcaaaagtaagaccataatattttaaagtatataaaagccaaagaatctgtgaacaacatctagcagtagcaacatatttagattcagcagtagattgtttcctagaaaaccatgcaatcaatgatgtaccaagaaaataacatgttccactagtacttttcctatcaattctacaacccccaaaatcagcatcggaatatccacttaagcatatttgaagatgatgtagaataccaaattccaaactcaagtgtatgattcaaatacctcattattcgcttgaccgcttgacgatgtgaagcacgaggagaagcttgaaagcgcgcacacaaacacacagcaaattgtatgtctgacctagaagcagttagatacaacaaaaattcaatcatacttctatactccttttgatcaacagcttcaccatcttcatcaggatccaacacagctgtataaccaatttgtgttgaaattggcttgcaattctccattttgaaccgtctcaaaagatcctttgtgtacttcatttgatgcacaaatgtaccttgaggtgtttgcttaatttgcaatcccaaaaagtacgataactcacccatcatgctcatctcaaattccctgcgcatagtctcaacaaactccacaaccaaagcgtgagttgaacaaccaaagatgatatcatccacataaatccgaacaaacaacaaacaaaggggttttttttgattatcaccatgcttaagaacaaaaagcgttttgtcaacctttcccattgtaaaacctttcgcaagcaaaaagttctgaagcctatcatacgatgctctaggtgcttgtttcaaaccatacaaagctttagacaatttaaaaacttggttgggaaaatcaggattttcaaaacctggtggttgtttgacataaacttcctcctgtataaaatcatgtagaaaagcaattttcacatccattcgacacaatttaaagccttttgaagcagcaaaagccaacaaaagtctaattgcctcaattctagcaacatgagcaaaagtttcatcaaaatccaaaccctccacctgggtaaaaccttgagcaaaaagtccagctttatttctcacaatcaaaccatcctcattttgtttatttttgaaaacccacttggttgattcacgttctgtatcagtactagtcgaagttgtaatctctggaggtccatctcgatcagcatcgacagtaccgggacctgacgagcctggccggtctgaccgcaacacctgtgtcggtctgatcggcggtgtgccggcggtctgaccggcctggcgcccagtctgaccggccgagccaacctcgtcgtcatcgtcgctctcgtctttaaaaatacgaccatcctcccactgaacctacaatatcgggtctagtacctggactagtcacaacaattttgttagtctccaaaataagtacacgatagccacgagtgtgtgtggggtaaccaagaaacaatccattggtagaacatgcctcaaacttatccaaatttccagatttcaagacaaatcacttgcaaccaaaaacacgcaaatgtgaaactt

SEQ ID NO: 15644 - DNA, 473 bp, Oryza sativa
gcagcccgaactttttagcacaaatcaagttaaacatcaaactagcatgaaaagcaatttgatatttttgcaacaactttttagttaaaaacaacacatccaaagtgcgtgtgtgcaaagcaaaactaagaactagagaagatctatttttcaaatcatgtgcagcattaacatctctaatttttgaaatctcattcattaaaacctcacaacttttgcaatcatcatcattaggaataagatattttaatctagcaatttcagaattaagagattcaatgataaactcctgttttctatacatcttctcacacttcttactttttgcactcaaaatattaatagatttctcaaaagcacttacctttccaatatttttgggggttcccttttttccaacccaaaccttttcctgactcgattaccacacgccatgaagcaaacaccggagatgttctttcccttatcttcat

SEQ ID NO: 15645 - DNA, 13016 bp, Oryza sativa
aaatttctctgaggccggtttgactgaggtggtactgccggtctgaccgggggccggtccgaccgcgtctgtaccgccagtctgactggtgcccggtctgaccaccgctcagtagccggtctgaccggtcgccggtcttaccgcgggacccactgcgtctgatcggtttcctcaagggaaaaccagatttttgccactttgattttgcaaaagcaatctctctctcctttttctgtttatgagctaatctgaaacaaaaaccaacaatatgtccatctttgccacaaaaagaacaagtatatttttcacgatgattagacacattagtagaatcagaagacttagctacacaagcaacaacatgacgttttgcatacacaacattggattttgaagaagatgcacccaaggtagacatgataccaacagatttaaatacagttttattagtataaggtttaaccaaaatctcactacttctagcaccaacacctaacacaacacgaggatgtctagtattatgagcataaggattaaaacctaaaccgcgattatgggtgctaaccttagattgatctaaaatcatgttgatgttctttttaccatcagaaaatctttgcaaggaatttttcaaataagaaatctctttttccaaattagcacaattttcacaatctaccatgacacctttgcttttacgacacttggggcaagaaagcaactcattggttttcacaacatcttccatgtactcaacacaacctaaagcattttttagtttcatcttattcaaagtacatgttgagcaatccaaaacatcatgagattgtttgaactttttagcacaaatcaagttaaacatcaaactagcatgaaaagcaatttgatatttttgcaacaactttttagttaaaaacaacacatccaaagtgcgtgtgtgcaaagcaaaactaagaactagagaagatctatttttcaaatcatgtgcagcattaacatctctaatttttgaaatctcattcattaaaacctcacaacttttgcaatcatcatcattaggaataagatattttaatctagcaatttcagaattaagagattcaatgataaactcctgttttctatacatcttctcacacttcttactttttgcactcaaaatattaatagatttctcaaaagcacttacctcattgtcttcacactctgactccgattcaccacacgccatgaagcaaacaccggagatgttctttcccttatcttcatctccactctctccatctacatcgcttagtgcttcaaacgcggcgtagacttgatcaaaagccttcttgagattctccttgatcttcctccctttgaatgtacccttcggcttgttgtcattggtcttctcaccatctttgtcttctcttttgcctctcccaagcttaggacaatgcgaacgaagttgatcaatcgaaccacattcaaagcaacgatttggaccacctcttttcccgaacttgatattatttatagctcgagcaactttgttagcaaccaaagtcaaatcctcctcctcgatctgttcgagtttatcatcggatgtggcattaaataaagcaagaaaagaaggcttagatgaagaagcatcaacatctaaagaagaagaggaagaaaccaaagcactcgacttagaatcaactttacgagaaagaacgttcatctcatgtgttttcgattttgtgtaaagcgaatccaaagtcaaagtagacatattaacagactcttgaatagatgtaactttcatctcccaaatagacatgtcaagaccattcaaaaagtgacgagaaatctcagattgtggataattagcatcataagaagaatcaacagatccaagtcactcaaaattttgttaaacctagaaagatagtcatccaaagcttctccaggtttcatctcaaatttaatgtactcctttttgaaaagatctcgacgaagttctttaatgttatttgttccttgatgaaaattactcaaagcaatccaaatctcataggcagtttgaagatgagaaagacgatcataatccaaacgagaaatcccactgaaaagaatattgcgagctttacaattttgttcaaattcaatttttaaagcagcagtattaatctcttcaggatgaaaaacttttctccaaatatcataatcttcagccacaatgtaagattgcatcctactacaccaatgagaaaaatcggttccatcgaaaacatgaggcttagttgtaaaacgagcagccatggcaaaaactctagatcgattaaaatccaatgaagaaaacaaggctctgataccacttgtaggatcgaatcacaagaactaagccaaccagaggggggagggtgaatggttggtatacccaaaaaccgaaaacttttagcggaaataaaagttaccctcgaattcgacggatcgcggtctgcctggttgccgtggtctgactaagattagatctccggtctgaccgccgagatcagctcttgtcgcttgttgccgaagccggtctgaccgccgtgtccccgccggtctgaccgctgtgacgctgccggtctgaccgccagtgcaccgccggttagaccgccgaaacccggtgaaacacaaatcgaagaactcttaaagtggatgacgactttattgattctctctgtgcttacaaagtgcaccaacagcactccttacaaaaatttcgactaaactcgaaaccctaactaaactctcaactcaattgatctcaaaagcgataccgggaatcctcacgctccccctctatttatacccgaggtaggcagcctaaagccacgaaccaaactcatactagaagtcctaaaacccttaggaaaccctctattacaagaaacaaactttacataaccactcataccaaatttggactccttccaaattcgactccgcatcccatatgcacacaatacgtccatcgtatgccatatgaaatcttcatcaaccatgtgcatcaactctagcctaagtatatatcttgcatgatctctgacctccacagacgtcgtcttatccccaagccgactcccggtccatcaccgcaaatactctcccgaggcatcgagtcacctacacatgaaataaacaaagaaaccatatcccgagaccaagctatctccaacttgactcattagtagcaaacaacagtattacatacgcatagtatccatctagaagccataatcatgaaacaatcacagatatccaaacaaataacccgaaaccgaaaccgacacagagtcggccgatcagaccgcaggctgcgctagtctgaccgcgcgatacacgccggtctgactgacacacactgcccggtctgactggtcacataaaataacaacacctgttactcacctgtaaatccaatcatcttcaaaaccacttcgtaaataaattccaaatatcaaaaccaataatctccaatggcaattgttcatcacagaataacaatcaaaaacatctttgattttacagcaacaagtgaatacaccggtggcttcaccacttgggtatattgattgatgctattaaaaacaattaataccatcaattaatattacagtggcatcttagcattgtggtcacaagcatgtatgaaaatgatccgttgaactctatgaagtcatgagtatattctaacttgataactgtgcagagagtatagacacagcaaattgctcatgaattaagtatatatatagacctaaaaattcttagaaatggttatctaagtaacactaatatagaaagtttttagaaaaaatcatattagtgatgtagaaagtttctagaaaaaacatacttttggataattgacaacaccgttagcgatttaaaacacaagtgttgttgttaagttatattaattgttgaatttagagatgtggatacattgaatggggacagtcatgtgggccattggcgattctgtggttcagtcctttgccataacagagccattggtgaaagtatgagagtgattaacagtagaatataacgaatttgaatgagaagtgattgatgggataattaatactctgtagagataattattttgggacaatttctaagtactacaaatacaattattttagaacggagataatatacttttttttctcacacgctatcctgcttcattttataccatcgatatgatagcactatattgattttgtggtcccaggcaagtgggaaaatgattgagctacgtgaactcaacaacattttgatgtacaaataatgtatttacaaatctcttattttcatttataggcataaaactatatcatatacaatcatagcgattacaacattatataatccagatccatcacacagggaggaaaattgatatgcattgttccaatttaaattcgaattttaatttagcagatatgatcatgtttcaagtagcagaaaggcagaaacatgtactaacaagtctcttcagtagaggtgtaagtgagcttgtccgcgaacctgcttataggtaaacttagtatgtaacccgcgggtttgatcagcgggttacctattaatttaacttataaatgagtttatggatcgacccatttgcatatcttgatgcggtaaaccggaccatgacgcgaatactcatgaattatcattaatttgacatataaataaactcgcgggttggcccgcttgtatccctcgtcttcagtgcttgactcgatacccacgttggatatgagcctgcatcgacttcctcctttaccatgcaccgcagaggatcagacgatgcccatgtatgttctggaatgataactagggcttttactttgccaactcgtactaggaacctatgcaaatggttgtcacattctcctgattcctctcagccctaagcgtgtctcatactgaatgatgccataattaacataagctgcttatgatttgcacgttgtaggttcagtagagagagctctacaaatgtttggatctcaaaaatttttggccaaaaatattgtttacacccaaatttgacaccttggattaaaataggaaaaattgccaaagtttggaagtctaccggtttcctcggagtgggccggtctgaccgccatatgttggccgatcagaccgccggttgagggccttaaaactattcacggcacaattttcctggcgataatgaaacaattatgcatcgattttaaattaaagactaacaagttcactactacagaaagggctattggtgccggttggaaaaccccctttggtgtcggatttcccaaccggcaccatgaaggcggcattgatgactctgagtgattggtgctggtttcaaaatcggcacctttgaggcgtacgtgagccaaaaaaaggctcgatgcaccgactcaaatcgagctgatgcattgagcgtgttccccatcagcagcttccccatccacaagcacattcatcaaaccctgagattgaaggctatccaagaacatgaaaaatattgcatacaacaatttaatttatagacatacaagaacacacatcaatcaacaggaagaacaatatgaacagcaagcacacaactcctgctaggctgccgccgcatcttgcgctgggccggcgccttccctcccgaccggatatggaggaggggagatgctgccgtcgccgcctcccctcccgtcgaatttggcagagaggatggcgtcgctgggccgtcgcacctcacgccgggccgacgcctcccctcccggccagatctggcggagggcgatgctacacctcgcgccaggccgacacctcccctctcgggcgaatctggcggaggggaggcgccaccgttaggctgtcgccgacactgggtggggtgggcgcgcaagagagccgatgggaggtagtgtgagagatcaaggaggagaagaaagagaaggaagaaaagagagagagagggagagagagcggtgggtggggtggggccagatggataagaacaatttgattaatcgagtattacttattgaaaacttaaaaaatatatatttatttgattttaagaaatttttatataggaaatttttgcatgaaaacaccgtttagcagttcggaaaatgtgctaatgaaaaatgaaaaaattgtgacttgcggaaaagaactcttaaaaaccatcctctcagccttgcttatatccaaatctcttgtattttactcatgccgtacaaaagacaacaatgaattaaaatgctaggaacatgtatacatgatcaggcctcagggttcctgcaatggacttcgatcacttaactatccacagtcaatgcccagatttgatgctttagtttcgtacatctctccatggacacactgggccattgttgagcagtcaggcctgattatattgtttaatgtttctctgtgttggacaatgaatcaaactttgaatcaatcaattcgtagtgcaatcgagaacttccgcaagtgcgctgtagagaactggaaaatgtcttcggccatgaagaatgtagcccaaaagcgttgtccaaaagcaatgtattactgttcgcaatgctgtcctcatgccacccaagcccaaatcagtcctcatcacaattggttgcactcctttctgatttccagtcatgtttgccagggtgattgaattttcacaatggccaactgattttgtgttgatcagaaaatgcatgaaacagggtcacaattgtcctgatttggagataagagaaggaatgagagcaagtttaatagtatagctaactagtagctccaattcatctatagccgatctaatagctcatttataaaatagttacatactacattattaatacatggtcctacctgtcatacacactgcgtcttggagttcgtgctacagctggctacaaatctatagcccactgcccttctctctcatcatttatctccttattaaaatatgtttgcaactggcttatagcctgctattgtacctgctctgatgacatgagaatctcatggtgagatgcaattgcattaattgaagagcaattgctacaagtagagcagattgacttattaagcaacgtcacattctatcatcctagattcatataataagcgatccacaatcatatttatgagtgaaaacgcacccactaaacaactatctagctactcagcatttttttttcaattagttattttaaggccttgtgcaacaacctgaatatcgtattttttcttgcacataacaaaacatgctgcgtgtctttgccaagtttacgaacagtgattgtatggtctgcgaggaggtactggaggtacattttaatagttttctgtagttatatatatatactccctccatccctaaaaataaaaggtgtagatttgtttttagagacagagggagtgagtgtgtgtattattactgtttcctaacaagagataattatttgaacctaccaaagttggactccattatttccatcgttattacacgtcggctaagttagccagcaatattccatcattgtgttaaatggagatataacactcttgaatgcctcccaaagtttcatgaagtgatgtggtggtatatctataaagacatggaaacccctgaagacaaacatatacatgttctcctctcaaatccttagttctatgcatacatataggcactgaaagaaaagagtgaccaacagatatattctatctttccaaactattattgcctttctgccctctagtctagtttagcacaaataacatctttatcagcagcaagtcagtatattttgtatgctcaggagctcagatattttcatcgcattgagagatttacaggagtggttgggaatgggaggtatcaggtagaaacggaaggcatggctccaatgagtgtttggcccactcagttgcagactatcttcatgaattcctccacttgcacttacttgaggaatggcggccatcatttttcaagatttctaacgtgccttcataattttgctgcggatgtggctatgtttgagcagcagagtatcattctgcaaaacgtaggcatcgattgtttcgtgtttacatgttgctaaacaatatgcagatagctagcgcaaaagaacatgctgaatattgcccgtgttaggagcagctagctgtggcagtacatcaacaggacttagcaagcaaatttctactagaactacagcagcactgtggctgtacagccacacgttctagcttaaccggacattctcattagtttaattgaacttccctccttacgtacgtaacagatatgtcgtacttttaattgaacaggaaaaatgttttggaatttaaaagatctggaagagaatgctcttgcaggtttggaagagaatttttaggtatttttcctaaaaaaaaacaataacagtactactcacaaatgggccattcttgccttcgttaatactaccctagtagttctcaaattcagtatgcttctccaatctttttcctccacgagttatatatctctgttagcatagctactttgcttttgcttgctctggttgaggtgccatcaaatatattcttgcactagaggctgtatatatggcggattgagatcctccgacgtaaagtcagaggaacgtggtgactgacatgtgggccccactgctctcgggacgtcagaggtaactttacgttagaggatccctttccatatattgcacacaataaaagtaatatacgaaaggaatggaacatatggtggagtagctgattgcatggttgttcacttgttctctattgtattgttcatacttcgtaggacatgaataaaaaaaagagggtactacatcaaactttaacaggtatgacttccaaatgaagatattttttttatatgcatgacatttccaattatatataaatttcatttcctaactttagcaggatcagtaatacttttggcttaggaggcttcagtggaaaccggattcacgaacagattgtgttgaggatgtgcttgggacatggcgtctttcctgctacccatatatgtgctgccaatcatgctcccgggtattctgatggctctagatgttcaagcactagggatggcaacggagcggggcagggccggattggacgaaaacagccctgcccccgaccccaaccccaactggagatgcaggggtagcatctccatccaatcaacacaggacaaatattgtacatatataattgacacactatcaaaaatagcatgaatatttaaatagtatcataaaaaactcagcaaaaacacatattgatccatcattccatccattaactaaatgcatgcatgaccacaattccacaaagtccacaaatactttgacattcaatacacaaacaacacttcaccattcaccatgatagtctagcaagctgccagccactcacactcagccagccaagcaaacacatgacacagacatgagttcaaggttcaacacatcacatatcctcgccggtcgccgcgcccttgccgcgcggccgtgccgttgctctgcgccgtgactatgcgcctccccgcacgccgcccgtgcgttgtcgggagaccggagggtgaggggacactggagaggacatgaggccagaggggagaggaggggaggagagatggcgactgacgacgacgagatctagaggagtgcacggtgccggtgcgccttggtgacatgcaccgcctctctctgtggctggttgcatggggcgaacgggaggggagacaaggagactggagaggataaggctagagctagggttttttttatatatctcaatattttgctgggttaggttatttttgggccttctacaggctacatttaagggttattttgctttactatatgtttgacgaggatctagttgtgcgcgacacatatagtttgtcgcccaatttttctaccgttggactgtttagtttattttttctaaaaaaaaaatccacagctgcatgtattcgaaccatgaaaggatttagctgaagataagataaaactgccaaactgggagatttaacacatactatgaagtagctaaggggaactgttctacatagacacattggagatggattcaccttttcaacaatcagtttaccaacccagcaaccaatttactataactaaatgtgatggcattactagacaataccttgcaattgtactatactagcaatgctctaagaagagacgctgctaattaaatttccaacacctcttgctccaatggtgtacaaactctagcatgccgctactgcttgagatcatagacatgatatgctggtcactagggcaagagccctgcctgaataatgttgcaaagaaatccccagctgaagctgccttaccaacacctccgaatcctataaccagctgagcactccaatacttcatgaatttttgttgcaggcattggagtaaaacataatgttatgcattgcaccttggaattttagcttgcgaggccgcttcaatttcatgggccatgcatcagccatgtcatggtgacattatatggaaggatcttttttttttaattcagaattgaagcatagtgacttaacgtgtccgtctgaaaatatgtcgaggaaatgctagggtgcaactcagaaaagtactctgtaatcaagatctttaaagtgtatattaatggtaggtctggagttaaaatgaagctagagatatatatgtgcgtgatgcatctactccatatataactgctagtcgcttctcgatcgaacgctttgtaaacccattttcaccatatataattaatgttagcctgtttactctagcactttattacagtatactcaggcctcgcggaagctcatgttctttccagcattgaaaatttggaactcaatagtcctctttacaaataaagcaaaaatttaaaattatatttcagcatagaaggtactacacaaaaagtgtagagatctacacagcttcatgcaatcccacatgttgttttagtcctatggtgagctccagttctttgtcttggaaggcctcatggaaatgcagattatagcgaagctgaacatgctcaccagatggtagtgaacacggaaaatagcaggccaggcaatgttcttcgttcccacgtgctggaaccaaacaacaacaagatcaatgcatgattagacttttgctactccttttttgaagagaacttttgctactcctttgtactgcctgacgagaatatttcaatcttcaatataaattcctcgtataccattgaaatctcgatccctctcattctcttgaaatttgcccgatcctttccatacccctgaaatttcaaattgatcatttgcatgcttgttccgtcagttgattgttagttgatcatctaatatctataaaaatagccattttacccttatacatggacgaacatagaaatttatgaattgcattgttgaaaaatataaaagtttatcgcatgagactattatagttatgagtttattgtgtgacacattatttatgataaaatttatttttagataatgaaagaaaaacaaaatatatttttttatttattaaaaagtcataaaaatgaggagcattcatataaaaaaggggctattaatgctcatgataatttttttaggtgcttctcatttttgtatgaatgctccccatagaaaaaagagtaaattgcacccccggtacaacaacttgacagatgggtacgatatagtgcaagaacttgacaattgaacatccgggtgcaacaacttgacaagtgggtgctttctagtacaagaacttgacaatttagtattttggtgaatcaatttggctaagcatatgctaggtgaggtttttcatgatgtcaatatgccaatacacaataattctatggatattaccttataatattgaatttaatctttaagaattatattgcacatacaatttacatacagttacctttaagaatattttgttttcttcaccttctcaaatatcaaccgaaatataataatttctacatccagtttaattgactcagttattagttattagagttattagttattaggataaaaatataaatatgtttatacaaatccacgctagtatattgtcaagcacttaaaattttgaatttatatgaaaaatgctccaaataattaagttgtcacaacttcttaatttattgtatcaaaatcgtacctaccttgcaagttgttgtatttatacgatcacttataaagttcttatactaaattgcaccttcttgccaagttgttgcactagaacgctcatttttcaagttattacaccaaattacacccacctgccaagttgttgcaccgtgggtgtaatttactctagaaaaaaaatccattgtcctgttaaatttcaatttattacatttgttttattttaaatttatgttgaaaatcttttgcactagttatttagttccattagtttcataaaatacagatattttgcattcaaacaaaattttcaatcttttttcaagcttgtattcaaaccaacatcgttgatcaagttgcaatttcgaaaatatagaagggaccgggtatatattttaggggtatgagagagattgagtgagttaattttcaagtgtatacagagaatttactatatttgttggagcactagaactaattctcctctttttccttgccacaaggcagtagatttttcatgatgctgcatagtatacacagtaggattaggctagtggctttaagtatagggcctgctgcatttcctatggctgcaacggaggcagcctgttcagttgatttatgtctgaaataggcctccgtttctaaatatttgacatcgttaattttttagcacatatttaactgttagtcttattcaaacacttttatgaaatacgtaaaactatatgtgtat

SEQ ID NO: 15646 - DNA, 2678 bp, Oryza sativa
tcttcagatgctgtatggggaccattgaatgctggccacatcactgctgaaaggatttttaccttgtaaccatggccaagagcttccctacgaagtccaaggctaaacataagaagaatttgtattttacattttactgttgactgtttaattgacaatagtttcttgggatgttccttgtgctttgagcacagatgttgcagtttgcagtttgttgcaacaactctgaaaatcatctgaggaagatcagtcaaacatctgttttgagtaaagggagctgttcttatttggttaacttggattagttgtgtgctcaacttatgattcgaaagtagagaaaaaacagcctgctcagattggttacacatccatgtaactttgttcaaatccggacagacacacatcacatatagctgagtgtttttctcctctcaataaaatgatatttgacatatacactgtaccatagttcagcattagaaatttcaataattttttcttctcaaatgttctaaaattgccacaaactacatatttcggttttaaatttcctcgtggaaaaatttggccaatagtaggtcttgttgcaatcgcagacataaaaggtaaccaacgatgaattatggattatcatgaccacaagtggcgtaagctttctatacatctcaataaaaagcgttctttttctatccatgtccaccatcactatttatctaccaatacaggtgcctccatctatattcactagagaaaatgtttcatacatttattctttctttaccggttttcatatatttattctggattgacaagcacccaaacaagataataaaaaaaaaggtaaaatcagatgagcataatttgcagtttacaagcagtactctgaatttcgatccaatgcttctccggtacaaattttgaatggcacaaattgcgagaacagcgtaaaatatgttgtttcccagaagcaattttggcatgggaagcatcagaaattgggtgatgtactatagagctggatgaaatgcttgatatgtactgagggcacaataatgtttattccactgtcaccaatcattcttcttatcaccaacttgggatttcagctatgcagaaatatctggacagctttatatagttgatctgggcttgtcgtaatatataactatcgacattaccaaggtagcgactatgcagtggtcgccctatataacaaaatttaatgtcatgactggaaattatcttgttctcaatgtcattaacttggtgagctggaatatatgttattatttttggtgctctcaaaattgttcttccaaggtgatcatctcaaattgtaaactaacattcttgccatattaagtttaggattcaacgaattcaaatttgatttttgaggtcatgagacttatactatgatattttgcatggtttttgtagaaccatgtgatcattaatcttggttatgaacaattgtcaaagctagggtttggtttgaagtttcgattctagctcatgaattgagagacgagggctttagatgcactttgtaaacacatattgatgcaataaaatcaatttactttcaagagtttcatcgtttttatgtttttctggatcctgacggcctaacggagtacaatgggcaattagaccggcggcggcgagtaagagaggagatcgacgggcggtcactctcgtggtaaggcagtggtccaaccggtagcaagacaacagtgagactggcgattgtactacggttagtcgggagttaatctgattgtcagattgagctacattgccacttcatcaagggtgaggataacttatattttagctaaaaaaaaaaaaaaaaggttttttttaaaatttttttgttttggggggtttttttttttttgttgggggggcccaatttacaaaaaagggcatttcacccctactgtgataggtttagctcttgtattcgatcatacagttttgatgtgatttctttccatagcattatcattacacttattgacggcatgattttgaaaattgttttgaagaaaaattttcgtaaatattatgaacccagacaattcccttgatggtcatcaccattgttggatccactaatccacacttgccctaccatttctgattgtctgttatccaccccacaaattcctctgtctgcttactcaattacagatatctccaaaacaaggaaacaaacgaaatcgaatggcatgaacaactgaagaatggtacaactatgttaccactgcaggaagccagattagtgtcggttcttagtttgatcctgcccaatataatggtctcatctggataggaaagatatcatatgtgctttttaagcaaatcagcacctatgagaccggcacgattgtggtgtcctgtactagtgacatttatcaataacgaaagtaaattaaggtcaataaaaaaccactcaaaaaaagatcaatcaaaaccaatgtactcgggaaatgacaagattatcgaggcatcctaatgttttacttgagttggctatggtacaagtggtagcatgcttgcctgcttggaactgtacattcggataaaatcaccactgtcgatgttgtgtatgaaaacccgctagttgttgctgaaagttttatgacaactaggaaggtagcccgcgcatatgc

SEQ ID NO: 15647 - DNA, 1138 bp, Oryza sativa
ttaaatgaaaattaccggttagatatttttcttttttctcagaattttctttaaattattagagcaccacgtggcagtttaggagcgttcgtaggagtccacgtggcggttcaagagcgttttaaggaagtttaatggacttttagtatataactaggaaggtagcccgcgcattcgcgcgggcatgtatcgtgcactgtatttgaaaatggatcatatttatcagagagcctccgccatgttttggaagtgcatttcctcagcaaatattcttcgtttcatcactttgataatttctctatgctatatactatatagtatttaattaatatgtataagcaattatatataatcttcatcatcatctaaaaaggagttagacctagtttgtttagaaaacatgtttatttaattaaaagcaaggtgttttttttctttgtttgttgaatgctatgggccctattgatgaaaatgtaagacctagctaaattcattgttccttttcccccgccatacggttttatgcagctcctagtcaccgtgttgagatgtggtcattgcacctacagaggttgccttgtgattcatcgcagttgtgatcacatttttggtggagcttagttactcatatttctatgtcttgttatatcataaaatctaaatggactccaaagttaatcatttaagtatatatatacaccaaaatatatttgcagatgattaatgtttatatatagggatgattcaccttttgaatggtctatgagcaaagaaaataaacggagttacccagaatgcttagaaggccaaaacaacacgcttgaacatatatcaatgatatactaaaagtgcattaagcaccatctaaagtcaattagatggtaacatagtttaaagcaaatacacggaagatcatttagcttgcttggattattttagcacatattttttaaaaaaatcatgaagtaatcggattttctctaactaaagccattggattttctatgcattggtggtttggacttcatattttagttagttgtatttgctgagacaatgtatatctaatttagctatgcatgtttgacaaacaacatatgatgatgcaacctgtattggattatttcgtaattctttt

SEQ ID NO: 15648 - DNA, 656 bp, Oryza sativa
ttgacaaagccactccctcagcctaagcatgagacacacactagggcaatgggtgtaagatacattcatgattgactctagtgcaagtggaagactgttagtgacatgccctagagacaatcatagagatgattgtatcacatactatgtttacatatttatctgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatgggatagagataccaaattaataatgtggacacatgatagtgaacatgttgttggatagacccaacatgagacactgcaagagccatatgtgttgggtcatcagtgatctcatttagggttggtgttgatccttaaacctgaaattatcatggttctcaacatgtgtagaagcttacttaggactgcttaacgctactccgtaattggatagttttaaaggaggttttgggtatgctattgaacatgtagtgggatttgaataatcaagaggggatttgccctttctttggagagatatctttaggcccctc

SEQ ID NO: 15649 - DNA, 17574 bp, Oryza sativa
  unsure (1)..(17574): unsure at all n locations
atgagatatagcaaattgatgtcaaaacaactttcctcaatggaaatctcgatgaggatgtgtacatgacacaacccaagggttttgttgatccacaatcagctaaaaagatatgcaaattgcagaaatctatttatgggttgaagcaagcatctcagagttggaatattcgttttgacaaagtaggcattgggctttgtcaaaaacgaagaagagccttgtgtatacaagaagattagtgggagcgcactcgtgtttctaatcctatatgtagatgacatattattgattgggaatgatattcctatgcttgaatccgttaagacatcgttgaaaaaatagtttttcaatgaaggacttaggggaagcagcatatattctgggcataaggatctatagagatagatcaaagaggctaattggattaagccagagtacatacattgacaaggtgttgaagaggttcaacatggcattaatcttggcaagaatcaatgtcctcaaacgactgatgagcgaaacaagatgagtgtgattccatatgccttggcaatcggatccatcatgtatgctatgctatgtacacgtccagatttttcatatgcacttagtgcaacaagccgataccaatcagatctaggtgagagtcactggatagctataaagaatatcctgaagtacttgagaagaactaaggatatgttcctagtctatggagaacaggaagagctcgttgtaaatggttacactgatccaagcttccaaaccgacaaagatgattttagatcgcagtttggatttgtggtctgcctgaatggaggcgttgtgagttgaaagagttccaagcaagatacagtggctgattctacaacagaagccgaatacattgccgcttctgaagcaacaaaggaggctgtttcgataaagaaatttgtttctcaactaggtgtgatgactagtgcttctagccctttggacctgtattgcgataatagtggtgccattgcgcaagccaaggagcctagatcacatcaaaagtacaaacacattttacggcggtatcacctcattcgcgagatagtgggtagaggaaatgtgaagatatgcaaaatacatacggatttgaatgttgcagatccgttgacaaagccactccctcagcctaagcatgagacacacactagggcaatgggtgtaagatacattcatgattgactctagtgcaagtggaagactgttagtgacatgccctagagacaatcatagagatgattgtatcacatactatgtttacatatttatctgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatggtatagagataccaaattaataatgtggacacatgatagtgaacatgttgttggatagacccaacatgagacactgcaagagccatatgtgttgtgtcatcagtgatctcatttagtgttggtgttgaatccttagacctgagattatcatggttctcaacatgtgtagtagcttacttaggactgctaaacgctactccgtaattggatagttataaaagtagtttttgggtatgctatgaaacatgtagtgggatatgaataatcaagatgggatttgcgcttcctatggagagatatctctaggcccctcgatgttgtagattatggaaatgcatggccatgccaaaggtgattgaggaatcaatcacaagttatataatctatcaacaggttcgagtggatgattgagctattagaggatggcacatatctagccttgagtttaatcgatatcgtgaggcaaaggggttcgtacaagtatacactagagattcagccgatatgatctttatgtaagcccggtgggtcaatacgttctgctaggatccgctgttgatgcgtggaccaaaaaggagttttcgggttacagcggagtatatatgaacctacagggtcgcatgcttaatgggccggaataaggggattggatagagatgcaatataagcttaattcggatagggatccgaataggagtcctacgggccttggaggcccgagtgatggatcctatatattcgtgaggggtgtgaccggcggaggcattgcatcacgtgagaaaccctagccatcacttccctctccgagcaaaaccctagccgcgcgcgggtgctagcacatctgtgcgtggcgttccgtccctatacgtgtggataccggtagaggcgccgctattttgcggtgctgatcggtgtgggagtacggcgaggagaacgcacgaggaggacaaggtcgagccggtgcgatcgactacttcctctacatcgacgcgcgctacttcgcgagagttccttcgacttctcagcgtcttcttccgctgcacagcgcgtcgagtggtaacgatctatgatctaatacttgcatggttcctggtttacgcgatagaaaattttgatttatgctatcgtagcctacgcgtattccacaagagagggcgcggcccaccactggaagagncggttgctgcaattncaagggcgttgncggtgncggcaccgggtggtacttgtggagcagcggcgttggtggtgggagcaaggacgacgttatggacaacgnaggcggtggcgcagccgcgacaccatcatgtccttcatgtgtcgccgccgcactgtgtagtcctgctccaccttagacgttgtgcaccctatcaacccccgcaaactggtgccactactgccaatgccgacccatgcactacataccgccgacggtgctccccgcatcctcctcccgtgcctcacttgatctacaccgtaactgttgtgggcgtcatcgcacggtgtccctactccgccgctgtcctgactgtccccgttccttcgtcatcgtcgcgcactccacccgctggtcgcgccactgctcgtggcttgcagtgctcactggagaagagagaaaggagggagatagaggatgtgataaggaagaagatctagaggatgaggaacacaaaggatggacaattagtggagtgaagagatttaaaagtaaaaatagaatgggacttctgaaagctgatcagatcaagctttgatctacgtaccttaagtacaaacaggtctatcttgtaaatgaagatgtaacatattttcgtatatggttgccatgcaaagaaaggggtctgtgcccaaaccacatattttcctatatagcaaaatatgagtaatattgatctcaatttatttgtttaattacaaattaaataacagttttaaaaattaaaaactggagattttgttcagtacatgatcacttttatacgaacaggaaggaaggaggtggggatggtcgtacatacgtacaggagtgagggaggtgttggtggaagggatttattttttaaaagatttgatctaataactgaaaatactggatccaccaaattgagtgaaaatcaacgattagatatttttattttcttagaatttttaggatttcctttaatttattagaatgccacttggtgacttaggagcgttcgtaggatgctacgtggtggtgtaggagcgtttgtagaaagtttaatagactaaaaacaattgtttatttatagtagcatcgagaccgctcctgtacatgaacagctagtgattgcacgttcactacccgctaaaactccgtggaaaaacagatctaattatttatggtaacaaattatggtgcatatctttgaactgctttaattaggaaagaaaataagagaatgagggggaggaacgggatagatcgtgcacatggatggagggatttgtacgtacgtacacacgtgtggggccggccaggagagaagggtgaaggggatttagttttgatctaatggttaatattattgggtccacctttttaagtgaaaactgatggttagatgtttttcttttttacagatttttctataaattattagagcgccacatggcggcttaggagcgtttgtagaatgcttcgtggcggtgtaggagcgtttgtaagaagtttaatagacttttagtatataatagaagatagatagatagatagattttgtatatataataaatgaagctcctagtcttgtactaggaaagaggttagagaatatgggttgtgttggggttttatgaagagaaaaggaaagttgggaccattgttgaatcaaagttgattcctttgttcccgagaaggcaaattaattaatcaggttacttgagaagagaacctgattttctacaagaatatcacatggtaagttactttataagataaatcgaagtgtgctaaaatccattatgccttcctgagcagaagaaaagacctgaaatcccatactgatttgtgagttgtgaggaattcattaacgactggatgagaaggcgattctctcattagcatccttaatacatagagcaatgaggttcagaacacacattaacccaaactctgctcacggacacatttcatcacaacattctattgggactttttgccatgtagtctaaaaaatccaagtagctccatggtccttccagatccatccatgccaaatttacaaccacagctcatcaaatatatagcatagtattgttgggggagtgggttcaccctcaaagccaagaggccttatgccccccaccattttcttggtgtgtaggagggagcctccgggaagaatccctttgaaggccttgccacaggtctctctaggtgagctctgggagacctccaggggcaccttcaagaccggtcatccaggctccaggggtgctattggcacaagcaagtagaggagggcagcattgatggcgcattcaaggcaaccaaccacccctgacttcaatggcagtagcaggtgaagcggggccgatgcgcctcggtatcacgcctcgctctcgagccgcacactccgggaatcacaggacccccagcaatgctggtttaatgggtgaaatcccatcctttatcccctaaggttttacctcgctaccctcgagctggaggccacctgccacccttagccaaagggctagctagctccataagggcaccgttgtaatctcccatactgctgtaagggtatataagtataatcctaccccccatgaggggacataatgaatagagaaggatactaccatagactggtggttgaccttaatttgatgaacttggttccaacacatacttaaaattaaattagagtatataagtgccagatggactcaaagcacttaaaccgaaggacaaatccaatagctccaacaacctgtctctaaacaacaagcaaaagcaacaagtagaataatatggaaacaaaagtggtaggtgaagatgaccttgcacatatatagatgccttagagaccactatggcgatggagacaacatgtggtaagacggtcttgccaccaaagagtaaggaacacctgagatagagctagacctagtgctggtggcacttgtactagaaagaccagcgactgtgatgtccgagaaaacacaggagcactagcagccacgttagaattggagatcacttaagcctagctggataatcaactaacttctccagatgaagatagaagcaatcataggaagtatgcccaataacttttggtactgccctgacattgtgagtaatcaataggagtaaatgtagtgtctagggagcaaagacgtgtatcctcagcgattatatatatctacaagaacctctggccatggtaggatgtgcacgtcatccaatcaactggacttgaatggactcaaattgggagggaaattgcatgacaaattggtacagtagattttcctggtcgttctcctctctcgccttgcattgtgcacaacctgaacttggccagacaactgaataaaaccatcataaaattcttcaatggactattcttgttgtttaattaatagccacctatacactcatgaatatttattccataacaggatcaactgcatgttctccatgccttaaccttagttgcatctgttcgatcatcaggaggatcatctgcgagttgacatgcttggccaattaacattcgaagcatataaaccgaaagttcccattcttgaaaatttttaccatttagcttaatgtccatggagagctagcagagatcaacctccaagaaaaggttcgaatgtttccatcaagaaatgcagaggaaaaattgataagttgagtggagtgaagcttggttattgaacttgatgtagtgtctcttggatgaagatgactttgtattgaaaattttgtggagcctctgataagtatatagtatactagtatcattgccagcttaaatcttatgttactataaagttcatgcccactaacatctaaagcttaacacgcaaatatgccacatcaccctcattagcaattattatatagattattttaaatcacatgcaagtgtgccacatcatcacctactaacaattattatctatattattttaaatatcaagcaaacatgacatatcatttacaatttttttatattttaaaacttaatatgaaagcaatgtcaaatcattatttccacatcattttcatattatttaaacatatacattcaccatttctagaatgtatgacatgcatttgacatgcattcatctagacatctcgtagcaaagcgtggggtatcaactagttgattcaaggtgggaatacgaactgaaacgtcaattatatactaacaacgtcggttcacagcgaaccggcagtggtgacccttttggggtagtgatgtttcctaggagatatttaactatttgccactcttacaagtggcaattaagaatttagcactggactcgcatgttatacacacatgaggatccaaatgtcgagtggtaaatccttaattgccacatcttaaaagtggcgaaaagttaaatgccccatttttaaaccctagtattaatgcgcaaacttaatttggtggagcctctaattagttaagataacgaaaaaaataggaaatgctcctgaactaaacatgctgcatcatgttagaataagcgttcactacttaaaagatacacatagaggtcggcactataggtgccggaagtgttaaaattggcacctctagaccttttcccactcagcgggacacctttaagcaactataaatggtggttcaaaagaaaaaccggcccctatactatagaagtttttttaaaaaaaatagaacctttaatatattataggtgtcagttaattaaaaaaacaaaaaaaacaacatctaaaatcgagccgaaccaaacggtgacctcccgtccttatcatctcctcctcctcctcatctatcacgtcattatcctctcatttctcctccaccgcactctcctctctctctctctcgctcttggtccctctctctctctccctcggctctctacccggtgttggcgcgaggaggcaacggcttgcagccgctggaggggaggcggcagcggcaggcagcgacctcgcctccgccaagtcaggctggaagggaggcgacagcggtggcatgcgacggtgggagggaggtggaggcatcgactggtggcgcttcgccagatccgtcgggaggaaaggctgcgacagcagagtgccaccgcgggtgggaggcagaggcagcgacgggcggtggcctctccttcgctagatctattttttagtgattttagtgctcttagtattctagtgttcccatgttcttggatgttcttgattggtttgggtgaaggggagttgctcgatgcttgaattgaatcgagccgatgcatcgagcttgctttttttttattcgtggaacctcaaagtactggttctctagcacctattctcttttcatatcagtgccgacttcaaggtgttggctgaaaaatactgcacctttgtggggttcacaacaatgtcactttctgtagcattggttgtatatactagccctagtttagtacttttcggttacagttggacttgtaattgtaataggtcgtaggagatagagttagagtcggactctataacacggcaaccctttaaataaagagcaaacatcacaatgcaaccatgacaactataatgtagcgtagacacgtatggagaggatgacggcaacgccatggacctgtagcttctaggtgctatattgattgggatgagcgcccataatcaaagccccagagaatatgtttcagctgaacctctcgttaacaaatattgtttgttcaggtgtctccatctgacgtgtcttaggtgatcgatgactgaagtgatcgggaatgttagttgtagttccgctatatcggctaaattttataacacatcattccatctagagcaaactaaatccaaaacgaatgcacatcatatgattcaattgccaaggcaattagcaaagcttggtgcagtgtatgccgagtgaggacagaatggttggaacacgtcacaggaaacaaccatcctactgtactcctctgattctgactcttctattcttcctccaaggctccaccatgacattacagcttgtctaccttccctgaataaccactgtccgaatttctatctacccgaaaccaaatacatagtaggctgcatcatcagtcagtagcttggagcaatgaagatcattgtacacttgtcagttcaactccaactttattttttcctctttaatttgcatcgactttcctgatgcccctcatgccaaaactccaatgcattctctaaccagaacacataatttgtgtttgcaggagttaatatctaaagccgaagtagaacaacaacattggttgttgtaatctcaaagaagttgactgtgatataacttagtgagagcccctgaacacgaagggacataataagataaattgaggcttcaaacttgctatatggatgattacggtttatcaaaagagagagcaatataagtacaaattaagtagttcagcttgttagtttgtattgtacgagtagtttcttttcataatttcaccaaaaatccaatcttgaaataccgaccatatacatgtcctaagatagcatttgtatattcagcctgcttcaactcacctaacgtacattgtttcgttttacatgatttttcattcctattttgtgagcttatgtcggagaaatataataatctcttgtaaaaaaacaatttaattctaaaatgaggaatatgatcatggcaccagtacaaaaccttccatctgtgacggcttctaacatgtctggaattagcgtaccgtcacaaggaagtcatctcaatcgggccaaaaaaaacaccttattgagattggtcgcacagacatgctagatggacgtaaaactaaggcccgtcatggatgacacctatccgtgacgggccataacttagacccgattgagataacattccatatctcaatcggccctcaatttggcacccgccacggatgaccatcatttgtgacgggcaccaacttggagcctgattgagataacaactaggcccgtcacagataactcatccatgacgttctctatactaatgcccgattgagatcacttaatctctatctagttttaactaatatctctatctagttttaactaatgcccgtcaccgatgagtattttttcatttttcatatgacatgtttatatttgtgagttgacttgtagcaaaataattaactgcaatataataatttattttattagtcaataatttttcaggtagtaaataatttcaaatagaaaaattgtcaacaacaaagttgtataacttatcaagatttacaacttttattttggttattttttatataacttttttgaacagtttgaatttgaatttaaaaatatgacaacttcaaacagcattttgaaatactaaatgatttcaaatggaaaaattgttaacaacaaagttctatatcttatcaagatttacaactttcattttggtcagttttctatataaatttttttttgaatagtttgaatttgaacttgaaaatatgacaacttcaaaacaacatttcaaatactaaatgatttcaactaaaaaagttatcaacaacaaagttgtataacccataaaatctgtaactattattttgatcattttctatataacatttttttgaatagtttgaatttgaatttgaaaatatgacgacttcaaacaacatttttaaatactaaatggtttcaaatttacatatctatgttatagtttataaaaccagatgagagatatgtgaattttgtgaacaatgttactatcactttgtcggatgaagaaatgaccaaaataaaagttataggtcttgatgagttatacaactttgttgttgatgacttgcagttgaaatcatttagtatttccaaatgttgtttgaagttgtcatatttttaaattcaaattcaaattgttaaaaaaatgttatatagaaaaatgacaaaaataaaagttatatatcttgataagctatacaactttgttgttgacaatttttccatttgaagtcatttactacccaaaaattatttgaatttcttatattttaaaatttaaattttatatagttcaatcaaactcggatggagaaatgaccaaaataaaattggtagatttcaatgagttctacaactttttcatatgagttaattcggtatcataaaattcaatttgaaattcattttcacctagaagtctgatttgcctcctcttccctctcaaccttatcttctcttctcactcagtcctctctctctctctcaaccttatcttctcttctcactcaatcctgtctctctctctccctctcttcatttgggcgaagagtgggcggtgagccagcgacgcgggcggcgcctcagtgacttcaggcggtggcgccactgccatattctcctcaccgcagccgccgctgccaacgaggaggcgaccagctccatcccccccccccccccgatgtcgatgacaacaaggaggaggcggcatcagcggttgagtgcggctgttctggccatatattttatatttggcttgtcctgaagatcctaccgtaatagatgggttccattggttttctgaaagttcccagctatacttttttcgtaattttctcatttcttacttctactgaaatgagaaaatttaattctagcagcatacatgacggttaagctgatttctctcccatatttgctacaggacatccaaaaaacgtgtaattagagataccgtaaaaatgcgtatttgctgtaggacatcgcaaaaaaatggttattagctcctggacacccgctgcattaatttattatttttggaggaataggagagagaaacggttgtataagtacggttctacccttattcttctctctctcattctttctctctttctctctctgctatttcttcaagtgagcccgagggagagggagagcgctggtgatggcatgggccggtgtagcgccttgactgtggcggcgctgcgcggtcatgcgggagatggtgccagagctagagggcaggttgtgccggcgcagttgggcggcatcggcgcgcaggcaagggcggccgggctcggcggagcgaccacgccaggagctcggctgctccaggccgacttccggaggctggaccggatggcgccggcgccggcgcggcgaggctcaagccgtcgttgcgggcgctcttctcatgtgggatgttcagcacctgcacacacccagcactcagcccaatggcaacgcccaacaacaatgttgtagcggggatgagtgggtctaagggcggatcgagcacgccataaggttggttgtggaggcggcgtcgtcgctggttgtggaggtggcggcagaggtgacggtggatgcagcagcgggcagcggcttcgatgatggtcaacgagcccgacggctgtggtgatggaggcagcggcaagcagcgctgggaagtgggcaacggtgatagtttcgatgacgatcagcgagccggcggcagcggcttcgattgcgacggttggcgagtggcgctgggaagcggctgccagcaatgggggttagatagggctaagggcaattttgtctttttgaaatttctctctcctctttttgataagaaatgataaaatattatctcgggtgtcctatagcaaattatacaaattttgtggtgtccatcaccagcgacacgattttacagtgtctcccagccaattatataatttttggatgtcctagggcaaattttgccttgaaaaaaataggccaaatttgtagtctagcattttggaagacacaaccctccacaacaatttgtgtgtgcatgctttaggggtgtttttgcctcaatatcatatattattaatacgaaggtgcaggtatcatattcgaaaaacataaaagtacaaaagcagcaatccaagaattttcctttggtaaacatggcatttaaaaaccacatcctagcgcataaacaggtgaggtttttacattcaaatttaaattccattaattgacacaaaaatagttcagctgcttccagtattttcagttagaaatatttccacccaaatagcatgagttgtcccaaataccaccgatatatgaaaaatacctggtaattgataacaaatagcatgagttgtccactcttagggaagtactggaagctgaatgtaagaatcttacaagtcagttgaatctagattcagatctgggataatttggatggtcagtcttgagcaattttatggttgttgaggaggtaccaaatttatgatagaaatagtcgtacctcatagtattttctcaaggactttaaaattcctcagcagtcttagctatgattttcctactgatggggcccttactctaaaccgtgtactttgttcacatataattcgctgtcatggaaacttaactagccctgacagccaaaaatcgtcaggaaaatgcataatcacgtaaggaaaatacatcctgacgtggcactgtcagaaaaattccatcagaactgacctatcggctggagcggagctagaacgaaatggagagaagtgacacttgcttaacttactctactttatatcgagtttaagctgatatgggtgcctaaatatatattgagggtgatgcatacaggtgaaaataggtgagttatagctacaaaattttcttaatcgggttcgtgggcaccctcgtcaataccctaactcagctcctgcctatcggcaaaattttaatttgcgtaatgtgtcaccgtcattggtatgttcactgcaaaccattggtgtatttagttcgataagcctagtatgatctttgctttgagttctcaatcgccacaatatttggggctcaaatgtttacttcactatccttcatcactgtgtgccccgttgcatcacctgtgtgtcaattttgtgtttggatgaatattgtacagtagatatacatgattggtttgaatgagaaagcatgtcgtagactagtagttacgttggtttaattgtgtcgattttgtgcaacatttacatccatccaatggaaccaacagcatccacgcgagtttgaactgaaaagcgtcgagttatcccgtttgaatcttctaaggatgaaattaaaagcaaatacgtgaaacgagataaccatttaacgcatgacttaaaaaatagatttatctaatattttaaaacaacttctatatagaatattttcggataaaatacaccgtttagcagtttgaaaaacatgttaacggaaatcgaggaaaaatatgtttctttatgaagtcagaatggggccttagacaaagaactagatagcggactaatttttcattatggacttttctgaggcataagatcagcactacgttttaatttaattagccagctcgacttaattttaaattgtcagtttgaattaactgaaacgtctctcaacttttcatttttaggaatgaagcatttcttgctttgcaccgtgggagattgaattggaccagagtagttcagttttcagaatagtggattggattgaaagcagtatgctagctagatttaactttgcacgctctatgtacatcgtgcagcacgactgtttccctcatttgctaaaatagtacaattctggcaaataattcaaaagccagcaagcaactgattaactaattaaggtttatcaaaggagacgctgaagaagcaacgctaggaaaaatggagcccagagatgacaaattttatcagacaaggagactgatgctgagtagaagagtacaacagattattcgtagaggaagcacgggacaagatgccatagtcaagtgtagtttacttgctttttttttttaaggaatcagcaggagactgtgctatttctttgaatatagaggttaaagaaaatacaacctctgaaggtaaagaaaaaaacatacaaaataataaaggcctatatttagttaggtaaaaactcctgaaacctccttgcacatgctatagcctatgtttttgcctcctcttttattttcgccatcaggctaggtaacacggtctctttgagcctaaaaatatattggttcatttccttccaaatttcccaggcgaaaagtaggattaggattcacagtcctttcttggacgcttcctttatgttggctagtctttcccacccgtcttgaacactgtgacatgggtcccattggttcggattcagtttgtttgagaaactgtcagtgcttcctctgcagcaagcttcttggacaaatcattgatgcagaacgaagcaagacacgagttcaactttccaataggtgaccctcttctgttttgctgattactcccaagccaataccattgggtttatataagaacaaaagaattagtgatctccaaaagtagttttcatatgtacagaaaggtgttgaagaaactagaatcatgggaatgtatatgtgatgctccttttatttttcctacaatgatgtggctatatattcggtatggatgtggacagggctgccaaacaatggaaccatccatgtagcctgcaactttggcactaactataattaatgctaattacttttattatctcttatgaagacatatcacccgaattatttgtagcatttggttaattattctctagctatacccacatattctcatttatacctagaactttatactatcccatccctaattatttgtagtctttgatctcttatgaagccacactatcaaatctatggatggtgtgacctgtgtaaagcagatgaacttatactgtttagtaacaaagtaaatccatttcacacttcatatttactaaaagtccataaaacttcctacaaacgctcctacgctgccatatggcattctacaaatactcctaaaccgcatgtgtcattctacaatccaccgtcgattttcacttaaattggtagatccgttattttagaccgttagattatatccactgggttgtacttcctatcggtactgttcgtttgaaaaaaaaaacaactaacgtacgtatacgatgaaaaaaagctatcaagacaaaaaaaaacattgagatataccgttcacttgaaaaaaaaaggaacctgcccatgtttgctgtaagccccataaaaaaaaactattaaaccctaaaagtaaatatcagtacggtgctaaaaccatcggaaacaaaatagatggcctttttaaattaggattttctatactataacaataaaattcaaatatagtcacgacgcttctacaagccctcttactatttgattggtattcctaggcaattattccttaatcaattatcatatacatttttttctttgccaaattggtttaataacaaattactacagcattaaaaacaacattaatataacatatgcattaaactactcatgatatattttataatttatattttcctatagctaaggaattctaatatgtcgggcatctatctatctatctatcttctatcttctatctatctatctatctattatatactaaaagtccattaaacttcctacgaacgctcctaaaccgccacgtggcgctctacaaacgcccctaagtcgccacatggcactatctaatctcaccgttgattttcacttaaattggtggtcccgttagtctacaccattagattagatctattattaaaaaataataacctcctcatgatctgtacgtatgtgtttgtacgatactactgctgatctttccatacgtacaaacgtaatgtacattatctttcctaatcttgctcgaacccaaaaaaaaacgtacacatgaaaaaaaaagacagaaaaaacatacttccataaaaatcgatggttttaaaaatatgattttagataaaatatattacttcacaaatataaatatatttagttaaataatgatctatataaatatccaatcaatgttctcaaaaccatattctaaatctatctatctatctatctattattatatactaaaagtcaattaaacttcctacaaacgctcctaaaccgccacatggcatgctacaaacgctcataggctgccacttggcattatcaaatctcaccgtcgattttcacttaaattggtggacccgttattttataccattggattatatctattattaaaaaatttcaactttctctgtatatgatttaagagctactactggtgtcatgtacgtacaggtttatacgatgtcttctcccgtacgtacttatgtgcacaaaaacaaaacaatagtttacgtactattcgctggaaagaaaagaaaaaaaccatgcgcatatacataaaaaagacgacaaaaaaatacatcataaaaatcgatgatctttaaataaaatatgattttctaaaatatattacatcacaaatataaatatatataggtaaactaagatctataataataatataaaatatccaaccaatgttccttgaaccatcttctaaattatttttaaattatatatctaatttctgattccgttgttttcctttaattaaattataagttatattgtggtcttaaatatatcacgacacatggggctgatatataatagttagtttttgataatctattatatactaaaaggctattaagcatccttaaaacattctcaaaccgttatatggcattctacaaacactctcatctcaccatgtatcactctagaaaaattatagaaaaaataaaacatctagccatcgattttcactaatatacggtgcacccgtattttctaccctcggatttccttaaagaaaaaaaaaagaaagacccacaccccaccgcttccatccattacgttacgttaggta

SEQ ID NO: 15650 - DNA, 416 bp, Oryza sativa
tttagctttctcttttgaccactcttcttgttgttgggcttgcgcttatgcataaccatcacatggttggaatttttcttaatgctttcctccggagtctttagcatcccatgcaattctgccaaggtcctgttcagattgttcatgttgaaattcattatgaacggctcaaagctgggagggagcaactggagaatcaaatcagtagccaactctcggctaaggggaaagccaagtttatccaaactcttggtgtaaccaatcattttgatcatgtgtgggctcactagattaccttctgcaagcttgcacgcaaacaaggactttgaggtattaaacctctcagctcttgcttggtcctcaaacatgttacgtagtcccgtgattatcgtatgagcatccaatggcctcatatt

SEQ ID NO: 15651 - DNA, 791 bp, Oryza sativa
ccaattgaagaaataaaccacgaaagtgttgaaaagcttcgtccttaattgccataaagaaaacctaagaatatcgagaaaaatcgtcaacataacagacacataccactttcctccaacagattgcactctagctggaccaatagtgtccatatgtaatagctatcccggtgcatccgtcatcactgaaacaataggagcatgtgaagaagcaaccatcttagcatgacgacacggtgtgcaaaccaaatcaagatctttcttaagtttaggcaaactacgaacaagatccaaaccacttaatctagtgagatgatcaaaaccaacatgtccaagtctacgatgccaaaacatcacatctttatcaaactttgcaaccaaacatgttatcacaggtgaaacaggattatcaaaatcagctttaaacactcttccatagcaagaaatattcagcatagaatcaccacaagaatcaaaaactttacttccagttttcttaaagtgaacctcaaaatcttcatcaacaatttgtgaaaccgaaaataaattgtactttaagtcctcaaccaaagctacattcttcaattcaaatttctcatttacctttaccaaacttgtagcgagaacggcactagtagaagcatcaccaaagataatcgattcagtcttggatgcctttttgagggaggagaaccaatttttatcaccggtcatgtgccgcgaacaaccggaattcacgatccgcacgttctcctttcttgccaccaaagcacataaacagaaaaaggaga

SEQ ID NO: 15652 - DNA, 581 bp, Oryza sativa
ccaaacaaaggaacagaagttgcgcaagatgtccgccgatcgccaagaagtagcaaaagccgaagtgcaaaagctgctcaagcccggggtgatccgagagatcgaccaccctgagtagttggcgaacctggtactggtgcggaagtcaatcggcaaatagcgcatgtgcgttgatttcacagacctcaacaaggtgtgcccgaaagacgacttcccccggctcagcaagtgggcggcggagttatctcccttcgatctgcattttgtcgcccgcactgctatcaagtcccaagtcctagctgacttcgtggccgaatggacgccggcattcacccctgaacccaagcctgtcgaacaaccttgggtaatgtactccgacggttcgtggtcacaaaagggggcgggtgccgcggcagtactcattttgccaaggggcgtgccgattcggtatgccataaggctgtagttcaacacgaccaacaacacggcagacgtcgtactgctgggcctaagaaaggtgaaagcattgggggttcggcgcttgctcatccgaatagactccaaactagtggcaagccacg

SEQ ID NO: 15653 - DNA, 2258 bp, Oryza sativa
gggatccccaaatacttcataggcaaaacacccacactacaagcaaaaatctgactgaaaacctcggccttatcatttacctgaccaatgcagaacacctcacttttattgaagttgattttgagaccagataattgctcaaacaaacataagatgtatttcagattttttgcatatgtctcattatcaggaagaagaaatatagtatcatcagcgtattgtaaaatgaccactttgctggtatcattttcccccaatccttctatcaacagattatcttcagctctttgcactagtaaagttagtgcttctgctgccaaattgaatagaagaggggatagaggatctccctgcctcaaacctttatgtgtcttaaaataaggccccacttgatcatttacttggacagcaaccttaccacccattatcactttcattacccaatcacaccattgatcaggaaactcttttgctttcaacattctataaataaagacccaatcaactttgtcgtatgctttttcaaaatccaccttaaaaaggacaccactttgttttttctgatgtaaggagttaagaatttcatgcaggatcagcacaccttccattatgaatctatttttcagaaacgctgtctgattttttgagatgatatatgtcataatttctgtaatcctattcatgagcactttggttataatcttaaaactgacattcaggagacaaataggcctatatttttgaatttgagctgcatccttaattttcggaatcaagggtaataacaccaaaatttaaatctatcaatgtcaaccaaccctttgtgatagtcattcaccaattttagaagatctcccttgatcagatcccaaaactgagtataaaactcaccaataaaaccgtctgggcctggagctttgtttttcttaagctcgaaaacaactattctgacctcttcctcactgaaaggtttggtcaacatcaccttgtgttcttccattattgttgtaacccctctcatatctagaaaaagtgtgttctgtttaggatgaccaaacaaatctttgtaaaagctagtaatataggttaacaacttctcttgcccttctatttcaccttcctcctgagttaaggaatgaatatagcttttcctttttctcccattggccttggcatggtagtattttgtattacaatctccctctaacaactcattttctttactcctttgaaaccatttaatcttttcttctctaatcacaaaattcagtttatcctccaactccttcctttcttctctatcttccttgctcatcccacatctttcaaccttcgcatccaaattttcaattttctcaagaatgctttctttttccctcctatatctcccctcccaattattattccaaccattaagttttttcctcaaagctctaaatcttttctgccatctctcaatactagatccataataattaattttccaaacactctccacaatttcttttaaatcttctctaagaaaccaactgagttcaaatttgaagctcttatgagtaatctttaagactccagtatctatgcgcaaaggattatgatctgaaatgcttctagttaaagtttttgccattgtgaggggatattccttttcccaatctgtgttcacaaaaattctgtccaatttttctaaagtgggattctcttgattgttacaccaagtaaactttctcccacctagaaagatttctctcaaattagcttgctctatgacagcattaaaaatgaaactccacctattataccctccagctttggtttttatcactttcctttctaataatattaaaatcaccacccatgactaaagggtttcatttgtttctgaataatgttagccagttcagtcaaaaacctatccttgtgtgcattttgggctgctccatatacagctatcaaatcccagcagaaattggtttgcatattgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaagctctaaaaaggccccttttcctccctcttcctctt

SEQ ID NO: 15654 - DNA, 11675 bp, Oryza sativa
  unsure (1)..(11675): unsure at all n locations
aatagggggaaattattacccgtgattccctccgcctttccccccaattttccctccctctctcccttggatttgtttggaaaccctcccctaatcctgccggcgccattgatggagcccgagagcgccgcgccggtttccttcccctccgggcggcctcttccccttccaaccctatttaaaccctccccgcacctcctccatccgtttccgcctctcgccggccttcctcctcgccagaatcgagctcacgccatcgctctctctctccgccgtcgccgtcgagctccggtccgccggcgtcgtcgccccggaccaccttccacctcggcgccgccttcttcggctttgccgcatcctcgccgacctcgttcacccctccgtttcgctcgccggccgccggaacgccgtcgaccccgtcgacctgagccgcgccgccgcctttcttcgtccggccacctttttcgttgtcgccgtcgacctaaggtgagccgtggaccgccgcttctttttcccccttcccttcccctctctcggccggcgctccgccgtgcctatgggcgccgccggcgaccatagggcgcgggcgccgccttccgccggctgcgccggcttggccgccctcgggcgcgccgagtggctgccgcgtggcgcccggccgtcagccgcccgcgccctcgggtgcggctgacgcgtgggacccacggggcggcttagtttgtggctcagtctggttataaacaaaagtacacggatggagatggacgaagtcgggggtcgatggacatctctaggacaaatgaaggctacacaagctgcggcccggtagtcgagatgtcatggcacaaggccggtgtcctgctgctaggggcgcagtcctgcatacctgtcccgggggttccggccgtaggtggggttgggtcggtactcttgtctatggctaggatgggttggaaactatgtcacatcttccgtccgtataccgtggtggtatgtggcacgtgggtacacgtgaggaaaatgtgtcttgtgggtaaagatgtacacctctgatcagagtataatctattcgatagccgcgccctccgttatgggcaagccgagcaatgtacccaagttaagagtttaattcttaaaacctgcttaacaactaaaatggggaatgggtggcccgggttggcttgggacgagctgggacccaaggtcgggttgccagttcggtctgaatcatcgtaggccttggattaaggcatgttcgtgtgggttcacggccttgattaataatattgtatagctctggaatcatgtttacaaaaagctttgagcaactaagtgtcttttaatgctgtttactacaaaccctaaccctttatattataacccccttgtactcccttgcatttatcctgcacttgtgggtgtgtcttgttgagtacggtggttgtactcagtcttgctcaattttttcccaaaccaagaagaggagcccctggaagaagaaggctttggtgtctagctcgtgcctgccgtcaagcgcctgtggtcgtcgccctagtcttccactgtttctcgtttgtctttgtgtatgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacacatatcttgcaattcaattttaacatgaaaatctccttttgaaacagccaacatactcagtttgtcaatgttaattcctaccaaaaatcctcttgagtgacccatagccggcaaccactcccatttcatatttttgttaccacttagacctctcaatagaccagcagagaaatcctgctttatggactccataatcccaacaaaatcaatgtttttttccttaatcaaatcttgtaaatgactagttttttcaacctgacccattcctctaatattccaaaaaagtcctttcatttttttcctggtttttttattatattttttcctactcatctttggagtgaccttgaaaatctcaaggtttcctcttttgtttttatgcttactaccagaaaaatgagagcctttaagtaaagagtcaatgtgctccaaatcagagtcatatccctcagaagagcacaattcatcaagcaaattttccacagggaattctatctcagttttagattcacaattcttattcttcataacctcttgttcttttaaaaataaactaattctagcacattctaagtctttaatcaaagacaagtttgaatcaatattatcaatagcacagcctaagttaactcctaaaatactagccatatccataagggccacattagaatcttgaacaaaagaaggaatcaagtcctgacctttgttgatgaatgcattttgcgcttccttcctttcaatcgccacttcctgcaaatttcaatcgtcattttcaatcggcacctatcacgcttttaacgtcatgatagccagaaagaagaattctgagcaaggagcacaaatacggaacgactgccgtccacatcgcgagggatacatgtaatctgaagatgacaaagcctactcatgtcgccaactgttaaaggtcgcctgatctatgtcagtgtgcggctaatacgcagctactaatcaaaagcaatcattttgaagtgccatcatacgtcttattctttgtgtgttttttttttctctttgcaagaaataaaatcttgcaggtaacaactcttgcagaactatactaatttatgacaagttcagatcaagttgaggtagttcttgcaggtaacaaactcttgtagaactatactaatttatgacaggctcagatcaagttgaggtaatcaagcatttctggttctgcatttcagtgttcatgcggtagaaagtggattgagaagtggggagtattcaaactagcaaaggctacgggagttgcaccaatcacccaattttggttctgtgggcatatatatgcttcgttggagatatcgttcatatctttttagataatggaatgaaatagcatcccgacctttattcgaaagagttacagccaattattacaaactagcactctgtaagagtgaagttcaaatagaagcaaacacaccaaccaaactagacaaaataacattattccagtttattggtaaatctccatccatgattggcaaacagttgcataaccatcgtttcaaccttacgacatgcaacaattaagaaatctgcatcttcatcacacttttgtaactgtgcccacagacgaagccaatatgttgccttgaaaatgacctgcatataagtaatagtaggtgatttgtcaaaaaccctatcattcctactcagccacagtgcccaacacaaggcagaagctccaacaagtatcagtttgctctttttgtttatgactccttgaagccaatcatcaaaaatatgagatatgctaataggaatatataaaccaaaagaaaactgaactgccctccaaataaactttgtaaaatgacaatcaatgaacagatgttggatagtctcatttttcgtacaaaagcaacatcttaaattaccagtccaattccgtcttgctaaattatccttggttaacataactcccttaagcaaataccacataaagatcttgatcttaagcggcatcttgagtttccaaattaacttatttctgtcaatgtaaccattattaattaaggctaagtacattgatctaactgagaattggccattctgatgatagttccatctaaaatattgttcatatctaccaggccgcggaaaagaacatgacatgcaggcaaggatcaaaacaaaaccttctactggccataggttgatcgatcaggaagggagacggaatttctctgcaaccacacaaaatgctggatctctctttgatatctactgtttgtccgtaaactttccccaagtagattcactccatcccaaaatgattggagggcttgagcagtactaccaaaaatgttggtagaagagtaggacagcgcatctagacgagaagacacccttgctgaaagttcagaacagatacatggtaagctcggcgttttaaacctggttaatcggaagcactcactgatctagattgaaagacgcatgaatccaaccatgcgtatctaccttcgagttcaaaatctgggccatccaactgatactgtcgtgaatcagaacaacgcaatcgagccaacatcaaatcgttgctccagggcccatcaggaggaagagagcgaaacaatcaaaatcactgaggaaggaaagttacttgtacagaaacaatcaaaatcaacttgctgcaagggtgtgcacatctactttctgtttctttctctccctttcattccattacaagtagcacttcgatccttaattcgtctctgcctctctccagaaaaaagaagagtaatatgaatatatgcattctggtgtcattaataggcaccatgttcccgacataccactgtaaatatgaaaaaaaaaactgaagagtataattgggaggaggggagaagaaaaacaaccaccaggcgtctccgtcatcaacaaggagaggaaatccaagttatactcgtacagtgatggcgatgcaacttgcacaccctcgcttggcggctagccgtggctcacgtttccgctgtcgctcgcgcgacgccgaggcgaggcggggccgggccgcgggggtggcccaggcgcgacctaggactggtcctcgcggccgctcgccacaacgccgcccccgtctcgaccgtccaattcgggggcaaaccaccaaccgattccaccggggcgatcgaaatctcctccggcccgtttggccgggtcgatcccaacaccggctcgatgggaacgtggcgcccatcggggcccccctctcgacgccctcccaaccgtccgtccgctcgtaaacaccccccaccccccaggcccgagatattttccgttaccgtctcggcgtctagctaggcgcgccgtgtcgccactcgccagcgagcggaaaggtccgaatcggatgggtgcctttcgggaaaaaaaattgccgaaacgcgcgtgcgttccgaaccgtgctggtggttggtgccgtgatgaacgtacgaggtccgcttgctaggcgctatcatcagttcagcgtcagtgtcgcgatttgcaaggagaaagacagtattggtagaggtagaattttaactcaatcatttctacaaccggtgaactactaggacacggaataagagacgctaactggaggtatctccaaaaaatgtcagctcaggcgtcgagtagtgagccgcatcagcaccaccaccgtgttgcacgagagcagcaccggtggggaggagatgtgcaagcgtgaggccagagtggagtgaagcccatgcgcgacttcactgtacagatgagtccatgggcgaccatgggggcgggcatgacttgcctagcgcagtgtggtgaccgattgacaccgcggcttaatggcggacacgtgtgggacgggagccgcggagggagcaacaaaagcctcgaggcttcacagttgcagcgccaccgccgcagctgttggcacgtgaacagaggtggacacgtttgagagttgcttctggtctcttttttttttcttgttctttcaagttaaaccacgtgaaatgagctgaaatgtcgttctttactacatactgtacactgtactagctgctctggtcaagctttagccgattatgtacttcgtgtcaaacgatcagcaacttaaatggctatattgatgttttggatacaatatgcagtagcagttcttttagttatccataaataaatttttaaatgcttagtttaaaaatatttttaaaatagcacgtacagatttttcttgaaaaatatgaaacgtgctagccttttagcatgcacaaccatcaaagcataggccaaaaagcaaggcttgagaaaaccagaggcactacggtgcatcatccttccttgaaatggaattctatgctttggttccaaaaaataaaaatagtacttgaaagtacagaatataccggattttcaacatgcataactattaaaccaaagcctaagctataatttgacaaaaccaaagatattatgatacgccatcctcctttgaaaacgaacttgaatgctaaagcacgatacattcataatttcataaacttattagactattatagatttattataataaaaaactatggttaaagtcgtatattaaagactgtagaaagcctaaatgtcaaaagtaagtattgcattttcttctgaagggaaataaattttattgtacaatggcaatgtatagcggttaaaggtttcttgaattttctaatataaaaggaatggcccaaataaacaagttttttcctaaaataattctgagatgtctttctggaaagtatatttggcttttttgcacacttatgaataataagtaggagacaataagaaaaaagtcacagaaattcggggtggccatacccagcacacacgttgatgatgagagaggggagccgtacaggagagtgaggcggtctacggattcttcggccgcacactcatgcaatgcatccgggtggcacgcacgaaataaataggcaaggcctccctacacgctcttcgtcttctcccatcactcttcttccctcttcactcgctactgaacaccatctcatatttttgttcttgatttttttttctctcccccccccctccaaagtatatactgcttgccattcgtatctcgagtgtgtgagcgcctaattttggctcaagcctatattaaggaggggcgtaccgtatcgtttctattttgtttcgtgaaactggtgtcaccggtagcggcagtagcaggagtgctagatccttcacgagctgcgtgggggtggttgaccaggacacgcctcccggatcctgaaataaggccaccgctcgtttccccctccccctcttcctcttcctcttcctttgccaccccctcgcatttagccagcctcccacggttgtggagctgtgtgggccatttcccaaccgtcgctccggtgggtggccgggagggtggtcgctgcgacccatgggcatccaggtcgcggccgtgacgtcgtcgccatgcgccgtcacgacgtcgtcgtcgtcgtcgctgtcgccttcgtcgtctgccgccgcgacgacgttgcggcggcatggcgttcttggaggtgtcaagctttcgagagggcaatcgtcgctggctagctgaagcgtcggtatgacccgccggcgcgccggggggcaccagatggcaaggcgcgctctcagcgctagcattgacagcatcgggagcgaccgccgggacgacgaggagtttttgcggaagaatcaggagctggcggtggggctgcaccctggcgccgctggctgcgggtggccggcgagcgtggancggagcgcgancagcgtggggttgccgctgtcgctgcggatgctcaagcggaagaagcagcagcagcagcagcagggccggtgggacgagcggctgatcgactgcgccggcgagtccgcgcccggcgcggtggggcgcgcgttctcgtcgatggtgctcatcatccgggagctgcagagcttcacgctgcagatgcggcaggcgctcttctacgaggacctgcagcgcgtgctcgcgcgcgtccacgccgagatgcacgcctccttcgtgtggctcttccagcacatcttctccggcacccccgccctcatggtctccgtgatgcttctgctcgccaacttcaccgtctactccatgggcgacagcgtcgcggccgccgccacgctcccgcctccccagccccccgcggcgactgtggcgatggtcgacacccagcacgcggagcagtctcattcccaccagcggttcgaccatgcctcgctcaagacgttgtccatcggccgaacggcctcggtgggtggcaacagcggcggcggcggcaaggtgcggccggtcgccggggcaaccggcgacggtcgctcggacgagtggtcaaatcggcaaagcggcgcggtgttgccgcaggatgcgtcacagggtacgccgggagctggcgcggaggaggccgtgcccgtgtcagaagcaatggccgtggaggagacagaggacgaactggtcatctggaaaaggatagccgatgaggctaccaggatgcaggcgagcgttcgcgccgaggcgctgatggacccggacacactggggcagctcgtggcgccggtggaggccaagctggacacggaggacacggcggagttcgcggcgacggaggagcggtacgagcgagccgtgtccgaggagccagacaactcgctgctgctgtccaactttgcccagttcctgtacacggtgcagcgcgaccacgatcggtgagttgctgcgcgccacgtcgccagccgttcgacgaaatggccgccggggcctcttggggttttacgggcgctgaccgaggtggtggttttgcgcggatgcagggcggagcactacttcaagcggccggtgcgcgcggagccggcggacgcggaggcgatgggtcggtacgcgactttcctgtggaaagcgcgcaatgacctcgcggccgcggaggagacgtaccaggaggccatcgccgccgaacccagcaactcgcaccacgcggcagcctacgcgcacttcctctggaacacgggcggcgatgacacatgctaccccctcgactgatgcgcgtgcatgagccatgcctccgcgatccaacacctccctcccccaacaaaactcaacacacacaaaaagaagcaaaggatatttttttaccacactccaagaacaagacgcacttctccaccctgcacgtgcttggccgaccacgccgctacactacactacactactacgcgctagtagtacagattttttcttcttgtggttgctcgtctcgcggtgagccggtgagtaatattggggtgatccgcggcgtacgtgctgctgcttcccgttctggaaatccggcgagcggggcacttggccggaaacggcgggagccgcgctaaagctggtgtgatcgatcgagttcgctgctcgcggccctacgggtttgccagttgcgtttgcccgagggacccgtcctattggcacggatgctttgcggcgtcatggagagagatgagagtttgctgtgtttaccagtggagtgaatactgtaatacaagtgcatagcagcaatccaatttgcaacctgtaattgtgcagacgaataagaggctctttttttccgcaccaactgcggcttgcacttaattttctcttcaactagcatggtagcacgcgcagattgtgcggctagcatcattatattttctctcatataatagcatatatgttttttcaatatattattcaaatatattaaaataacaacataattttaaattttgcaataacttgtaatattcatattgtattttatatacgtgttagttattaataatttttaatattaaattttagttatttgtaaattatatatattcctatatggactctagactcgtcttttaatatttctttttttaaattccgaattttcagtaaattgtatttctatatagactctaggctcttctttcaatattatttattttatttctgaatttttattatttctaattgtatttctacgtggactctaaactcatctttcaatattatttcatttttaatttcgaatttcagttacttctaaattgtattcctatattgactcttcttcccatgtttttcttaatctcaaattttagttatttgtaaattgtatttttatacggactcttaacttgtagcgcccgttccatcgtggcgcctagcggaaaaatttaaattctaagaaccctaattgcgaaatctgtttttttttcttgttgtcagtctccgtgccaatccctaatctcgaattcccgatcaaaagtcaaattcaaatccggaatccaaatccttcccaaatcaaattcctccgcaaaagtttattttgcttccctcagggtccggtgggccgttttcttctgggcccatatctctggtcttctctccttctccatcagctctcccttcgcttttgcccgtgccccgcgtgcacgtgcgcatgcgcgtaagccgacacggagccgagctctccctctctctctcgttctcccgctctctctgccggctccatcccgggcaagctccccgcgcgctgttactttgcgcgcgcggtcgcggccgtcgtcagcagcttgctgcccgtgcttgcgctgtctggccccgcgccctaccgcgttgcgccgcttgcgccgcgccttgcccagcgagccagcgcgcgtccccgagccgcgccgcccgcatccgtccaaaaaccagaggcagcgcctcccgctcccatccctcttcctccccaaaccagcatagcgcgagccttctttctccccctccgtttcccgctttcctctctcggcccgacctctgctctccctccgctcggagctagcgccagggcagacgagcggccgcgccgcgccagcccgtcctccacgccgtttgaccgcgcccgtgaagcctatcccatcccctcgaagttccctcgccccctagtgtcgcccaaggtcggtttccgaaccgacattgccgccctataaacccgagcccctccccaaaccaatcttccccattttcgccctcgccattgccgcgccctgccctgttcgccgtcgccgttcgtcgtcgcgcgtgtcggaggagccgggacgagcgaggacgcgtgacgtggactccgggcgcaccctctccttcctcttccccggcccgaggccagagcgatcacgccccgcgccgtcggccatcgtcactgcgccccttcaccccgcacggtagtgcctcctccccgttccccctcctcgttcctcctcttccccttagctttcggtagaagcttgtaaagcctccccgtagctagctggcgccgccccgaccgctgccgccgctcgctgtgtgctcgccgccgtcgctgcctgtgctccgtagcacccgcacgtcgccggcctctctcgtagtgtctccgtctaatccgatggtagaaacggactccggtggccgcgtagatgctctagtccggaggaatcgaaccctagtcgcgtcgttgccgtttccttcttttctcacagccggttgccgccgccgcaatccgccgccgtcgaactcccttcggcgaatccgagcccttggctcgtctcccctcgtctcatgcaaccacccggtgtgctcgctttcgcctgtatcgccgtggttcgccccgcctttcgcagccgccgtccgccgtccgttccggccggcgccttcgtcaaccttccgccggcccgcgtggcagccatgtaggcgccacgtcggtgccagctcggccaagaccgggtcaagccgaccccggtccggcggtcccctgtgccccgctcgcgcgcgcggtccaccgcgagccgtgaggctgcgcgtgggcccgccgcatccgcacccaccgcgagccgcgcgcgtgcaccg

SEQ ID NO: 15655 - DNA, 10123 bp, Oryza sativa
gtggctcgtctcccctcatctggtgcaaacaccgggtgtgctcgatttcgcctgtatcgccgtggttcgcccgccgttcgcaaccgccgtccgcggtcagttcgggcgggcgcttctttcaaccttccgcgggcccgtgtgcaagcaacgtaggtgccacgtcggcgccagctcggccaagaccgggtcaagccgaccccggtccgccgctcccttatgcccgctcgcgcgcgcggtccaccgcgacccgtgaggctgcgcgtgggcccgccgcatccgcatccaccgcaagccgcgcgcgtgcaccgcgccccgctccaaaccctagcgccgcatcacgtgctcctcgctcacggtgagtcgagccgccaacaagcgggtcccactcgggaccacgcgagatggacccggcccaccggctacctctttcctcccctcccgcacgtgccttgggccgccttctcgggccggccggcccattatgctcggccgagccgcccctttctctcaggccgtgccctagccgcccgagggaagtctgtttcccctccctctttcttttctttttcgaaagggtttaattaaatcctttttcctttagaccaaaaatccaataatcttataaattcaatatcttctcaaccgtatgtccgtttgactccgttcaacttccaaaatttctcaaatcttgatatctatttaatggcacgtttagaggtcaataatagggctttattttcgccatttgttgagttgtcccgtttcgcgtgtagtttcggagcccgaagacccgcagtgcgaggatttcaaggatcaagctctcgagcaaggcaagtcacctttgatcatcttgcacctataatttaaatctaagtacttcttttccgcaaatattgcatgaataagtttaacacaagtatttcggccgcggcttgcgagatagcctaccggccccaatcctaattgttgcaattaccctccttgaattattgaacacttgaaccacctttgtcaactgttgtgcttcgatgcacgggcctacaggcacgcgcatcggaacaccttccctcaaatttaaaacatccaacgatgggtaaaacttggggttttacaaaagacttggaaaacccgacacctgggtcggtgcttgcgaactaaaattaaatttccaaaatcgcggaccgggggacgtaccgggagtacggtttaccgctcttgcacttaaggaccgtttccttggaatttcatccgaacataaggcaagtgcgaccacatgggtggaatgggacacccctggctgagtaactagctaatcgggggaaccatgatgacaagagacatgtggattcaacggggtggtgccggggggaacccccgggcttcctggcacagtatggtgtgggacctaacctgatatcggtctgggacccctctcgttggcatatggtgaacctgtgtcggctttcgaaatgccttgtcatgaaagcctcaaggtctctagacgtggccgttctgcacgggcggggtgatccgggttagtaatgtcatgtgggtaaagtgtaccccctctgcagaggttattaaactgttcgaacagccgtgcccacggtcataggcggatgtgaggtgatttctagcgtagtttgactactgcttgtgaaattacttttatggaatgggttcaatgtttggaaaatctgcggctgatgggatcagccaggcccgggtggccgtttgaaagccgttggccgggtgacaaccttgaatcagttcaaagattgatacattgcacatactccgaccagacgagacgcactgtctcatccgtgtcgtttgagaagcactcacttagttgtttcaacaaggagtttaaataaaaccaattgcaaaaacaacagcatttcctttgaagcctgcattaaacacttaattcccatggcttgctgagtactcctgtactcacccttgctctatataaataatccccccccccagttgctgaagaaaatgatgtggatcctgctgatgaggagttcttccaggagcaagtcggctacgatgagttttagggttttggcctagttcccaagtcacgcctgtgatgaatggtccaagtcttggcttccgctttcccttttgtaatgcagttgtgagctcagcatctatccgcagcccaacatgattgtactcctactctgtaataaagagacctctgctgctgtgatattctgtcttcctgtgataccagcactgtttcctgggactggtatcgattaacatgttaatttggagcgtcacgggctagttccgttcagggctagttcggggcgtgacaaaagatggtatcagagcacaggcttggccctagggcgaaacccgacgtttaggatgaccctaaggatactaagttcaaaaactacttgctcaaaggcttctttttgctttctttattttcagtagtttattgctaaaatggctactgatcttttctccctctttcaaaattgtagatggtagtgaacgccagcttcagttcccatagttttggtgagggtcaccacgtcgctcagcttcgtgacctcgcccgcttccttggcttctcgtgtcccgagtacacggggtactctgtggaccgtgttccccctcgttgtgagctttcggtgtacctttaccctcgtggaggtatacacggggctggcctttgcccacaccacttcaatgtggccaggcccactctccagatcgtgtaccaggacctctcctggacagcacttcgtcgcttggtccacgactacagccaccgcctcgggggctctgcctttcggcagctcccacgcctttcttctggccgcactgacactaggtacccttgtccgtaccgcgagcctcagcctgtgctgactcgcatggttgagctttctgaggctcaagccacccagcacgacctactccttgaggcttaccgctctggaggcccgtctggccgaggagggtgtcacctcagttgacactgcgtcttgggactcaggccgcctctgccacgccagccacctgtcttcccacagctcccgcggctcctttcgcactcccagtggcccacgctcccccagctcgcgtgcgccgtactctccagtgtactctccctaccctcacccagttagcccttcctacactcctggtcacaccccagtcgcttcctcccgccgtggcccacgctttatctgcactgcgcggaagcgtgttgttggttcttccactatgttccgctttgactacccagctcccccaccgccagcagctcgtgctgctgccggccctcgacaggttccgccggtctcttcgcgtcagccgatcgacgtctcttcgactgaggagccgactacaggaggcagccaggcaggcgaggagtagaggaggccgtcttcagcagttgtccgtgtgttaggccccttttgtgccaccgccacctctcttggagtcgtggcgaggtaatgcgtgcgtgtgtttgatgtgggtgttgtttggtagtctggttctcctaggtggtgtgcgtacagtcaagctcggcgtagctctgtgacttgtccacacccgttgtatcagatgtctttatgatttgagaaaaccagtttatgcctagtgtgtgctatctgagttgttatttattttgcttcttgtcttccttaagtgcttatctggttcttatctcgccccttttctgggagtttagatggctagccgcccccgtcgcgctgctcgtgcaccagcccgcttcggctttgaggaaggtagagttgagccagaagcagatcatgagtcagctaatgagcagtctcaccacagcaaccgttcgcaccgtaccgctccccgcaatgcagaagtcgagcaatcccaccgcagcaatcgctcgcatcacacagtttcccgtaattgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaatgagaaacagcggaagactagggcgacgaccacaggcgcttgacggcaggcacgagctagacaccaaagccttcatcttccaggggctcctcttctgggtttgggaaaaattgagcaagactgagtacaaccactgaggaggtgcggggagggtttaaatagagttagaagggggagagggcggccggaggggaaggaaaccggcgcggcgctctcgggctccatcaatggcgccgtcgagatttgcgggggcaaatccgcccgtttgaacgcgagagagggaggggaaaatggggggaaagggagagggaatcacggggaataattcccccctattgattgcacgcggggaggacgggggcggcgggattcgcggcggcggcggcgctagggcgtgggcgaggcagcgggagcggcgggaggaaggggatgacgggtgggccccacccgtcagcgagggtggcgggcgggcccgcccgtcagtggcgcgcgcgcggggagaggccggatgggccgcggggagaggagagggagggggagggagatgggccgagccggcccgagagggagagggagggaaaggggtctttttagagtttttctttttataaaaccttttcaactttgtttatttcttaataattattatttgtgctctgaaaattccactaaaatttatttacgcattttaggcttttaggaaatatacaaaaaccctctaagccttgtttgacttttaactttgcacattttaattgttggaggctttcacacggattttaattattctaggcacaatttagaggatatattttagggtcgttttgggacgtgacagtaatgcagaagtggaacagtctcaccgctctcactgcactgccagtcacaattctggtgaagaacgcattccttcgccaccccatattcaaaataacatgcagcacttgatggcagttcagactcaaatcttgcaaggtttagccacagccatagccggtattcagcacaacgcgcatggaaatggccacccccacatgggcaacaacagatccaagcagacagactttctgaggtctcgtccgccagagttctctcagaccgtcgagcccgttgaggctgacgattggctgaaggatgtagagagaaaactcaacttagtgcagtgtactcctgttgagaagacgttctacgcctctcaccagctaagaggacctgctgcagattggtgggagaattattgcaatgcacatgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctggcaatcaaaaataaacagcagcggactagcgggcctacggctccatcttcacaggcgctcaaccggggtataagccaggactccacctaagacatcttctccaaagcctctcttactgaagaggggaaatattgagcaagagtgagtacaaccacagtactcagcaagtcacaccggcagatgcatgattaatgcaagggggtacaaggggataataataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgcacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaatcacctaatgttgcctaattaatcagcgaagcatctacctaaatttatactagtggaaccatgaatagagtacccactagttggggttttgtttattctagggtaaacaaggtaataataacaatagcaataataataaggccataacaaaggtaaataggcaaggctaaataaaacagtgataacgcgggaatttaaataaagcgataatgcattaatttaaatcaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaacggcttttactctaataaactccatataacaagcagaaacaaagcacaaaaatgggttcttgacttcttaaggaaaaattagagacttgaacggtccaattccgagttcaaatggccaagttatggccatttgaagtttatatgctatttaaatggatatttgcgaatttcttcatttaaattttaatttaaaatagatttattgcgtcagccgggagagaggagcgcgcggaccgggtccacgggagtggggcccacgcggcagcctctcggtccacggtggaccgggtgcacccggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggtgaccaccggcgcggcggagcggcgcccgagagaggggagggaagggggaagcgaaacggcggtccacggctcaccccgagtcgacggcggggacgggaacggcgaccggagcggaggaaggcggcggcgcggctcgggtcgacgaggacggcggcgttccggcggtcggcgggcgaaacggaggggtggatgaggtcggcgaggttgcggcgaacccgaagaaggcgacgccgaaacgggaggaggtccggggcgacgacggcggcggaccggagctcggcggcgacggcggagagagagagcgacggcgcgagctcgattccggcggagagagagagcggcgagaggcggaaccggacgaagggggtgcggggagggtttaaatagagccggggcgagagagggtggccggggaagggaggaaaccggcgcgggaggtcggccgccatcaatggcgccggcgggattaggggagcggtttccaaccgaatccgagggagagagggagggaaaaatggggggaaagagagggaatcacggggagtgatttccccctctttattgcgcgcggggacggcgggaggcggcgggattcgcagcggcggcggcgctagggcacgggcgaggcggcgggagcggcgggaggatagggatgacaggtgggccccacccgtcagcgagggtggcgggcgggcccgcccgtcagcggcgcgcgcgcggggagaggccgagtgggccgcggggaggaggagagagagggagggagatgggccgagccggcccaagtggggaagggggaaaaaaggactttttagggtttttcttttcataaaacctttttaactttgtttatttcttaataattattatttgtgctctgaaaattcaagtaaaatttgagggctccttttagaccaaggagaatttaacaaaaattctccgggccgcatttgaatttttcttgtacgtattttagtgtttgccaatttcttttcgaattttaattaattctattattccttttagcgaatgatttttaattcgggatgaatttatcaggacgtgacagcacacctcgaacccactaacattccatggaatgagttcgctacagctttccgtgtagctcatgtgcctgaaagtactattgacatgaagaaagaagaatttaacaggcttaagcaaggcaatagtcgtgtcaatgagtacctaagtcagttcaacaagttggctcggtactctcctgaggaagtggacacagacaagaagaagatcaggaagttcttgaaaggagtcacagttggaatgaggctccagttgcttgctcatgacttccccacttttcagcacatgatcaacaaggcacttatacttgaggatgccagaaaagaggcaaccgaagaatataagaaacgcaagtctaaccatcgggggaattcttcctgaggcgcacctcgccctcgctttggacaacccatgcaatatcaccagtcggtcactcaggctaaccgccagccaggctatgcccctcgtcctcagatgaaccatccggcacctcagccgcagcagcgtgccccaaatggcaatactgcagcaaatagtgttacctctttcaagtcaccgccaggactgtcagcagttcagtgtttccggtgcaacctgatgggtcactatgccagacagtgccctcagaatcctaccaacttgaactcagggcatgctaatggcagcactgccagaactcctactccagcagcagctcagtccagtcctagctcgcaggcaagtggacaaggttcccgtgcttccaacaactttggtcgaggccgggtgaaccacattcaagctgagaccgcttaggatgctccagacgttgtgatgggtatgttctctgtcaactccgtacccgcaatagttctgtttgattctggagcttcacattttttcatatcgcaagcttttgtgaaaagaaacggttgtgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgagtgaaggaatacagagagccggagagccagagagagttcaggctctagaacccattcgctagagtcccaacccctttctcttttttctcctccccctttctctcctaggcctgggcctcctttttatctggtcaggggtcaccacaagggcctccaactacctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctcccgctagggacgagagccaggaagctcttatcattccgaccggatggggcgaggcgtgtgacaaggcggctggtgccacctaacccgcgatctgaacgatctgtgaccg

SEQ ID NO: 15656 - DNA, 11558 bp, Oryza sativa
ccgacccctcggggagacagagggaggggtggccacgtcaccctcgggctcgacccccccgagggggttaggccacgtgggtgaccgcggctacccaagcctctagtcacgatacccccggccccatgtcaccgacagtagcccccggcgtcacgccagggcaatcgcccccctcgagggaagcgctcgggcgtgacgccactccttaggcccggtgacaggtggggccggtccctacaggcgggcagaaacccagcggtcgcaaatcgcgcgcatcggcaaaggaaaaccgaccgacaataatgagcggcctctttaagaccgctacattactcgagcagcgcgcgaatcgggacgagccggttcgtttcgcctggagacatgatgatggcgcttttcacggttggcgggcgtagttaatgcgcgcacaatctgccccatctcaaccgctacggccgcacatctgccgcgtgcgccgcaaacgggcgagtggggttagtggaggcgtgggcgcgagaaacgagggggcgaggtagcgggcgcgggaagcgaggagccgggcatagcattggcaagggtgtaaagacgccgagcaagggattcgtttctttcctctcgccactcttccccttgccttcgccacttgtgctctaactcttcgtttcctgtgccctacccttgccgcactcgctcgctctcaagcttctcctccgccggtgtcatggcacggggctccgcaccgctcgatggtagcgtgctgccgccttcccgcatcgtgagcgagaggcaggccgggctgccgcgccgattcatgccggaatctgccaccggccgggaggtggtcgcgctgggtgagggacgcccggtgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgtgagatgtttatcggggtgcgtccatctctccggctattccggtggttcttcaccgtacagccggtgtcgccgccgacggtagtcggtggctgctacttccagccgcgggggcaggtgctaaaccgctacattccctgcatcctccgcaaaaagtgggacgactggaagagcgattggttctacacccccctcgccgatgaagcgcgcttccgacttccgagccagcccccggcgcaggcctccagctggcgggcggcggtagatctgggagacggctacgacgccgttcttgaccgcctggcgggtctgcgatcccagggactcacgggggccatggtgttcggcgactaccttcgtcgccggatcgcgccgttccagcggcgcgcccagggcgcctgggagtacaccgggcccgaggactacattaggacccaccaggggcgcaaatgggactgggaccctgaggacttcaggatggtggtccaacgggtgctgaatctcagctccgtggaggcatccctcatcccccaaggggtcctccccctctgctgtgatccagagcgcgccaagatcctggccatcatgcaggtggtcggggcgtcgggggagcgggccccccgaggccacgatggcgcgggcgggagccgcaggggggaataatctaccccgggagggggtcgtgcttctgggccctgcgacgggggcccggggggcagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggctccgcaagatgggggggatcgtgccatgccgggggaacctcatctcgcccccgaggtggtcgtttagccgacctccccgcaggttcgtccccgcgcccaccgcggccgtattcattctcccatctcccaaggcgagttttcactcacccgtttctttttgtcttctggtttttcttctgcctcagcgagatcccgtcgcgcccccccgccattccaagtccggccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggccagactccaccgggccgaggagtccgtccgggaggcagaggcggcgcgcgcacgccagacggcctgccaaacccccgacccgactccgcccgaggcgacgacgacttccgaggccacccacgacgaggccgcgggcgcgccgctcgggcccgacccctcgggcgacgcttgggacgagccagcttcgggggacgcccccgagtccggcacgtcgatcggcgggccgagccgcgcggcacccacaccgaggcggctctcccctctgtcttccgctgccccactgagcgcgaagcccttcctgcaggccttggccgccgcgaacagcacggtgctggactggttaagtgcccagatggaggccctacaggcggagcgggcggagctcgacgcggcgtgggcgcgcgtcgacaaggggcggcgctcggtggaggccatggtggaggcgggccgcaaggcgcaccgctggcacacctcacagctcgaggcccgtcgtagggacctggcggagatcgccagggaggtggaggaggagcgggagactgccctcatcgccaccgccgtgctcgacgaggcgcgggacgacctccgcctctaatacgggagccgggcggcggagctagaggagaagctcgacgccgcccggggagtccttgacgccgccgctgcccgggaacggtgggcggcggagaacgaggcggcgtcccgtcagcgtgaagagggccttgaggctcgcgccacggcgctagaggagcgcgcccgcgccctggacgcgaaggagagagacctggccgaccgcgaggccgccgtcgccaaccgggaggcaacactggtggcgcacgaggccgcctgcgccgaagaggagtccgcactccgcctccgcgaggacgcgctcaccgagcgggggcgagctctcgaggaggccgaggccgcggcgcagcggctggcggacagcctgttcctccgcgaggcagcgcgggaggagcaggcgcgccgcaatctggaaggcgcctgcgccgagaaggccgcactggatcagcgggccgctgagctcgaggcgcgggcgaaggagctggacgcgagagcgcacagcgacggggcggccgcgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccgtctagaccgcgtcgggcggcaggcgggcctctggggcgggcggtacgcgaagtacgccgccaaccaggggggcctcgcccagcgtctctcagagatggccggggccctcgagcggctcccagaggagctcgaggagacgatcaagtcatcctcgagggacctcgcccggggggcggtggagctcgtactggcaagctaccaggccagggaccctgacttctccccgtgggcagcgctggaagagttccctcccggaaccaaggacggcgcgcgcgcgcaggtccgggacgccgccgaccacatcgtccacagcttcgagggtacggcccctcggctcgcgttcgcgctcgactccgacgaggagggcggtgacgacggtgcggacgacagtgacgacgaggccgacgacccgggcgcgttggagtgagcccccaggcccccgccaatcttaataacttctccttcttcttccgaggccttcgggcccccttcttgtatagactgatttaatctgcaatcaagtaaagaggaaatttctgcgtcggttctgtttgttgtgtgtatgagacgaggacggtctgtgccgcggtccttctgtgtcttggcttgaacaagggctcgtgcccaggccccagcctcaaacggcgcgtgtcggggctagtgcctggggagatcctcgtgtcgagactggccaggccgggagcgtggtgaccgagggttatggatgacccgattgtgggcctttgccgattcccccccagagttcaccacgccccggggcacggctcggttctgggccccgtttggcgattttagccggcccgggccaccgagggcagggtcgagcacgagcgtgctaattcaagccaagattcttcaaaaggaaacgatggcacagacacggtcgtcaggaaatcgaaaatgcttttattgaaatacagaagagaaaaaaggtaagtatgtgcatatggtagcccccggccaaccctgcacgcccggggggtgcggggttggcccgagcccgagacatgacacccgacccccactaggggtagaagcgacgaaggtgttcgatgttccacgggttaggcaactctgtgccgtcgcccgtggccagccgaacggagcccggccgagggacgccgatcactcgatacggaccctcccacattggtgagagcttgcttagtccagcacgcgtttggacgcggcgtaggacgaggtcgtcgacgcagagtgatcaggcccggacgtggcgctgatggtagcgccgcaggctctgctggtagcgcgcggctcggagggccgcgcgccgccttcgctcttccaagtagtcgaggtcgtctcggcgaagctgatcttgatcagcctcgcaatacatggtgacccgaggggacctcagggtgagctcagatgggaggaccacctccgcgccgtagacgaggaagaaaggcatttccccggttgctcggcttggcgtggttcggttcgcccagagcaccgctggaagctcctcgatccacgagtcgccatgcttcttgaggatgttgaaggtcttagttttgaggcccttgaggatttccgcgttggcgcgctccatttggccattgcttcttgggtgggcgggagaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtttgcagagcctgggccggctgatgggtttgcctggcgtgaaactggcacgccctgcaccgccggaccaggtcgaccgcatcgttgagagccgtcggccaatagaaaccctggcgaaaggccttgccaaccaaggtgcgtgaggcggagtgggctccacactcgccttcatggacatcggcgagaagctcgacgctttgttcccgaggaatgcacttcaggaggactccgttagccgcgcgccgatagagggtcccttccaccagcacgtagcgcttggagatgcgccggacgcgttcactcccttcgcggtcctcgagtagagtcttatctgcgaggtacgcctggatctcagtgatccaagcaatcaatctaggggagctgggagcgctcccctcgggtcccgaggcctgggctccgacgggcctcgggggccgttcaggcgcgtccgtctcccctacggggtcgggtcgcgccgacggctgggcaagcctttcttcaaaggcgcccggtggggtctgggctcgcgaggaagcgagccttgagagttcgttggcgaccgcgttatcccgtctgggcacgtgccgaagctctatcccgtcgaaatggcgctccatacgccgcacctggcgcacgtaagcgtccatctgcgggtcagagcactggtactcctgacagacctggttaacgaccaactgggagtcgcctaacaccaggaggcggcggatccccagtccagctgccactctgagtagcaacggctcatctggctccggggcgaccaagactgggggagaactgaggtacgccttcaactgagtgaaggcccgctcagcctcctccgtccaggtaaacggcccggagcatttgaggagcttaaataggggtagtgccttctctcccagcctcgatatgaaccgacttagggcggccatgcagccggtgacgcactgcacatccctaagcttactgggggggcgcatccgctctatagctcgtatcttctcggggttggcctcgatgcctcgggcagagaccaagaacccgagaagcttgcccgcaggcatgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagtttttcctcatcctccctagccatgcgaatctgatgataaccagagtatgcatctagaaaatacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgtcggaccggccttgcgcccggccgcacggcgagacggtgctcaatcacctccctggggaccccgggcatgtcagaggtcacatcgaagtccacccgctccgtgcggaagttggcggaaccaccgaaggtgaacgggaggtcgatatgacccaacggccaggtgtgccccggaaaacccaaaatttgcgagtaccaatgatagtacattccccttgtcggtgacatggggccgggggtatcgtgactagaggcttgggtagccgcggtcacccacgtggcctgaccccctcggggcggtcgggcccgagggtgacgtggccacccctccctctgtctccccgaggggtcgggccgctcccgtttcggccccgagggctggggcgccccgaccccctgtggttttggcgccatgtgtatgggttaggtgagcacagcgggctcacctaaccgcatttatagcaggttggacgagcgcgccacgccgcatttaatgcggcgcagcacacgcttatccggtccgtgaccggtcgcggtgtgtgaccggtcacagatcggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggtagctggaggcccttgtggtgacccctgaccagataaaaaggaggcccaggcctagagagaaaaggagaggagaaaaaagagaaaggggttgggactctggcgaatgggttctagagcctgaactctctctggctctccggctctctgtattccttcactcacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcctggtgaggagccccacgctccgtcacccctagaagggatataagggcaactaaaatatgcccagaagttaaccttagaattgaggaagttgacttcctagccaaaccgatagtcctagactcgcaaagcttggacatcatcctagggatggattggttggctaagcacaaaggacagatagattgtgccgaaaggtctatcaccttgcaaggacctggaggaaagcaagtctgctttacccctaacacccttatcgcaagtcggtctatcctaaccagtttgcaagccactcctttggaatcggtgcccatagtctgtgaatatcacgacatatttccagaagagttatcgagtatgccaccagaccgagagatcaagttctccatagaattagcaccaggtaccgcaccgattgcgaaaagaccctaccgaatggcagctaacgagttagcagaagtcaaaaggcagatcgaagaactggagagtaaaggttatgtgcgacctagctcatccccttggggagccccagtgctcctggttaagaaaaaggatggctctgagagaatggtaattgactatagagccctgaatgaagtaactataaagaacaagtacccgttgccacggattgacgatctgttcgatcaacttgaaggagcaaaagttttctctaaaattgacctaagatcaggttaccaccagttgaaaatcagatctgaagatatcccgaggaccgctttctcaacgcgctatggtctgtatgagttcacagtgatgtctttcggactcaccaatgctctagcattcttcatgaacctgatgaacaaaatcttcatggaatacctggaccagtttgttgtggtattcatcgatgacatcctgatatactccaagaatgaggaagaacatgttgaacacctgaggctgataatggaaaagctcagggatcatcaactattcgctaagttctcgaaatgcgaattttggttggaccgagtagcatttcttggacacgtgatctcctccaacggtgtcgaagtagaccccagcaagtttgaagccgtacttgcttggaatccgcccaagaatgtgtcagagatccgcagtttccttggcctagctggatattatcgaagattcatcgaagggttctctaagctagccagacctatgaccgagttgttaaaaaaggaaaagaagttggaatggtcaacaacctgtgaagatagctttcaagaaatgaagaaaaggttgaccactgccccggttctcaccttgccagatatacgaaaggatttcgaaatcttctgtgatgcatcaaggcaaggcttgggatgtgtcctaatgcaagagcgaaaggttatggcctatgcatccaggcagcttaggcctcatgaagtcaactatcccacccatgatcttgagttggcagccgtggttcatgctcttaagatctggcgacactacctaatcgggaacagatgtgaagtatacaccgatcataagagtcttaagtatatcttcactcacaccgagttaaatatgaggcagagaagatggttggaactaatcaaggattacgatcttggaattcattaccatcccagtaaagctaatgtggtcgctgatacgctaagtcgcaagacctattgcaatgcagttcaagtatggccagaccaagattgtctatgcagagaactagagaagttaaggctgacagtggtacagtcaggcgtccctgctaacctgaccgtgcaacctacactggaatcgcaaatccaagaagctcagaaagatgatgaaggtataaaagagttaataaaaagaatacacgagaagaaagacaccagtttcaccatagatgaccaaggcatagtgtggtacggatcacgcatctgtgtaccagccaagaaagaattaaaagatatcattttaaaagaagcccatgagtccgcctactccattcatccaggaagtacaaaaatgtaccaggacattaagggatatttctggtgggctggaatgaagcgagatgtcacggaatatgtggctctgtgtgatatttgccaaagagttaaagcaaagcatcaaaggccagctaccgatccccgaatggaaatgggaagagatcggaatggatttcatcaccggtttgccaagaacccctagcgggtacgactccatctgggtaatcgtggatcgactcacgaaatcggctcatttcgtgccagtgaaaactacctttgatggaaataaactggcagaactctacatgacccatgtcgtatgtagatttggttgtcccaagaagattgtgtcagatcgaggcacttagttcacctcaaggttctggaagcagttgcatgaagctctcggaaccgatttaaattttagtatagcttaccatccgcagaccgatggtcagacagaaagagtaaatcagatcctagaagacatgcttcgtgcgtgtgccctggatttcgaaggcacttgggatcgttgtttgccgtatgccgagttctcctacaacaatagttatcaggccagcattcagatgtcgctgaatgaggcaatgttcggaagaaagtgctgcacccccttgtgctggaatgaggtcggggaagcactagtgtttggccccgacatactcaaggcagcagaagagcaagttaagctgatccgagaacatttgaagacagctcagaaccgccagaaaagttacaccgacaatcggagacgtgatctcgagtttgaaaaaggagatcatgtgtacctgcgggtatcacctctccgtggtatgaggaggtttgggatgtccagcaagttagcaccccgctacatcggcccctacctcataaccgccagacgtggcgaagtggcttatcagcttgagttacctgaaggtctcgcagatgtgcacaacgtgtttcacgtgtctcagttgaagaaatgtcttcgtgttccagaagaacaagttcccctgggcaatatcgagctggaaaagaatctgacctacaaagaaataccgatcagagttcttgaagaggcagaacgtcagactcgacgaaagaccatcaagttctacaaggttcagtggagcaaccattccaaagatgaagcaacctgggaacgataagatcatctccgcgccgagtttccggagctgctcccttaggtgctgaatctcggggtcgagattcttgttaggggggttggtctgtagcgcccgttccgtcgtggcgcctagcgggaaaatttaaat

SEQ ID NO: 15657 - DNA, 1253 bp, Oryza sativa
tttgacaaaggatggaatcttttctgtgaaatcgttttacaaagcccttaaaatgcatcaggtgtctttccctcaaaagaaaatatggaaatttaagattcctctgaaaattagagtctttatttggctgtttgttaaaaacaaaattctcactatggaaaacttgtataaaaaaggttggaggaaggggaatgaaaagtgtcaattttgtgatagaaaagaggatatacaacacttgttttttgaatgtcctttggctaaacttctctggaatatcatgtgttgtgctttggatatactgcctactttgaatcgtcaggatatttttggacattggctggatagacatgataaaaacatgaaacacttgattgtgattggtttagctgcaatcatttggacaatttggaagtccaggaataaagcttgttttgaaaataaatttccaagagatcctactgatttggtctttatggcttgctcctgggtggattcatgggcatctttgcagaagttggaagcaaatcgaagaagactgcagttgggagccagacttataagacaggtggcaagtgacatcttctgctcgagacatggatggagacctggaatcaggaggatagaaggatgaagatgttattagttttttgtgatctgttttatccttttgatgaccgaatgatgtattcgtgttcagccatccagccctatgaggcatctggataagctctttagctttctttcctcgtatttgttttttgcttccctgactttgtaaggatatgttcatttctagtaagagaaatgggggctctctggccctaattctaaaaaaaagcgtgataggtgcatgaccggctcgcctgagcttggcagcgttacacagaacaacatgaatagcagatctagcagctgcggtggtgcaccggctctgggcgaaccgctcaagctggtctctgcgaagaggtcgctgatgatcttgtacatccgcctgaacgtgatgacgagcgatgaagacatggattccctcgctatcctcctgaggccatgttcggttatccctcccacaagaggattgagaaggatttaaagggtatttatttcccttcaatctactccaattcctttatcttggggattaaacgaccgagccctgaaaagggcgcgaaagctttcatcaacataacaaaggctaaccaatcgacgaaattacagcgggaacagagggattagtttaaaataactaggaccgc

SEQ ID NO: 15658 - DNA, 10671 bp, Oryza sativa
  unsure (1)..(10671): unsure at all n locations
aggccgggggcagatatctcaacctcggtttttcgggcatctgctcctagccaagtgaacaatcccgatttcgcgtacatctattataattataaatatagttataatacaatcacactatagtgcaggtacacttattttatatgaggtgtcaaagtgcttttcttctcaatcttaatttgtactataaacaacctataaatacttatagttatggacagaggaaattaatttatctctataattaactagataactgtgacgcattggatgaggataatgtgggtttagcggttggctagctgactaggtatcctgcagtgtcacaacccgcaggcacccacattgtcaaccccttcttctaccttggttgcgacttttttcgggaatacgcaaggagcacatttgtttccattaagagaaataaaagttatttacatttgaaagagaaaaacagcacgggactgatacaggacaataacagacaatcctaggtctatctctcgcgctgattttggcgaccaaacttccttctgaattgcagtgcaaggatcgccgggtttgctttacgccaaagagaggcttcgtccaccatccctctggccacatccacccaagatctacactgctgattgaagatccaaccgttccgttccttccatattgtccatgctaccaatgtcaccaccgtgtcgaagcctcgacgatgtgactcacttagcaccattctgttatcgcacattcattggtgaaaagaagcttcattcaccggcaggcagttggggtggccgattgctctcaaagtccaccaccaaagctgccttgaatctgggcagccgactaggatatgattaatgctctcatcctgctgatcacagagaatgtagcggtcgggatgcggcaatccccgactccacagtcggtcggctatccagcatatgttcaacgcgaccagctagaggaagaaatgacagtgagatggtgccaatgagttccagatcggcgtggatttaaaggcaattcgcccaaggaacaaaccttagttgcgacttgcgacgttcaatcttgcgatggtaaagcatggtgtcaccgatgatgctgttgactactgatatttgtcttcaaactactatctctgcatcacagtggtggaggcagacctagaacagctaggacttgaaaaatcaattttaaatctcttaaattattatgtaaattttggacaaaagcaacaaccaattagttatagtttttaaataatgtatggctccgccactgctgcatcatattgttcctcatagctaccctgaataaaattcaggcaagtttcacgcatgcgccaaagtttacaggcaataagtttaagagcaggatataactagagttcggaatatacagatgagaaaccaagtttatgctcatagacacagattacagaagaaatatatgacatgttcaccttcaagcttttactctcaagtctagatttttcgctttctcacagctgaaattcacatagaaattttattcggtagtcagcagtcagcatacgaaggttagcacgtcagatattttctaaacagcaggcaatggtcacactagccaacaacacatcccttgtctttcacgttgcaagtttccacgcgcagtaccgctacagttgtcctgatgtgcagtagaactgtagaagcactgtctgcttgctgtagctagcttaccaaacattgcacggaaaggtttaagatctgtttagtatacgagcctgaagtagacaaaatcatcagaaaacttacccatgagacgatgaaacatgtcctacaatctacacttacaccgaataagtggagatcttatagttttcccaaaaaaaaaaaggtggagatcttatgaacatcactggccattttttttttcttgacagctgacagggacgccgtaggtgtgtaatcgtgccagcgatccaacattccaacgccacccctcttatctccaagtctgccggaccttctcactggccctcttcgctatcgccttcccggccgtcctcctcttgtctcacgtcctgcactcctgcccttcttatcttccatgctgttaaacaccctatctgactagtctccaaacgatccagtcaccgtacctgttacatctcgcccagcggcacctatcctcgatcgatggctgttcaatctgcatatcatgtttcatttgaatggcttccagtgtccacacaccctcacgacaataatatctgcacatatgcgttttcatttcctctcgtttggaagtagggatgcaaacaaccttcactatattggtaatataaccatatttcttcgaagacaaaatcgaaaatgaaaagacccaaaacgaaaacagtgtccaaaatatcagaaagtcggaaatgaaattgtatgaacagaaacaattcaatatcaaatgaataccattaataaatatcgaaaacattgagctatagaagcacatatttagcttaacattactatataatatcatcaattatattcgggcttgtgatatttggttgaagagtatttatatatagatatatatagctataaaagcacatattacggtatttatatatatggatcatagatattacagtatttatatatagaaaaaaaaagtccgaatgacacccctgaattagcggggttgatcgaattaccccctaaactcaaataccagtcatttcacaccatcgactattcaaacggaacaaatgacaaccctaagtaagtccacagtgattttggtcaatgttacgaataaggcatacctcctattttacgacttatggaatatacgagtatggtataacacgggttgtttccgtatgcgtcgtaggaatccgtcacggattatggaaaatatctctacgggtcgagtgatttacaaagtcctactcggtatggatagagctttcattgtatcatatgagatccaatgtctccgagtcttacttagagatcaagatgatcaacggtataaaagggacccctgggaggggtgcaaggcatcgaatctcatcgccaacacaccaccacagcctacaaagccagagcatacggagccaagtcaccgggggatttcgtcgagtctatcgattacgatctcgtcggtatcatcggatccatctactcctattgtattttgtggcttttccatattaatcccatgtaaaacttgactagggctattacctgataaggggtctgaaccagtaaaatccttgtcttctgttcgcttgatgtcgtattacgtagatcctcgttccaacgtaccccaataccctaatcatccggtctacgagtatcactcgtcgacatttatcataactgatagttgtagcgcccgttccgtcgtggcacctagcggaaaaactatctcttaaaaatcctaattgcgaaatctgtttctttgcttgttgtctagtgtccgtgccatctcagatctcaaatccccgatctatcgtcgagttcatcccgaatccaaatccttcctaaatcaaatccctccgcaaaagtctatttcgcctccctcgggttcgatgggccgaatccctctcggcccatctccccctccctccccggctctctctctctctctctctctccctctcccccgcactgcccgtacgctgcgcacgcgtgctcgtgagccgcgccgagccgagcgcccccccgccctcgctgctgtttcctgccgacgtcgcccaaatcgccgcgccgcccgttgcttcccgcgcgcgcgccatggtggccgaccggccagtcgccgccgccgtcagcgcctgcccgcgcctgccgctcgtgtcgtcgctccgatccaaaccgcccggccgtcatcggcgtcgtcacgacccggcccccgccactccacgcgctagcctccaagggacggaggcagagctcctcctccctctgctgcgtcgcccccgctccctcctccttttccccaaagaggcaaggggcaagctccctttctcccttcctttttccttttcccctccccgccggcgtcatccgtctctgttgccgttttggccgcgagcgccgagcgccagctcgtgccttgaccgcccaaggtcggtttccaaaccgacatcgtcgtcctataaaccaaggcgccctcccatcgattcctcctcccgttcgcttgccgccaccgcgccattgcccgccctctgactcgcctccgccgttcatcgccaagcaccgggagagccggtgcgttcgtggacgcggaagggaactccgggcgctcgccttcttcctcttccccggcctgaggccggagagatcactcccgtgccgtcggcccatcgtcactgcgccccgtccgcacggtagcgcatctccccgttctccctcctcaatccatctcctccccttagttttcggtagtagcatgtgtagcctccccgtagctagccggcgccaccccgaccgttgccgccgctcgctgtgtgctcgccgccgtcaccgcccgtgctccgtagcgcccgaccgtcgccggcctcgctcggcgtagctccgcctaatctgacgctagcaacggattcccgtagccgcgtagatgctctcaccgccgggaatcggccccttgtgacctcatcgccgtttcccccttccctcgccgccggttgccaccgccgcaatccgccgccgtcgagctccctccggcgaatccgagccgttggctcgtctcccctcgtctcatgcaaccatccggtgtgctcgctttcgcctgtatcgccgtggttcgccccgcctttcgcagccgccgtccgccgtccgttccggccgacgtcgtcgtctacctcccgccggcccgcgtggcagccatgtaggcgccacgtcggtgccagctcggccaagaccgggtcgagccgaccccggtcagccgctccctccggccccgctcgcgggcgcggtccaccgctagccgtgaggctgcgcgtgggcccgccgcatccgcgtcctccgcgaaccgcgcgcgtgcaccgcgtctctctccctgaaccctagcacgccccgcgtgcacctcgctcacggtgagccgagtcgccgacaagcgggtcccacccgggaccacgcggggtggacccagccccccggctctctctcccctccccgcccgcgcgcgcgccttgggccgccttcttgggccggccggcccattaagctcggccgagccgccccattctctcgggccgcgccctagccgcccgagggaagtctaatttccctccctccttcttttcttttcttttatttttcaaaaaggatttaaataaatccttttcctttagaccaaaaatccaataatcttagaaattcaatatcttcccaaccgtaaatccgtttgactccgtccaaacttccaaaattcctcaaatctcgagatctatctaatggcacgcttagaggtcaataatagggctttattttcgccgtttgttgagttgtcccgttttgcatgtagtttcggagcccgaagacccgcagtgcgaggatttcgaggatcaaggtcaagatctcgagcaaggcaagccacctttgaacatcttgagcctatatttgaacttaattatgttgcttgaaaaatattatgcattgataggatcgcacttaatctgcttgtcccgtctgcaaggcagatcggcggacctacctaatttgttgcatttgatccttcctttgttaattgttataccatgttcccttgtaaccacccagttgcgcctcggtaatcgtgcactctgcacgagtatcgacggtcgccttcaaacttaaaatctaaaaaacatcttgggtaaaacttgggttttacaaaagacttggaaaacccgacacctgggtcggtgcttgcgaactaaatgattttccaaaaccgtggaccggggaacgtaccgggtgtacggtttcccgctcttgcacttaaggaccatttccttagaatttcatccgaacataagacaagtacgaccacatgggtggaatgggacacccctggctgagtaactagcttattgggggagccatgatgctaagagacatgtggattcgccggggtgtgtcggggaggacccctgggcttcctggcacaatatggtctggacctaatctggtgttggtctgggacccctctcgttggcatatggtgaacctgtgtcggctttcgaaatgccttgtcatgaaagccttaaggtctctagtcgtggccgttctgcacggactggatgatccgggttagtaatgtcgtgtgggtaaagtgtacctcctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatctgcggctgatgagatcagccaggcccgggtggccgtttgaaagctgttggccgggtgccaatcttaatcaattcaaaagactgatacattgcacatactccgaccggacgagacgcactgtctcatccgtgtcgtttgagaaacactcacctagttgtttcagaaaagagttcaaataaaatcaattgcaaaaacaacagcctttctttgaagcctgcattaaacacttatttcccatggcttgctgagtactcctgtactcacccttgctctatataaataacccccccagttgctgaagaagatgaagcggatcccgctgacgaggagttcttccaggagcaagccggctacgatgagttttagggtttcggcctagtccccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgttttcctgtgataccagcactgtttcctgggactggtatcgattaacaggttaatttggagcgtcacgggctagtcctggtcgggactagttcggggcgtgacaatagtctagtattttctaaaaaaaatcgctagcccaattgtcggggaggtagcatgcccctagcctcaggtgcagtaggtctcagtgacggcaacatgctcatgcggtagaaagatacagtggccctgacccagggaggggcggatgtgtcgtcctcaaccttgggtgtgacgggtctcaatggcggcgatgatgatgacaacaagcggcaagggcttggctttgaggttggggtcaacgagatggcgaagtcagatggccttgcggggaagagacctgctgcaacatggagacggttggaaacagagcttgaggtgacgccggatccacgtggagcttggggcggtgacagatccaactagagctcgggtccatttgtcgccatcttcatcacctcttctctccctccgcctctttgttcgcctctgcctcttccatttggcgctgcatgagctcgacggaaccaggccaaggttgatgctgcgggtagggtgacatgtcggtggcggattgtagttcttcagaggcgggcaagatttaggtgatggactgcggatggtgggcgagaggcaggcagagatcgatagcgaccgagatgagtcagggaagaggagaccaagagaggaagaagcataattgacatgtggactcccacaaattgttttgatttttttatgctgattggactaccacgcataagccatatatgaccaaaaccgttctcgagtgagtcatgggggctcatccggttttaaaagttgagtgtaaatgatgtctatttttgaattgatattgtaattcgtaccgtcgcaataattaagggaaacggtctccttaggaatatgttaattatcgtattatgacaacaccattttccatgtaagtacggtaaaatgagggaaacagtcggtagaacaataaaatcgtattcgtttccttctcttattttgtcactttctattattgcttccatggaaattttcgtcaccattttcacccatactcaaaagaatatgccaaagacacgaagttcgtagcaccataacagacaatccaaccaacttgaactattaacatgtgaggtatgtcgcctaaaaatgtctacacacctaagtcgaagcagcgactcgaatccaagaacacgcgcacaaggctcaagcaatgcatgtgaacgggaacgcgtccagatacagaataagtggacggaatttattctgaaccgagggaacaacgcaggatttgccgttaagctatgtttgacgttgcatgttttcaccgccgtggatttccgcgcgcaaccagtggctagcccacagacggcgacacctcattctcccttctcccctctcctctcgtcgccgtgggtccaatccctctccctcatcccccgtcggcggcgacggagactaaaacgacgacaacgccccgtcggcagcgacggggactgcaatgacgacaacggcggcggcgatggccgtgaggcggcgccacggcgctagcgaggagaagcagtcggacacagcgtgatgaggaagaagagggatggaagaaggaatgacatgtgggggccgcgtgggccccaccatttctctagctgacatgtgggacccgcgtggcccctgctatttgtaaatgattttttctatgtagctgacatttggggccaacgatttttattattttcaaggatagaattgtcacgtcagcgccacgtcaatgccacatgggactgtaagttcaagtgccttaaatttggttttggtgattaatgacaaatctaactatatgagactaatcatttttatgagcctttctttgactagtctcatttggatatgaaagtaaaaatgatgagaggtatgtattaaacttcacatattctaacttggtctctcttgtagatccaaaatatagtgtgagcttcctatttgatctttattgattatgtgcatatgcgttccttcatatccatatgtatgcacatcttgagggggagcttattctatattttgtttattataagatttctatcttgatttgaaatcatttttcatctcatctctctatattgtttatatcgggttattatccatcaccaaagagagaaaatattgaaagatcttcgattaaacaatttgtgtaattgttactttggtgatagatgataaaccgatgtttatgggattaacctctcttttgcataagttgtctactaggttatttcccgataatgagatgtggaagacatgcattcttttgtgatggaacttaatcatgacaagaatgaaatgcatggagataaaacgatatgtaccacttcttatctcctactttttgataggttcatatatatgatttctatgttattgatatataagtgtgagactaatgtttactcgaatgttatattatttagtctcatttacattgagaacatggagatcatgaaggtatatgttttatgttggtctacatcattagtacatatgccttctctatatgtataggataaacccccattggtcattctctaattatgcatacacttgaatctcttgtatatttatttgtatgcatatatttagggggagcaaatcctatacatttattgtgcatgttccagatccatgttgttcacctattatttatatcggatctttacacttgagcttgcatacgagtatatgacacttgtaatgttaatgaatactcaacaagcatatacatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggtaagaatgaagtcaaacttgtgatgagaataaagtcttgacaaaggatggataagacctcggcataaacatggttcaaccggatggtcacaagtgttgatctcggctcaagcttgaccccaagatggatggcgcaaggcaaaggtataatgtagctaagaatattttcttagtcttttcccggtcttggtgtttggtgtagaccggatttgctagataggcgccgtactatcaagaggggtctatgaagcgagcttgtggatgaacttgtgccatattagtttatatgcatgtaggtgtattttgtgggcttgtctaaccaagtgtgatgagttttctcaagtcctaaaccaagagataagtgggcatgtccaataggagtgagtgacatcttgtgggtatgtccggtggatatcctttggagtgtgagccctttatccttgacttaagttgtgtttcttggatggatttttcatggtttggatggccctttgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15659 - DNA, 557 bp, Oryza sativa
tgctgtataaagtacatacctgagatcacaaaattaagggggatattttggagacaatgtctctgaatattgcaaaaattaagaaagcaacaactttggtaattcaactgaacataaatagagtccacttcttttactaggtcttactaacatgggggtttccacagtaacgtttagataattttctacataaaaacagttttttttttcaaagtgtgaaaacttcaatgcaaaagggctcttaccagaaaagaaccaagacaaatgtcgcattcttgtaaaagttgtagaggatcatatatgacattctttgataattccaatggccatgaactaatagaagagggaccaagaatctgaattggcccatcgcaaaatctgatgccattacagcccaatgccctgcttcttttgaccactgatgccaacaccaacatcagccatttgaatcattgaaacatcatttgcacctgaacaacaaaaagataattagcatatatcacatgtacatagaatggttctcacagaatattatatgccataatagcagaaccagg

SEQ ID NO: 15660 - DNA, 2263 bp, Oryza sativa
tcttccaggagcaagtcggctaccgatgagttttagggtttcggcctagttcccaagtcgcgcctgtgatgaatggtccaagtcttggcttccgctttcccttttgtaatgcagttgtgagctcgggatctgtccgcagcccaacatgactgtactcctactctgtaataaagagacctctgttgctgtgatattatgtcttcctgtgataccagcactgtttcctgggactggtatcgattaacaggttaatttggagcgtcacgggctagttccgttcggggctagttcggggcgtgacaaaactctacttttaattttattatgtttattttgaattttagttagttttaaattcctatatagactatgtactctacttctaatattccttattttttaattctgaatttctatttttttttcttaattgtatttctatatggactctatactctacttctaacattccttatttttaattccgaatttgtattatttcctaattgtatttctatatggactttatagtctacttctaatattccttatttttaattccgaatttcagttatttcctaattgtatttctatatggactctagtctcctcttctaatattccttattttttaattccgaatttcaactatttctaaattgtatttctatatggactctagtctcctcttctaatattccttattttttaattccgaatttcagctatttctaaattgtatttttatatggactctgccttttctttttctccgattaatgtgagaatttctagaccatgagagcgaatgtggaggcttctttttctattcctttaataatataactagctgggtggcccgcgcaattgcgcggctagcacccaaacaaaatcatatatttttttagtatgattttacttaaaatttattaatagctatctcattgtcttaagactttgaaagaccaaaccttatcatcctcgtgtttctaattatatagtttttaaaagtcacaccagttgctacccccttatgtcatctccttctttatttgcttgctcgatctaccactatttttattcattcttcttggaacctttaaaaattggattttgtagtttttagagtttattgtcatgttgggtttcatttttataatttctagatatcccgtcaaacgttgccattatactcctctgcgggccatccattgtctctactctttattgttattgagattttaaaaatcgaacataattatcgtttaggttcatttttactttctagaagtcctgccaaaccgtcaatagctttgccattgtactcctctacggctcgcccgctgcctaccttctttattgtcattgagattttaaaatcgaacataactatcattgtaattcattctttattgtcattgagattttaaaatcgaacataacttgtagtttcattttttaaaatttttagaagtcctatcaaacgatgccactatgcccctctacagcatgttcgccgcctacttttttattgtcattgtgattctaaaaatcgaacataactatcgtgggaattcattttttattttctaaaagtcccgtcaaacgtcggtggctctgcaactatactcttatacactccgcccgctgcttctcctttttattatcattgagattttaaaaatcgaatacgattatcaatgcggtttgtttttttactgtctaagaagtcccggcaaccgccttactcgtttgcttcacgggctgcctgacgtccctcctttttaatcgtcattaggattctatttgatgttttattaacaatttttatatgtcgtatcaaccgccaccactctactcctttataggcctgttacttagtttatttttattccaaattttaattaatctcgtattgggttcttatatgaactcttcttttaatgttccttatttttaataccgaatttcagctatttttaaattgtattcctacttggactctcatttccttttctaattttggattttattttatttttatttctaattttgattaatctcgtattgggttcttatatggaaacttctttcaatattgcttgtttttaattccgaatttcaactatttttaaattgtattcctacttggactctcccttccttttctaattttggattttattttatttttattttgaattttgattaatctcgtattgggttcttacatggaaatttctttcaatattgcttattttta

SEQ ID NO: 15661 - DNA, 2987 bp, Oryza sativa
  unsure (1)..(2987): unsure at all n locations
ttcaatattgcttatttttaatccgaattcatctatttttaattgtatttcaacttggactctcttttttccctaattttagattttatttaatttttatttcggattttgattaatctcgtattgggttctaatatggaaacttcttttaatattgcttatttttaattccgaatttcagctacttttagattgtatttctacttggactctccttttcttttttttctttttctctgattaatgagggaatttctaacccccacagcgaacgtggtgcctccttttaaagttgttttaatcatataatagatagattcagctatttctaaattgtatttctatatggactctgccttttctttttctccgattaatgtgagaatttctagaccatgagagcgaaggtggaggcttctttttctattcctttaataatataatagatacgtgtactcctatactgctaaattaaaacgatgtgctaatgatatttagtactactcacgtagaacattctggaaagtcaggaaagtatcccgtgctctgtaaagttactttagttaaaggatgtgaacgggggtgccagcagttgataattagcgcttagcggccgtgttgcacatgtaaaaagggattagtaatatctgatatgatctgagccccctggtgaacttgtgcatgggtgcagaagttctgcgcatacagcccattggtggctttattgcaaggcagggttgttgaggatttgcataaataatagattgaacccaagctaggcgttctgaaggaagtagatttcatgataaaaactcttcatgtttcttagcagaaggtaccaaataattcaaaggtgcaataatgcgcattggaggatcaattaagctaaacgaacaaaatttagaatacacttttttttaataattacgcttatatatgggagaattggtttttaaaaaaaaaattattacgntgtgtcatagatcgatcacgcgggtgcgctcacaaatccgcaccgcggtgtgagcgtctccacttcaagtgtatatttctactattattttccatgcatgtatataaacatgaattattaaaaaaagtatattctaaaaaaataaactgcactactataattaggagtataaagaaagaaaaaatgtgatcatattgcacgcccatatatttctgagtcccttttttccgtgtaaaagatcctccattttgatgtccgcttgtagtgtaactgtgtaagccatattctgaactagaggtagtataattagagcagtaaacatgccaagaaactaggcgtcaaaaatgaagaaatgcaatatacagtgccgtctgcaatccggactgcatggggtctaacaaagactattgtcttcatcgaagcccctgttgagctgagctgtggtgctgtttctacaggaagaaatgcataacggaatgacggtcacagggggacacagaggactagaggagcttcctagaaatgtaactgtaaatgcagtagaacttcttaagaattcagtaaatcatcgtcatcggcgtgtgcccaatgcaagaaataattccttgtcgtctgccttctgtccacactccatccgtcgatgcctgatgatgtagagcattcgagccaccgaataaatggcttaatctctgataaattaatcagcatggatgctaactagtcatcagtgggtatgatctacaatgcgatgcaatgatgggcactaataccccacaaattaagccgagtcttttcagtactttttttgccatagtggaattactctaccagagcatcaccggccgataatgaattgaagttgccagaattccatgggaaacgcggtgctaaggactacagagtttgaagagaaacttaaccatcgcaatcttccaccgaactgcttactcatattcgatcatcgatatgttttcctgtttgctgatcgatcagaacttcagaagaccacattatatccgaagcttctgaatctgcaagggatgagtagccaaacccgacatggccatgctcacagctccatgaaaactacatctgctcgaatctactaactcatgtcgcttcagcaagcaactagatcagagaaagagatggttccgatcatgacatgtacggtggatgcaacctagctcgtcaaatgtacgcccaccgatcgagttgccggttatgtagcacgatcgatcgacgcgagctatcaatcaattcaaccgggcacatgctctgggccacctgcagagtgtaagattgtgcctgaacttattctaaactgctgttcttgatcaggcctcgacatgagcctcgccgtgttgctcgatctcgcatggcccctctgacggagctagggtccagagttttgagttatttccaagaggaaaaatccatggcgaagtgtgggggttcagaatattagtgtagcttagtacgcagcaatgggatgatgacaagcgccggaggagggagaggggtgctccatgatttcattctgcagcttagtagttgcttgctttatcgagattgatagaggcacgtggcagaataagcctatttgctttgggatttccgtcttttgaagctgattagctacgaattgtgcatgtattatcatcatcctgacatcctttgctacgctacgcatgattaccgatcacatcttcggtacttgatcaggaatatatgtaacagatattttcacgcgagtagcacaagctggttgagaagggatttgaaaattccaggatagttcagccattcttgacagaatcacagaatcacgctttgtatcgtgtactgtatagctgaagaatgaggacccgacccacatgtgagcagcttcgactgactcttttgccatgtctgattcagtgaactttggggcagtccacatccaatagatttggtcgaggctctggcggttctaaactacattgcgtccaattcagactctcttttttttttt

SEQ ID NO: 15662 - DNA, 39100 bp, Oryza sativa
atcgtcttctcagcagtagcaatgcgttagcggggaggcggggcattggcaatagagcggcggtgacggaggaactccagggaggtgtggcatggtgcgccggctaagggcgaagggagtcccctttgccacctccaacttcccattttccctcctctcttgccctcccgactcatgcgttcctaggcagtggccgacccatgcatagctctaggcggtggcggtgagtcgagacctggagccacctgggagtcaggaggtgtgacaccacgtggtggccatgagcgcagcttggcaagcacaccctgaacgccctgggagccaaatcctggatgatgacgacgcccaggagagcctcttcatcgagcatgtcgcggcggcgtgcgtgggagcatgagatggcgccacggggagagcccgatcggtgctcattgcaatcgtccctctctgacgtcatcgctaaggagaggagacaaaagtaccttccccacggcaaaagctggtgtgaaagggagcctacgtgttgcatgccagggtgggagagagaagaggagcgctcactgccagccgccgctgctcccgttcttcgtcccgccgttgatccttctcgtcgtcccgtcactgctcccgcttgtagtcccaccgcgaccgccgccgctgtggagaagagggacaagaggagacagccatgggaggaagggccaaagggggaagagagagagagagagaagggggaaagagaggaatggggaagaacggaaggggagtgagaatgatatgcgggtctcacatgctgactcagttggatagaccaagctaattagccacatcaatgaaagccaccgtcaatactgtcgagagaatcaaattgtacctgttttaatagttggagggagatgaatcatattagacatatattgaaggagttgaactggacttattcccaaagctggccaaccacatagtcctacgcaactaatgggcttaccgggccatcaattttatcaccctaaccatccccattttgcaatgtaaaaacgcaatgtcatatgctgtgctaggaatgaggaatctatccatcaataccttccactccgtattctatcccaataagtcgctctgataaattaagttcccacttcaaaaagatataacaattaattaaatggatcttattgtcatgacgatcgatcatactaagaatatatgttaattaaaacatgcctttggaaataccaatgactctttagtttttagctttggtttcccttaaaactaaataaagtcagtgttgtggataatgaaatacagttgtcggactgagaggatacaaacaatcaatggaataccgattaatcataattatatggaaatttggtcttgacagatatatggtttcccatttacttcacttgttaattgatttacatattaaataaattatataaataaattattaaatgatttttaaagttctaaaagaaaatcagggcgtgacacccatttatctacactactattgatgcaaaaaaaacacactggcctaggagatctgcttagctccagtgcatgtccaagattttaatgagatgcgggcgtgccagtcagtttgatcatgcagctgacaagatatgtaaacagcagatcggctgacaagccaatggagtaatatcagccgatagccgatattagtcgatgctgattctagccgatgtcgatagggttttaagcaatcagctatatgttcaatgtagacaatgatataaagacaatcgtctgatgataataagatataaaaataatataatccaatagaaatcaatcggctaataataatatgataggataagtactgatccgatggttaaagcatatacatcggctaaaagtccgatgccataaaatccaatcgatttagataaacagtgagacctttgttgcaatcggctaaatccaacttgtatgtaatctttgtaagccgatgcaacgtccagataacttatcggctagtaccgcgataaaacactaggtcggacctaaccgatgcagcatgagattatatatgataatctaatacttgatgagccgatagatctgtctaatgtgatggatataacaagtctatttataacagcattgtgattgtagagatatatcggctaagacagaagatcagacataaccaagacagtcccaactaaactgatgcttttctaaacacaatgcaattagagatagaattgagatataaggtaggcaaatatatcaaccaaactagagtgatccaagagatcgaagcgatacagctttgaacaacaccaatgtagctgatagattcaccagggccgatggaacgtaagacttaccccttcgtcggagatcgaactgaatcgatgcaggcccgcgtcaagtgccaaattccgccggttgataagtaaaacctcagaaaagaaggtagcgatgcgccgagagtagtattgatcgagagatcaattacaataaccccgggtgtatatatgtatacccatgggtagatactaatccttgtaggataagaaagaaactttcctaaagataaaaggaaaacataaagtccttatcgaacactaaacatacttccctaaagataaaaggaaactaatagactattcttaattaatagataaattgacatgccgcatcctccttgaactcggtcacttctagataaacttcatttagtagattaattttcataaccgaatctactaagaatccgactattggcgacttgataattcccatcggccgattccatggctctgaagtcgatactgactctaggccgatgatgactttggagcttaccaaatttcactattaacaactactacataaagtgtttttacattctcggccaaaacctattttcgcagtcgaatggcagcccgccttcccacaagtgtctacgaaaatagagattatcgtaggtccatccagccgcatgggtgaatcgattatccaacatgaccggttaagacggccaactgcgataatgttttttggggtgaaaaaataaaatcaaaatatccccaaatcccttctcctctcacaaaccctagctctagatccagatccaaaagttcatcacgacaacaacagaatccattaatccattacttgaaattgaaattgaaacagaaccaaaaaccaaatgcgaacaaacataaacttcatccacatccacaaacatgaactccatccacaaacaaacataaaacaaatgaagatctggccacctccaccgtcttcttcgccgccggatccggccgacgccaccaccatcgtgcggatgcgccacctccactgccatcgccgccaccgagacaggctgaagagagaggcacgatgcgaccctcttcactactccccgcccctcccaaggtcaccgcactagatctgttgatggcaacggggtgcctgatcttccgtcaagtagagaaaactatcaatttggtggaaacttgacacattatcgtgcttctgatcaacactatccgaaccctataattgcagcaccacgtcttctctggttatcaaccatgtcgaaaccgattgaccttgttgctgcaaattgaaaacataagcaagaacaagaaaggttgcaacacaaatgcagatgattgattaataactcgaagttggggttccacaaatcaatgaacgacgaaactggaatggtataaataatctaagtaaacccaaccctaacttgatagtggctacaatatatataggttctaaggtcgaccaaggaggcaaggacacctggatgcatccttatttgattccaacacgatacacggcccaacagcccaaaagacggtgatgcaacacccgtacatattctagacgccacgtgtttcaacaattccatttgactttgaaggaatgatgtgagaccaggtccattggaaaggcggtcttgttacctttccatacataggtagaacgtcgaagatggagtccgaatgtgacttgtgcgacattttttgcacagactgctcagggagcccgaggtagactcgaacatggtatgatttgggcctccatattgacttgaatgcccttgatgatcttgtccatcttctagcttctctccttgttcttctccatagttcctaatcataataaaattattaggtaacaatctttcctaaaaatcacatgaagaagtacttaggaacaagctcacctataaatgcaattgtcgggtgtgagctctagtgattggaccttgtacgaaaacatgagaagtattttgcgtatccaaaggagtaatgtcctcatcatccatcctcatgtggctgcgctcaacctccctgccgcctcctctttgccatgccatcgccggatccacccctctcaaggccagtcagcggtgggtctacaagagaggcaaagaaatcgtcgtcgatccgttgcctccatgctcagtcaccatcggagcggagggggaaaggtgatgggagagcaggagaaggaaggctgaccttcgccgccctctgccattgcacgctgagagagagagagagagagagagagagagagaggacgggatagctagagagagggaggtggagagagggtgtcagtggctcggtgcgggtcattgcacaataagaggtccacttgcgataatacattaccgcagactggccttgaaccgccccccaggggagcgattttttgcatgcggggtcagttatggtccatttatagcctgggggaggcctcgtatggaaaaatcaaatctgtagttgtgctaatacccgattaatttcaaggctctttttatccagcaaattgattccctgatcctttccataaagaaaatcgttttccattaccttatgatgaaaagaatccattttgatcatatttgttgctacctgctacgagtacatcaatagtacaatcatcaactacaaatgccacacatataaagttactcgctgactagttggcatccatgaagaaataaaatctgcacaaacattgaaactttttcaaattggacacccatgaatgaatgtatgattatggtgaccaaatactccaagtgacctttacaacaaatgagcttgttcatctcagtttggtcctcacttctcagctgagaatcccgtttatgtacctacacaagattagcacaattgcataaactagaagacaatcctctttaataaatattgacttcttccttatttgtggttccaaatgattgttagcctatgtggtgaaagctttctagctgaaattgtttaatcttgtacacgttttggcccttctaaaaggcttccgtgtactaagggcctgtttggcacagctccagctccagcttttttggagctaaagcccagccaaatagtttctgctccacctaaaatgggagcggagctaggtgaagcgctctcatagaatgaactagagaggtgtagttgggtttaggcagctccacaactccactccatactcaactcctgaagctaaattttgggagttggagctctacaaaacaggccctaagaaagcttgtgtaaaacgttatgttgtgtaacactgattacctagggttaatggtagttagtaagttaaagatgtcacggctcaagctgctactgtactaatcatttgtggtaagtagttaatcatatacgtttaagcattctccttggaaagtacaaggagcaaatgaagtaattggatgaagtaatcaggaggcgtgccattacggcgccccaacgtctagttttcttatatacttatcaatcagtctttgaacaaccgctcccatttggatatgactcatgaggaccaattagctccattggtcattcttcatccaatggctatggttcctttatctctattttgtctttttggtatcagatggctgccgctcaattgcttacatggatgaacctagctagtacgaattggtgttggcgtttcacttagagagaatgggacaatcgacatcaaaatgccaaaaatttaaggataaacccgttactttagagcatatatatgatgtattatcccatagatagtagttatcatgcaccatttatcatttgttttttcttcggtacctcgactaattaccggttattctgctagatatgtaacggcattgaatatatatccctatttagacatgtcggttttagtatgcagtttcactaatacgacaaatctttgtcgtatgtgaaatcaaaacgccagatttctaaaagcttaaatccgcgggtagttaacattcagtatttttatagtttaattcttgatacttctgaagataacaaattctaaatttgtgatgacaataagattaacctgtttaaatactttggtgaacattggccggactcttgaaacagccgtccatcctattgatgcattacagcattgcttatggtatcttgatcagtactactggattaaatgctcaaggactgtagccaaatcaaccatggtggtagacacacactcaacgttcatattcatgcctggcatgggatgtacactagagtgctttgcatggcatgcagatacagccatatacctttgctcaatgcctatcctactggcagctcattgccactactgatatgaattttatattgacaacacccttttgtctgccagctcacctcttcaaacgttgcatgcacttggtgtacacaacctcctgggctatacggacagcttaaaagagacctggaaggttataatctagctctatttgtgaccattggatcacttcacagatgaacggctgatgcattccctcttctcctatataaagagaggactcaggtctccatcacactattctatccccttattgactttctctcaatcgacctcattctgtctttcctagaaaatcctccacccacaatcaaaaatctatgcttccaacctcaaagaacaagttgatggcggctgcaggtaactccttcctcaaccaagatccgacgatgatgggatctgggatgccgcatatgtactttgcaagctctagccatggcaccggtgcccactaccaaagtcctggtggtgctcccatcaccatggcagtcccggacatggggtttcttgttgcagggataggcatagctccatctagctttgtgatgccagagggggccctagcagctagctatagcgccatggctaccgttccagtaggggttgttgttcctcaacagcagtcgtcacgatttgggggcaacaatggtaaccctgggtcgttcaaaggagcatggacaaggcaagaagatgagtaagtaatagatcaatcgacttctagtgagattttatttttctcactaacaagattttttatatctatgtgttaacttgttttcagagttctcaaacaaatggtgatactccatggagatcgtaagtgggcaacgattgcaaagagcctcccaggtcggatcgggaagcagtgtcgcgaaagatggaccaatcatttgcgcccagacatcaaggttttactcttaacttcttgattcctatattattatgtagatctaagggggtttcttcatccatgtgattttgaggggtgatttctttttagatttacattaaaatcatgctaagcagtattctagcatagggattatcgaaataattcattttgttgcggttgttgtgtatgctaatcttaatgttctaggcaccgagtaatccaaagcctccgttttatatgatgtttttaggactagaaaatcagtagatcttgggctacaagatcaaagattcagactcatcatgtccctgcaggaaaaaaaaacaaaggcaaatctgtccaaaattgtacctacttcaattaatgcgtattacattttataaggttaaatctcttcttgatttataactacggagtaaacaacaacagtgttatacaacaccctgcatgaatatggtagccgttaatgatcatatatagatatatttttctatccttaataaatgtactgcttagatttaaattattccaactatctaccgatcttagaaggttcgagggcatattttcttgtgttgtgtcgccgattgcgtggatgaaattagtattcaaaaactgtacaatttatactgcagaaggacgtctggactgaggaggacgacaggatgctgatcgaagcacacaagacttatgggaaccgttggtcagtaatcgcaagatgcctccctggccggtcggagaatgctgtcaagaaccattggaacgcgactaagcggagcctgaagtcgaagcgtcggatgaagaagaagagcgtgcaagtggtgaattcaccgccggggcagctctccccccttgaagagtacatccgcagccagtacccgtcggccgttgagaccacaccgccgccaccggccgtgcctgcaccgccttccgacgtcattgtgcacggtgccggatcggtcagcgcaggtccaaccgttgccacacaggagcccaccggcaccaacccatcggaaatggggatctaccttggcctgggtaacccggctggaccgaccacccagcagctagcggcgatgaacctgaacatgtcactggcgccggacctcaacgcctacaacgatcagcgagaggggtactacctcccgttcgtcccgcagggcaacctgcactatgggatgcatgtgccggcaccgccggtgcagcagcagcagcagcaagggattagcgttgatcagggcctgcattcttcttgcctgagcctgtaccacccgttcccgggaacccacccggttagcctggatttcggttgccaatccagcaaccatgccaacgcaggtggctactacagtgaagctggcccaagcagcggcagtggcagcggcgaccctgacgacgtcgacgtcatccagatggcctccaggcagttcctgatgccgtccgaggctgaggtcactctcgacctgaccaggttcaagtgaggttcgcagtgccagtgccaatgccatatcaccgctcggttaataaatttatcttttgttttagcagctcctgttacctttctccaagtacaatgcatacctgactgtatgactgcagtgcgcgtttaagcttttcttgtatttctgtttggtacattcggtgatcattcgagctttgcattgtccatgtggtgtactggtgtgggaactttaacttgttgtactagtaccttttatgcatggatcaatgtgtggatttcatagttttccccctaaaattagtactcctattcctcgaaaagatgcttttaattttgtagtttactactgttgaggtattggagcgtggaaagtggtagcacctggtacgtctactccatgtactacagtctttgcttgcttccgcggatggtgcgcagctatctgggctttaaatgttggctcgcagacaaaaagagcgcaagagtttgacgtgcagcaaagctgttcagttcctctccccgaaccactcaaacggctgcctgcgcgcgtgatgcgccagccaaggatgcatgcattgcatgcagctagctgcctcggcgtacttcactgctggaagtagcccgggaataaaggcgaataattgtagtaccttaattaactattattactactctgctactggagttaagttgtaacatttgtcgtattaacttcaagtgccaaatgtgtcattcagcatctttcacaccaatacaccatggtagtaaccagtaggcagtagccagccactccatagtccatgacaccgtctgattccgaactctgactgatatgacagatttttcctgagttcagtgcaatgtcctatgtgggaggcccaaaccacgtggggacggcccaatccttgccggaaagttggtttcacgggaaacgggcctcctgaatcggccctaaatgtatcttaactgggccgaagcccgatcctttagatcagatgcttcaatttcgaaacaagttcattctagatacctcaatttgtcgccaaatatgatccttagtcttgaaaaccggatacaacacatccttcaacttatcaaaccgtgcaatcgaggtccctcgatagtatttatctccggttttgactgacgtggtgcctatgtggatcgtttgaccaggtcttcgtccgacgtgcgctggcgtggcgcttacgtggcaatgtgatccaaatataataataaaaccatggggcccacatgtcagtttcacacaaaataataaaatatagtggatcccatgtgaccccacatatcatctctatcctctctgtttctccctacttatctgtttctcccttcttcggccggcagagcaggggcggtggtgccgttgtggtcggagcaagccggcggcaagaaggccccctctccctccttgcccaacgatgacgactacgagagccgcgcaccgccacctcatcaggagatgacgaggatggagatgagatagcggagagggaggatgcggggaggccgacgagtgtggcggagaggcctcccggcgctcaccgccaagctcaaggccgtcggcgccgccgtcgcgctcgagtaatcccgagcagaagaaggggttcgcccttttttttggttcctattcattatccttagatcgaagatgctacgcttgtggatgccttgatttgtttggattgaaattagatgcaattggggcaactgagctgggatgaaggtcttgattgcattgttgtagcttgcctagttactgatttatcatgttgcctagttaccgccttctgcagcagcgccgaggctggacagcatgcatccgcgcgccatgctaagcgccggcggcaagagcgggtttctcgtggcggccatcggagagaagggcgatgatcgacaggaaggagctaggcgacctcgtgtcccctcccgacatccttcctccctcctcgagctccttggcctaccagcgagcgcgcgtaagagagagatgtcttgtggccgctcttctctatctggggcccattcccagcgtaagggagacgaagagaggggagaggaggaagaagatgaggggtgagtagactagcatgtggggtccatgtggtccccatcattttttattagtttgtgtgtgaaactggcatgtgagtcccattggttttattattttttcggatcaaactgccacgtaagtgtcacgtcaacgccactttagatgaagaccgagtcaaactagccacgtcagccaaaaccgctgtaaaccaccgagggatctcatttgcaccggttttgatagttgaggatctgttatatctggttttctggttgaaggatgaaaatcggattcattgacaagttaagggacttcagatgaacttattccttcaatttcgtcggcatcgtgagtcatgatgttgctgttggacatgctggcatgtaggcccaataaattaggccttaccgtcagaaatggcccatatgcccttttgatctcctttccttcgtactaggcctttttggttcatcaaagatggcagggagatttctaaaagtaatactatatgacagagggatgaaaggtgcttcgttctacacacgtagatacgtttaaggttggcgacgacgcttgcggagagtttttgggagtaccttgaaatgaatgggcgcatgttgatggtgtgtttgcaagtgtgccttttatgcagtaattgagaaaagaaaaggttataatcctttgaatgttgatatagtgttttgctttttcttttttttttacgaccactacatgaatagacaactcatgttgtatttgtatgcccatttgcatgctgatggtgttcatctccctttccggctagtgcaatccgaggaattatacccagctgcgcagatacaatggatttgcgtgcaatcgcccactggtttagccatttgggtcgtcctaccgaggaactcagactgcctctgactgggaggcatgtgctggtgacgcggtctcgacgaatacatgttgcccagtgcacctgccgggatgatctggacaaaatggtggtctagctagttcatatctagttggacttggaccggttctttgaacgtaaggaacggcgaaattgtgtctaacacgtctagattctagaagcagcctacttaatttgaaccttccttaacccttcctgtagtagttggcatgttagtcagttagataagctgtaaaaatgcggttgtatagcttcagtacaatgatctttggctgaatgctgtttttttcctctatggtctaccttatcggttttgtgatgtccggattagtcgctggaatttcttcctttttttttctctgttgatgagggggtaattgattgttcttccaaatctgtcatgtgcaagtattacataaacagctcggtcgttacttttagttgcatactctaactcatgtccatatataccaagtccgctcaaatcttctattaggacatggtcagcttaagtctcaaaagatggcctgagccacatcctcttgatttgattcatcaccaggattacatttatagagcattgctgtaactaggtatataaacatatataaaaaatactactatctgattaggaaataatttttcctttgaaacaattcgtagtacatcaaacattatcaatatcggacacataatccattgaaacatatttacagagcattatatacatcatcagtactctaattgaaatatatgatcctagatcattttcccgttaccatctagtaatcaaatctaaaccaaaatgtctcccaataaaacatttactcgaactgaaagatgaacgcgaccactaccctacagaaataaatcataaatgtattaaatgtatcatcaaccttgaaagactgcaaaattcagggtccggcggcatccatccgccactatttccgccgctcagcttcgcctggacgaagcagagtcaccgtcaccggccatccgccgtacccagtagtcggccaagaacgtcttggcggcgtcgaggctggggaagtagggcggctcgaggaacatctgcgccagggggtccatctcctccgccggcgagaacagcgcgcggttggtcgacgactccgcggtgcccatcaccgccgccacgagctgccggtacgcgaagaagaacctcctcaccgccgcctccacgggctggaacgcctgcagcagctccaccttgccggcctcctcgccctcgccgcgccgccggctgtggaacagcctcatggctgcctcctgcaccctcggcccgccgttggggtccacctcgacgccaagcacacatggcacacgcttcttgaggtccctcgtggcgttagcgacgtgcagcagcgccctggagcggaagcaggaggacgcgtcggagcccggtgccgcccgtattgcgagctggctcttgagccgcaggaagtcgtccgggtccatcagcaggtgcaggtcctcgacgtcggcgagcagcttccagacgcgttccaggatccagcagtcgctcgccgcggcctcccagtttcttgcttcgatccggttgtttaggcgggtgagaagctgtgaggccgcgcacagccaggactcgagtatctggtggatagtgaacagcgcctcgttctccttgttgcggtagccggtcttgggctccggcgcgatcttcgccttgagggcgtgcagctcgtgcggcctcacgacgcggtcgtactcgagcaccggcttgccggcgaggttgggctcgccgaggccgagggtgaacacgcagccctgcatctggctctcgatggcgtacttgatcctggccgccacggtctcggacttgtcccaagcggcgagccgcgggagcaggctggcctcgctgacctggcacaccaccgcggcggcgctaccgggaatcttccacacctcagacgcgctccgctcccgcgggagcacgcctttggacgcgctcagctcggccagcggcgggcactgctcgccctcgcagagcgcggccaccagctccacctcccttgccgcgagcgcctccagccgccgcgcgagctcgcggcggctggcgtagccccgcgggtcggagagcgcgacggagatgaagcggaaggtgatctccagcgcctgcagcgccggcttgacgaggccctcgtcggcccactccggacagcacctatccttccacagccttgcgagctccggaagccgcaggtactgctcgtactcctcgaccgccgtatcgtcctgcaccctcagaggcgcagccaccgcccccgacgacgacgaggaggacgcgcgctgcttatcttccggccgcaccggcgatacaggggacagcttgggcgttgccatctccgcgctccagttgagttgaactctccctcgatatgatcagcgtctagtttgaattttccaactgtatactccctccagttatcgatcgctaatcctcgcttgtctttgagtttggcctcgagaattagcagatgagtcgtctttatatactgctgcgctaggtggaagtggagtattacagctgtacaaggggagcgtgccagcatggcgtgtgggccacgctgctgcagcgtgattcgaaattcaattttggaaaccgcgggtgggccgggccctgtgcctgtggctggcgttcgcagagaaaggcaataaataatcgtgcaaagtgagaaaagaaagagatcttgagcttatccggatgaaggagaggtgacctctagttgtgtgaactgtgaacggcggatgcgctcgtggcctcgtgatgtccaggtcgtcgtgaatcgcgatgttctcttgcgttggggcagctcacgccgacgttgtattcgatgtaatgcttaacgcggacatctctatccgttgcgcacttgcgttgcccaccctaggtaggccggcacgaacgaggttcgctgaatggataaacggcgtctctgtttctctcgctagtctcgtaaaagaatactatcaaatgaaaacttcgttcgcttgccctactttgcttgtggtttatacttgtggatgattctatattggaatactagttcccgaagcgaacggcgcagcatgtatgatgattttgggtcggcaatatcgtcaatgaacgacgtcgtagctctgttattttcctatatgttattccatatcgtgagcgtacgtaactttcatcgaaaggcttttgcagtttcgccccgcccggctttcggtagtgatagatatctaggataggcagttgacctcaactgagttttccctcttcggtttatttagcaccaaacgttcttgtcaaccaattttgtaatatgtagtgagcgtttaaagttgtctttctgagctttctccttatcttctcgggttgttgagcacgtaagaatacaaatacaaccaatctagactgcatgctatggccttctttacactatactcaaaacgactgtgtgataccacttatagacggggtcgacagttctaaaccataaattaagcacggtcggtggaaataatcccatatgcactacacaattactacttcacttactgtgaactttcggttatactgacgcctaagtatctctctcctaattatctcagcaaaaaagttgtcttgtcgtaacgcactaaaccaagcccaagtaggcagcagctcgtgtagtcgtgtgtctattggctagtgcgaaacaaccggatcaatttcagtagggcgtcgcaatgcaatgctgatacgacgtgcacctagcccatcacccacgctcaaattccaccgtcacccacgctcaaattccaccagcgggtcgatcgccgccgcgaccgaaaattcagcggtcgtggcgtggatttgccggacgaccgcccgcccggccgtccgcgagcgctgccgaactttgacggcgtacgcgccgagacaccgcgcggccctgctccccagcctcctactagtcagaaccggcagtagccgaagcaaccaagaaggttgggtggatatgcgtaatgcgttgatttgggagggaagcgccgtgttttgccatgtgtcgccttgctattcgcggtgcttatcgctcgagtggattttcatattggttgacctagtatattccacgacgacctgtgctgtttagttagtggcgtaaattaattcaattttggaggattggtattttcgcgataagtacgaatgcgtttttttttttaagttgaccggaggaatgggaggttgagaataggtttttgtgcatatccaggagagatggagatcgatacaggctagctggggacgggttgaggctttttagctgaagaagacgtgctcgtacgcgagatgaaaagcatgtaaggtcggcagattacctgcctaagttaccctgtgcgacagagcatatgacgtgcaccgactgattttgttcagttacgcaacgtttcagtatacataactgtgcatgcgagttcaaatgattacctcaaacgtatagagacatcatatggtatttgttttcaagggattagtttactcaatgaaggaaacgggcatgcgaaaaattcagatcggtttctctctgactccgagagtactcgcctctcaacccatgaaccgcgaacagccgctacaactgcattgtggataacattgacccctctttataccgagggtggtgcatgatcccaactggcaacgagcgtgctcgtgcatgtgcatgaacccgccattaaaacccgtcacggtcgtttcgtcgagggccataattcgtgcatcaacggctgggctccggcgcgtgagtcgtgacgtctgggaagggaggccgggtccatgccgatacggggccaagattatggccaccaataacatctcatcatgatttccggataagagcttacgaaggtagtagtagctgaccagccggcctccgacgcctcccttccttgccgcctgcgcgctagtacgaataacgaatggacaaggacgaccggccggtaaacgtccacgacccgatccgagtatctgaccaatccgtcaccaggattagctcgttaagtttctaggcggacaagactttcacgcaaacgcacgtccgtcgctgtcgtgaaaaagagctctcgatctcccaagaaaaccgatccgatcgcggccccggtgtcccgtacgtcgatcactcgatcaccgatcgagggcgacgtgtctaggctgaggggagacagggacgccccgccacgagcgaggaggcgcgcgcctcgccggttaacccgctgttgccggacgcgacgcacgccggcacacgcgggtgacagctagcggttggcgagcgttctcacgagtttaccccggtccgcgactccgagggtgcgtgctgtgcatgagccgatgcgcgtcggctgcacagcgcagcgtagtggtgcggtgtgaccgactggcgtacttgtgctggcgacggcggcaactggggttgggattggattgcgccggtgcaaacgcgacattcgttttctccgttccgtcccctagccgacgcgccttctcgtgatgcgggatctgggtcggacgaaggaaagaaggctaacgacagaagttcggcggtgtgtgtgtggggcacaagggctttcagttttcggcgttccagataaggggaggcctcgtcgcacatggcgtgccgcacgggccgcggcgcactacgggattagacgaggcccatcatgtgcgatgcccagctcggccatatgctgcgagggggcatcggtcatcggtgcgcgccggctgagatgaccaagccgacgagctggcaaccgtttcaccgtacatggcagctcatgatcttatctggtttgatttgaagactagtccaattcgcacggtactgtattgcgtagggtactatgaaaatcattggtttatgcttccaagcagacattacgtcgagtatctacccttagtttcagacatcactgaagccatttttactacaccaaggttcacaatttcgtttagggtcaaaatacaagcccattgatatgaagaatttcgataaaggattttataaaaccaagtggttccgggagcttcgaattacggaagaaattcaaatagaattgtgcaccctagctcaagctaaaaagtcaggtttgagcctagtcccaacctaaaagaccaagccgaagctaagtccaaacacctttttttttaataagttcactttgagtcccttaactagtgatcaaatctaattcgtatccttaaaccacaatatcttgacctccaactattaaaaccggtgtaacttgactccctcgacgattttggagggtggtttcgctgacgtggtgttgacatgatcttcgtcctacgtggtgttgacatgacgcttatgtggtcaccacatggcgctacgtatgacgaggaccaagtcaacaccgccatatagtcgccacgtcagtaaaaggtgattacctttgatgttgtatgccacatgctcacgtgactaaggcgttgtgtttgcacctaaatgacaaagtttgggacgtgcaatacaccctgcctctaaacatttttctaagaactttttttttctaaacctgtttatataggttggaagcatctaagattaatttaaacatcgagatttctaagtccaaacaaatagtcatgaaaatgtttgaaaatatttttgagctttagtaatagtgtcatcgttggcttaaaaaaatacaactcaaaaatcaacatgaaaagaagatacaaagagtaaaaaatctactaagcagtaaaatggatcatattttatagtttactggtaatgaggaaaaaacagtttataaatagataatttctcaaatcaaatagttcaagagagtaaaattaactattatttccttctatgaataactagcaaaactgcccgtgcattgccacggaaagaaaaaaaagagaaaattgaattacaacatattaaattataattaaatgaaatacaaattttctggaatattttgggtattttttaagtaggtaggtatataattaaattaatttacaagtaaaataagtgtgagaaataaaatgatatggttggatttaattttcattaaattctccatattaattacactttttgaaattttcttggaatttactgagcttaattgctaattttgataatacaaacatcatttaagcatttatttaaataaaaatcattctttctctatgagccattttcagcctatttttttcttcagcctgcaagcgaccaaagtctacataatatccccacactcctcacttgccgtgcgggccgtaaccaaaaatgtgttggaccatcggcccacgtgtggcccaaatggtgcggtccggtgatgtaggccagcccaacgctcgatcaatccgagccgtttgttttgatggatggctcagatcagttccaatcaatcaaaaccctaaccctaaccctccctctccccctccccgatcggttcagccatcccccatccccccttccaccggccggccggcttcccggacgacgcggactctcccccttccctcaccggggccgactcttccttcaccccttcagcggggccgctttccttcccttccttcttcactccgggggggccactccctcttcccctttccctcctgtctcgctgggaaggcgcggcgacagcggggtacggcggtgataacgcacggtgacactcgggcctgcccctctccctttccctctcctcattgcctcaatgcccggcccttcctctcggggatgacgccttctgcaccctcaaaattcggcgacgtcgaccgggacgactatgttcgcagcctccgcgggtggatctgtcggtggtggcggctaccgcttgcggatctggcagcgacagctccctccgtcgcctcttttctttctctggcgacggtggcggcgtcggcggtggtcgtggatgaatccggcagtagtggcgacggccgaggggatccgaccacaccccgtggtcggattcggtggcgacgacggcgttggtggcttctcggtgatgtttttatttttcttccctttttttttctcaatcgcttgttgtccgattgaattttgtaagaattttttttttgctttttttttgccttattatgatgcaaccggatttgattttttttcaccttttttttttttttgccctttttcacggacggacgacggaaacaccttttaatttttagacgatggaaacaccttttaattttttaaatagtagagatgtagttgacagagttgccaggcctataaaaacacgattccaactggcccaacggtcttccctagccaactggcccacggcccacggcccactagcagcacatctgatgctcatctttgtaacctaggtcacatagccaacttgacagttgacactcgggcccgcgagcccccgactcgcccgccgccggccgccaggccgatgtccgacgacgctccagcctcctgcgctcctcacctcctgttcgtgcttgcttgacgtcgacgctggcctggcctcgctcggtcctgaccgagcctcgaggagacgtcgccgccgaccgccggggctgacctctcctccgattgcccgacgcccgctccagcgctcctactccatctccggcctccgactcccagccacaggggcgcaggcggctgatccccaggctgctatccgcggcggcggcggcgcgtgcggcacaactcgccatttcgaagggagtagccgctctttgatgagcgggcgaatgggtacaggtatgaacccgtacactgtaaccgtctcactgagaggagggagcgcatcgtctgccgtcgtaactataacggcacggtcatgccgttggcaaatcctgatcgttccttttctttggacgattaggatttagaaggatccaaataccaggcctgcaagttcattcaagcccactaaccaatcggctggtgcggcaatataggcgccgcaaccttctgacgcgagagaagtcccgatgcttttttttatcgatttcactttccccatcttcatctctcacctctgtctctctctccacgcatctctcaatcactgcaaagcaggagcgccgattcagtggcttcaaccataaatttttgctgccaataacagcaataagctccctgatattacccaggtttgcttcccatcatttttgtcaattaatttggctcctgttgctagcagcaatcagtcctggaagcattggcaacagtacgcagctatggttgctgtaatcagagaagtcaagcacgcatgcatgagcagaaaatggaagagacgaagctagagggtttgggactgattccagaatcatcggccaattcaatttcagtagcttgtgctttagaaatcttccgttgtgaagacattagatgacttgtctctggtagttggagcatgtggttgtgttcaatagataaatcatgcaaggtgtaaagaccagaatccctatctaaggtaattcccattcgggcatcacaacctgttcttgtctcagctcggggaagttttgtcaagtgatctctcttgtcctgtgctcggtagccctgattggaacatacaaatctacatgatgtaactaccttgtcaattttacttgtgttctcatacttcttcctagcattgaatcctacttgacctccatagaatacccaaaagttccaagcctcatcagcacaactaaaattcatgcctattcgaggtatccaagaaggtgtgttatttgtgctgcaaaacatggcatcgcttcttattttaccaaacatgattaatgtaagatatgaaatgaaatggtcggactggatttagatggtacatatggaactatgaatcagatcctgatatggcactcacaagtttgatgactcagaaggagcaggtttttcttgcagcgattgctttcgtactagcgtctgatctccctcaatctcattgcttcaatcaattgtaatattgttttaatcataggagaactaattatatgtattacagatgaagatgataatatgacttacttatttggagtctctgttgttgttggggtacctcgatcttcagaattatccagtgaagacatttctttaactcagatcttgcttgcatatactttggcctcttgaaactctcgatcaagagatggcatcagaccctttggagagaaaggtgaaaactgatttctataggtttctatcctctaaaatgaatgggtgaaattggcgccaagttatctgcttgccgcgcgccatttctctcgcgtcagaaggttgcaacgcctatattgccacaccagccgattggttagtgggctgaaatggacttgcaggcctggtatttggatccttctaaatcctaatcgtccaaagaaaaggaacgatcaggatttgccaacggcatggccgtgccgttatagttacgacggcagacgtgccgttatagttacgacggcagacgatgcgcttccgggggacccatacccgcgaagcattaagcggtccccaaaattttcaacgcgccctttcacactttcgtgtcgttcccgcgcgagggtgggaaaccctttggcgggcttggctctcgcgccactctccaccaccgcgccctttttcttgtcgcccacctctcgccccatcccccacaaacaattcctccccaatttccctcccaaatctctcccgcctccgatcccacagtctctctctctctctctctctctctctctcgatgccgacgcttcgcagcgccacagcgagcgcgtcaacggcgggcacggcctcgccgacggcaatcgccaccccacgaagcgccaagcggcgcctcacgagccctcgccgagccgcagggtcacccgacgcgtctcagttcacatccccccacaaatcccccaatgtcggaatcgtaagtcccccacctcccctcgatctctagtgcaggactatgcagatgctggcgtgctgctgctgctgctgcatattacctggtattctgttgcaatgaggagcaattgctcgatcttgcaggttggcaccccgaagctgctctcggcgtcgcccaggtcatctaggaagcggctttacggcgacttcgtcgcggccgagaagcccaagtggaatcctcgaggcaagtctccagaatcccatttcagtagggctcagagttctgattgggatctgacgaaagaattcatctgttctgcagatcccgctcagatgcaggtggtcaaggaggcgcttcacgtggctacggtgccctcttgcggattggtctgccgagatgatgagcagagtcgcgtgcttgagttctgcaagggttgcgtggagcaggagcgttcagggagcctgtatgtgtgcgggtgccctggtacagggaagaccttgtcgattaacaaggttaaggagagcgtggcgcgttgggcagacgaggtaaattcaatttctcatggttctgtaagattcctgaaataggagtgtgtagttgttgatatggttgtttgtcctcgtagaccggaatggagacacctgatgccttatcgatcaattgtacaagcctagcaaagacgcatgaaatttttagtaaggtatttactgttgcctaattattgactcgatatatctatgcaatgctgacaggcactgacaagttcttgatgcagatacttgcgaagtttcagactcggaagaaggcaacctgcaaactgtcaccacttcagcaacttcaaaccatgttttcccacaaggaatcagccccaagaaggatgttgtaaggactgcttgagcccagtacccatcctcacaacctggcctttttcgtgccatttagttcctggcatcacaattttcatattactgctcctctgtaggttggtcgttgtggatgagatggactacttaataacaagagaccgggctgtgctacatgatcttttcatgcttacgacttaccaattctcaagatgcatactgataggttagatgtcaaaggatgcttcttgtacttttgtaattatgttaatatcaaaatactgttttgccaatcgacaattggtgctattttttcaggtattgcaaatgctatagacctagcggatcggtttcttccaaagcttgagtccttaaattgtaagcatttaccaaatactagcaagaaaagtgttaacataaattgtatgaaagaaattaacatgtctttggcattataacactaatttacaggcaaaccacttgttgtgactttccgtgcttattccaaggatcaaatatctgacataattaagcataggctgaaggtaattcgtttatcatgtgaccaactgtggctcgtgcacatctgtgttcaattacttgacttaaataggttgcttaccttttgtgatactacacataggttctcgagtatgatgtttttgaaccactggcccttgaattttgtgctagggtaagtccaattactacccaagtactcatttgtagctagttcattttgaaatatgtcagttcacaaggcagcataggtattttttttgttaaggagaacatcatggtgcagttagcatgaaattgacgtgttcacttattaacaatgtttgcttaatattcttataccagaaagtcgctgcagcctctggagacatgagaaaagctcttggtgtttgcaggtaacccacttctcttgcagtgacaactattacgtttttgcactaacatgttgttccatcataaggtaagccagtccataacttaatttttatttattccaggagcgctgtagaggtttttgaagcaaggttacaagagtcttctgatcaagaatttggacttgtaagtcatgccgtcttttgatagcttttttttttcttttgagggaaatcatcttttgataggtaacatgtataaccaacaaagtggttcctgtaaaggaaatcacctttgttcatgtctacattgatgtaagtcaagttcacagtagttgcttcaactgtaaagcttccttgcggttgggtccatctgtgtctctttgcctgacttcttctggccggtagtcggtagaccactagaacatgattctagtgtagtacttaccaccaaacagaaatttgtatgtgcatgactgttgtactactaaacaagcgattgacagtgtatttcatgcttttagttgcctggatctaacgctggtcgccaaaataaatttatcttttgtttggatgatgaaacattgccacattgtatttctttcacaagatcagtaatttactttcctgttccagtgtcctgttgtctaatataagtattacaggtgacatttgaccacatggacattgctttgtcaaaggctttcaagtcacctgtagtagatagcattctctgtcttccccaacatcagcaggtaaattcagatttaccatctcctgttcccctcgattctttttccaaatttgctgtattcattttcctcgaatgacattccgcagatggtattgtgtgcattggcaaatacttttcatcattgcaagaaaaaggcaacgactctaggagaggtaatattcaatatttattcacagacattctgatagatcacgctcgttagccacatgttgtaatattctaaccaatctattttaatgcccttttgcagctcaataaatcatacatagaaatttgtagatcaacccaagtcccagcagttggaatgcttgaattttcaaacatgtgcatggttttgagtgatcaggtatgcaaacatgaagtaaggccaatccaaagaaatggaaagaaattcaaaacatatcaagtatttatggaatttacattgtagggattcatgaagcttgggcaatccaaagaagataagctcaggagagtgatgcttcaaattgacagttcagatatcacttttgcatttaaggtatggataaagtggttctgactattgtaaattcttcgcatcattgtatgttttgtttccagatgtactcattagcctaattcatactacagggtaaccggttctttcagaaatgtttggagcaccaaaaattttagttagtcactcaattcagcaacgacgtctatacacagtttgcattgtatcttataccaagggccagcaaatcaaaagcaataatgcccaaaagttcaggtgaaattctatctctattactgtaccagtcactttcatactgcagcatgttatacaaaaaaacatttcatactgtaccagtcactttctcaagcatcgagactactacaactttatgaactatacttagatctttttccttgtttcaggattttgcattctattggatcaaaccaacgtaaattttgaccccgtcctcaatgtttatcaatatttatgatttatggcgaaaccctttgctgagaaaactgtacatgcgggatgagttatgattgtttttcttacagttcttctgaaagattcctaactgtatttgtaattctaaaaggtagttgattgtagttctgatttttccccctagtcttattttccttcaacacagtctacattgattatgatttaatccattgacataaaagataatttatgacggttgagatctgtaatgcagacctctctctctctctctctcttttactttaccaaaggttatgtataatttcactttatttataatcaagctacaaggctcgaagcactttatttgttctgtatgcagttttatctcagacctggaaaaaataattctgttacttaggctggctatataaatgggcctggaagtgctattgacaattgggcttctgtgggctctttcttgggcacattttcttctctccttttccctgcaaaaactataggttggcttacctgggcaaggaggttgcaaggatatgcacacatttgtatcggaccgagttaaaatgcacctatgtttttcttcgacagtgacggatcgagtagatactagccaagtacccatgtgttgcaacatattattaaaaataaattatgttgtgcatgtcatttaaaattcaatataactctaaaaagttgagttttttttcatcgagatgaaataaagcaatagatgacacctcgtgtgttgtttctgagcaactataaacattaaaaattggatttcgttgctatttcagaaggaaattatgtcatgctaataatagtaataagcaaatgcaatctaaatagtagcttaggtttgatggcggtttagaaacattatcaaatagacaaatagaagaacaacactgcaacagaaagacaatgttgttcagggcctaatactacaaagacaaggctgatatttgataggctcctcaatcagctaaaacaattctcttgatgtggctaagcgtgagtattaatctatactccattatatatataagatagacccattatattctaaagcttataatataaactcacatgatcattaactagcaattattgtattttaaagtttatacacataacaagtcatagatgctgtgttagtatgtgttaacgaccaaatttggtaatatcattatcggaaacggagattagatcaaggtggagtcgaaggcggagattgatctgagaacagagcaagaatcggctgaaatccagatcggctacgattaggatcggctgggtctgagtcggactaggtgagctgatgcagccgattctgacagtataatctggtgtatgacattgggttgaattgaggtgcttcaagatgattgccgcatatggatagagtcatgagaaggcaattgtatctattaattaggatgttttatgtaacttccttagagatatgtttgggcaaaagtctgccgcaatgacttatggtatcttagagtttgttagagatagtggtcgtgttcggtatagacatatcttgtaattctcgggtataaatagaccccgagccctatgtaatttttaacatacacgttcaatacaatttcggcgcatcgccacctttttgctttagttttacttcgacgagtttttgctttcgggttgagctgcatcggtttcgatcttcaacaagaggtaaaacttgttatgacggcttgtgttctcgggattagtgcttccatctttatgacactaatcttgtctgtataattcgtcaagttattatatatcttatataatctttggcaatatcgtcatctaacctacaatcggttaacatctgttgatagaaggcagccgattaggttaaatagcgacgttgtcttagattatataagatatctaccactttataaaacatccagcggcttgattgtctagatattgctcttcttttcatacttaatgctgcatcagttgagtttgatctattaagtcgtgcttagaatatcaatctctagcctgtactctggttgccgattagggtagtatcggagtttcagccgatcttatttgatttaaccatattcgatctatatgcttcaatgacatgttaaatccgtcctttgtgtcaagatatcgtcgcaatctaaatatattaagcttctgtttaatacattatacctgttttaatatcttgatatagagtagtatcggagtattagccgatacacgctagatctatctgatcggctatgctataaacatatataatcctgttattaatatatatttcgatctaagtgatttatactgtcttggcatggtgaccgatctatcccaatcacttgatttaagtatatattaatataagaactatatatcattaatatctacagccgatcgaatagatttagttccttaccacctatttataaccgccgatcgattcatatatgacatcggctcaaagataaatgatatgtcatcggtacctagccgatcggctatcatttatagatttaaccacgaattctgtctctatttcttgttgattacatgatcaaatcaactggcacgctcatacattcgaaggcgagctttggacctgcactggagttaagcagatctcccaggcatcgtgttttctatcaacagtatgttatagggctcaacatataagcatattaaatcatcaggtctgttcagattgtaaccaaaataaaccttaccaaaatttggcattcttatgtatttaccaaatttggcaacaaactaaatgtagacatttttatttaactttgtaaaaaaaagggtatggttgaaaatattatcaatctgaacagccccatcatttcataatattttaacatatatttatctatcatttttatgatatttatcatacatttattcattcgtgtatttatagcaaaacatattataccatctggtaaatacaactgtgaaatattatcagtggatagtaacacgtatgtagaagtacttaagatcacgcccccgtacgtttgatgtgggatgttagtgcttgcaagattaccgtacatgaaactaacaaaacaattaatccaatagccaaaacaacacaagcatacaaggatgtcaaagttgggtgaataggtggtgaacagattgtgtagctgatgccttatttattgctataaccccaattcttaccatattaatgaagaaaaaattataaagaaataaatatcattggagtatattcgcccatgatctatagctgttcgtagctttgccagagcccttgtagtggagacgtcagcaccggcgctgtctacaggccaacgatgacgtactgtgatagaacggtggtggggtgagaactagagaagaggacagagctggcgaatgtcgaccgggctatacgtgatgtgtgcaagtttgggtttttgtgatcgattttacctggacattgacgatgtagatgtaggcatccaagggacgggtgagttttggacaatgctgtactatatacgacaatgttatagtacgatcgcaattacagttgatgggctattacaagagtaggatggcatggccccccctcctctcctcacaagacgaatcactgtaccaaactcagtcagcaagagttcttccacagatttttttttctagaaaatgtcccaatgaatttcagagagaaatttgcatatatgagtaaaaaaattgtttcactagaataccatcacttagttttgataaaatatcatggtcaaacagaggttgtttgctagaataccaacgtggacgacattatctttggatcttcttcatcctccctataacataggagtgaaaacgggtcgagttcggtcggatctcacccttcccatatcctaacccacattttataatcggaatcgattcagacacggatagtgctgagtacagatacaaactcggataatgtcgggcaaaaatacggaacgaatacgtaccaaaatggatatgtacactatcggttatgaatatttattcagatatcaagttgaagcaacaatcttatatatcacatagacaataaccattcaataatttcatatatccacgatacgattatattatgccattaggaccttaggaaataaatagggtgcaatacctcacaattgaaaatcattttatatatgacatacagttgagaatattaggtcattaagcacaatatatctcacagttgagtcacaatatcagtatatcatcccatacaagctatcagtaggcatcattcaggaccacaggggcatagactaataaacatcatttaagttatcaccaattcatcataacaatagtacctcatagtagaaccaatacatagtaccaaaaggtgccttgcaaaaacataatacgggtagtatccgtatatttatccgggtaataccaggattttttttaccggataattcgtatccgtcagatactacgttcccgaacccaatcctatatccgccaaaaagacccgtactcggatccgatgtccctgaaaagtctcgggtacccgaatttgtcccgaaataatgtggccggacgggcgacgagaaataccgccccgttttcacccttactataacatcggaagatcctagctctggcctttggccatgctcactccaggccatggcggtgccaagggcctcagagagctactcttggacgaggggcggggtggtctcccatttccctgtgcctggaggaccatacttccctccggtcatccctacatagttagaggtcgggatgtggttggcaccgtcaccgttcgggcctccggggagaacttagccaatggcggcggagcacaaacctggggagcacttgggggactcgatgctctactcagtgacacaggcacacagcgtgcgatgcgtcgggagagagcaactgcgtaaaccattttacaagggtgtcaagcgtctccgatgccacctccattctcgccaccatgatgatctggtaaaaaaggtggctagggttcaggagtaggcgatctgtttggtggaatggaggagatcgggaggaggaagtagggtttttgaaatttctcgtggtccaagaatcagtgtgcgcagtggcgagcagttaacggcggcgatggagcatggtgacctctgacgagctcttccgctattcatacaaacgcgagaagtacgcaaggcaaggagaacaacatgaacacgacctagaagaacacgagctatgggctagcaagatcgagtgtcgctgccgtcgacgcaaccagagcatgatgcggccggtggtggcctcttctagcgttggagagaggaagaagaatatttaagggtaattccgttcacgaagcaaacaaccacctgtttaattgtggcatttctggcgaagcctatttaaatgatggcattctaatgaagctaggttttttaagtggcacatgcaaaattctcaaatttcataacacaaaacaatacttcctccgtccaagatcaagaatataagtactattgatgctgaatcacgccgccacaccttgagcacgttatgtgcaaactacagcagcacccagagacgcgctgccacgagaaggaagatgatgccgaacgagcactccgagggacccagtcagggtgaacacgtatcgatttgtcctagactcggtaggccaattagggcatcctctaacactatagcaagaaggagattaaaatagacttgggataggtaacaagaaggagagagaaatataatatagaggataaggataatagattgatttagaatataaaggatatgatatgtacatctaaagtttttattaggagattaaaattgaggtacggatggttgtaatggcttggaatgagcaagtacattgagaagtcttcgtattttagaacaagctttgaacttagatgtgcttatattaaggttagagatggttgtaattacttgagatgagcatgtagattgagaagtcctcgtattatatgtgctttatattcttgggcggaaagaaattatggaaaacccataaaagtagcataaaactttagtattgtaaccgatgacacataatccatatattattgctgtatagttttacaagaccccattgaagatgatttttttaaaaaaaaattcaaaatataagacaagtatattttttaaattattaattacttgattaaggctattagttttagtcttcactattaaaaaaaatattgtaccagatgtgttggaattaattgggatttactaagggtgaaggttttatgaaaaagataagccataaaacctatgattatgtcatataatataagtcataacaatcggtgtctttaacttaggtcataaaatatattacctccgttctaaattttagatatattataagatatacttactctgttctaaaataaattaacctcgtacatgatgcgatatacgagtttatatctcgtatgagattaatttattttgggaccgacggactagatattagtgtgaaatttgcacagacgaaaaggaaatactagtagccaatagaagaagccacaggtgcgctagtttaagttgggcgtggatggggaaagcaatagatgcggccagtccatttcatcaggacgcagtgtcgcaagttccaaagaggcccaccaccggattggattggccgagaccatcatcaccgccatgatcaccagctagattcattcatttgattccgcctagtcgagcttgacgtggtacggcgccttcaattggagatgacggccactgtgatcctgattgatccccagctacagaaatacagtatcatatcttaccctctcgcaatacagatcttgaaccccactagagtacatagctggaagaaaaaaaaatgctacgagtagcaaaaactcttcttcacaacgcagcgaagtggatggttgttgcttttccaaaaggacaaagctttgcttttgaaccacccgccttttccaggttttccaaaacttaaaaaaaatgcacggaggcccctgatggcatgatctctcctccttttgcaaaaaaggcccggtgaaaaatatccaaaaaactcaaaggtcaaaatgccacacatttgtttaccgaggctgagtggcgcaccacaccagaacgaacgtttctttaagcaccgtgcgcgttatactacaccgaagaacaaagatcgagagcacagcttagcttattattagtagcaaaccgcgaatgcgatggttcagcagcagaatcggccactatccttgacaaactctcccataatcatgcccgtcatgattggctcgaacgcccgatcacttgtttggcacgttgctacgtacttcgtactagtttttcgagatttgtacgcttgcttcaacgggcacagtggcatggctcccgagttccccatgccagttagtagcggcaatgcatttgcacgcgcagcctcgccgtcgcggcgtatggttggtggcgacctcgcgatcccagcgcccatgcggccagcgcttcttgggcccggcgtggcgtgggcgcggcgcggcgcggctcggctcgcgcgcgcaagcgaagccatcgcggaatagcgcgtccacagcgaaaaccactggattggtgagcgggattcgatgccaccacccacccgatcggcgcgcgaagccgtcggtcgctgttgcgggcggcatgggcgggtggcgcccgcgtgaacggcacgagggaaccgggcgctcccaccacaccacacgaatgtttgtccatgcacgcagcgggcgcatggatgcaggggctctgtcagggaccccatgccacacgtgaaacggatcctcctcctctcctctcctctgaactgtcctggctggctgctgctttcacgtcaggcgccagttgcgtttgagccgctcgatcggaaagctggaaggtgagcccgagctacggtcgggggaaaccttatccaccgatgggccctttatcctgtattaattcgatccttctaatccggcagattttgctctgtttaatcataccgaaactccatccagggcgcttggaatttcgttctcgtcttcgtcttacccgtccatgactcgatcaaatcgcgcctaccgcctagcgactcatgcatggttgggtccagggcaattcagcgtggagagctcatcagcctgcatctgcaagcccggacctatgccatttgatgattagtgctaggttggtgcttgccctttggagccgtgtgcatcatgggcaggtgtcccctaagctgactgacctgatactaccccgtttctctaccggcaccatcattgggtacctggaaaaaggacgctgaaaccctggagtccaaacactcaaaaccacaccatttttttggttcttgcttttggtacactactgctgctagtacgatttctacaacatttcctactcttttgtaattattctcagtccagcacacctgttaggtatagtcatttgcaattagggcagtccacagatgcgtctgagattgtgttcaaacccttgattatactataggtttatccgtgaatagtttgttagtcaaaagattcggggtgtgattattggtctcccttaagatggcatgcctagatcagtccaaagtaccaggactgataataatattagtaggccaaatctagcctaattcttctaattgagaacatgctgaaccttgtctggagtgaaattacttgattaacagtcgttcttcaggagtagttgtagtacatgactaggtcatttcttaactaagaagcgatataacatcccaattagtgagttggagtatatttctgagccgatcatcatggccccagatgtccttgtatcttttggcgaggcgcacttttaagctaaagattgggacttgctctaacagaaaaattgacacatcctcttttggaatcttttcccactggaacggcttaaagactactactggtcttgttggtagatgaagactgaacctgatggctgcaatgaaaagaataagaggaaaacaagcaatatgagtcacgcgtatgaatcattttactgcatcaatcgctgacatcatgacatcgccgaactggtgctactgtgctagtactccaacaaacgggccacaatgtgagtcagataagacggcccagttagtgttgtcaaccgctaagaagaggctcttggtaaaaagagaacaaaaaactggggccacacccattcttgcaccaaaagctcaaaacattctccgttaattttgtgattgaattgacagcggctgttaaatgtcaaaattaggctgctgtcataccaaacaccaagtcccaaagctcctctatacatcggccccgatcactgtcacttcatttggatccccattagctcttgcttcctgggggttggttctcatggcaggatatatctcactctcctcaatcaaatcctgctgctacttggctgtacacaggccatggcatgtatcccccgctcttgacatatactccgtccgtcccaaaataagtatagttttacactatttatctccaacgtttgaccgttcgtcttatgtgaaaattttttatgattattattttatttgttattagatgataaaatatgaatagtactttttgtgtgactattttttaaaaaaaatttataaatttttcaaataagacagacggtcaaacgttggacacggattttcactgctgtacttgttttaagacggaggtagcgtgcgaacagatgatccaagtgtactcgatttgggctacacgctgaattgcgttgcttcacagcttaagagttcagacttcagtgggcataaatattttctcaatcagctgcagggatcagataccttggaggattcgggacgttatatgataaccactattgttatccaggcgtggcagcaggcaaacaaacatccatcagcttttgcaaattattttcttccgtgcaaaaacagtgttttcaacctttccagttttcccacggatgacaacttccacatcaagcgagacgttaataattaggagatcgaactctcttttgttgcgaatatttggagtttttctcgtcgacgatgacccaatattcggcacattcttctaccagtcactaatttcctttcattttcttcattcctcctcttttctccaaaacaaatcgcctcgtggattgataggaaatgcgttttcacgctgcccagttgctaattagggcacgtacaaagatagagtcgtatataagctctacgttatttagagactagcatcctacaacagttagagacaatatggtctctaatcattaatgtatcaaaataacttttcttacttttatttcctttctttcatcaccatgcaacaaaatttgctctagtaaatgctaagagtcgactctgagccgttgtcatgcataacaaccatactcctttctctttcctccatgtcaccaaatttacttgcatggcaataaagagagaccactaataaacaccgttgtacatgcccttagccaatgatgccaacacatgtaacgcacacgtatcagtaaatcttcaccgcgatctgtaaagaaggatgggccgacacacacaccagccagcacggcggccctgccatgatggccgccggattatcgccggcggatacgagaggaggggatcgtggagtggcctatctccccctgctttggtgcgccggtgcaccctaaaacgagcacagccaccggcctgatgcaacctgatgactggccggccgtgcgtccatcgcccggcgccctacctgtggtggagccaacaacgagctagcagctggtttagttttcgtgtgtgggcacgtatcgatctcgtcactttactactactttggcgtagcggtataccctaccagccactattggtgctacccaaagacgacccaggtagtagaaagatttggagtatacaactagaggtggcagtggccagccagggcatgcagtggaggtgacatgttgttgtccggtgagtgcaagcaatgatccatggtctaggccatggcagcatcgggatcccccagaggcagacaagagggggacaggcgatggtagtggccggagctggtggcgtgtatgtacacactcgccattgctgatactatcatggtatgtggccgtcggcattggcattgctgcgccccgatcgaatgcagcttgcaacttgcaaagcatacgtagcgagatcgctaaccacagatgaggcgaggtactgatcgagcagccgagcaggcaagaaggcaggcatgcgtgcattggccatctttgttgctaatgcgtggtggtgtcttctcagtgtgcgccactcactctcgctggctcgctagtgcatcgtgcaatgcgtcgttgtaggtttgtagccggagcggcagcagcgcgtgacatgtttggtttttttgcatgaaacgcgtatcggcttgggccaggtgaggatgagatctaggcggctccagaagccttttttgagggtgcattactgagatactgctgcatggtgcaacggagaaacaaacaaatctgcaccaggattaccagcctttggtgtgaagtcaagtcacccggatcaaagtgatatttggatgggtgtggaggggcactggttcatgtaaaatggtcacctctctggtgtacacggaataattgcatgggtcgattggccatgactttttattcgtgttaaccataccccatatggtttttgtgatgtcgttgtttgtctgtcagatcatgtttattgcgtactactatacagtacatgtcatgctgctgaaagaaacacagaaatatttggtctgatcatctggttcccaaggggaccttttcaagcctaatcgatctccgaaggttggtggagtgtccccataggaaatggttgaaaatacggagaaagttatctcaagcaagtcaagtcatcaaagagagagagagagagatggttatcaaataattagaaataaaataaacgcgttgagaattaaacgcgagaccgtagggttaaaactatacacctcttaacactgcaatatcaaatacatgacacacaatccgtaatatttaggctttattttttaaaacaataggcttcaaaattttcctttggaggtaccaagaaaagaatcctcaactgtttttactgctcttcacatctcaacatctcaggcacggctagtactcccaatccgcctacgtgtgggcgagagagattgtagccagggtttgcaaaaccgccggtaactgcgcggttaccgcgctcgcttaccgtgggatacggtaaaacaaaaaccgcggcaacctccttaaattcaaataaatttaaaaaataatttaaaattttgataaattttgcacggttgcgtacgattttccacggttaccgtgcttattgccggggtgtggtaaccacgtccctggcagttggggaaaccctgattatagcaccagaggaaggccaagcgataacgcacgggagggggagcgagcgatctcgcttagaaggaggcccacttttttctattattttagggatcaattttggtcatctcttggaaacaagtgtatatattttaaatccttaaatcttcattagaaattcttaaatccctctattttaaaatataagat

SEQ ID NO: 15663 - DNA, 3346 bp, Oryza sativa
  unsure (1)..(3346): unsure at all n locations
gaccgtatattggtatactgcatgtgctaattagttccacgctaaaattggaagtttgaagaaaaaaagttagaagtttatgtgtataggaaagttttgatgtgatggaaaagttagaagtttgaagaaaaaagttaggaactaaacaagcacagtagtaatacctattcgccagatagtgtttagttgcaggtctagaatagatcaatgcacaaaaatatacaccggtcattctaatttctcccgcaaaagagacgttacatatgcaaacaagctattgacccgcgtccaaaagtgtaaggacacacctgaattgaaacaccggagagatctatcacatcagtagttgccccccatgtgtgtccggctacggtccgtcggccttgcatcagacaccatagcatgcggccggccgtgtgccggggtgcgactgtgcataccgaaaccgatcgaagatgacttgcgcgcaggggaggctgcgcacggttcaaacttcaaggggtgaactaaggccgccgccccgcgatatggccgtcctctggctggccaaggccgcgtatctcacacgatccgcgaggaccgcagagcagagagttcgtccgcgtccttgtttgatccgtctcgtggcctcagaaaccgcgaagcgcacatagcgcaccacgagcgccgccgcctttgtcgcggtctcgaccggcttgtttaatcctattagttcgttacaactgcatgtgcacgagcacgacaccgatcgatctcagcaggggatcgagttcgtacggaatttggtatttctagattataaattgtatcgctagtaaacaaacttattaggtgggtgttatttaaaaaaacgcccagggttttttggctagctccacaaacggtgatgggttagatgatctggattcaaagcctcacccctcctaattatttgatattaggtcatttattaatattcgtgtttttttaggtaggtgtattttagcatatgaacttgcaaanttgctcgttttgatgcacaactttatcgacgtgcaaactaaggcaatgaaaacccttttataactaatttctctaattaagttgcattctgaatagaatattatgcatacgcttaatcagtaaaatggctccgtagatcggtaaaatgaatagagttcgtgtttttggttgttggctccgatccgattcattttagctccaattctttttaggatattagcccttcatttcgttcatgtctgccttggcgtatgataatgctatgtaagtttgaatttttctctccttctaccaattgaaatagtagagctaccgcttgtttaaaaaacatatactcaatggataagttatgttaagtgtacagagaaaaagtatataaaataaaaggaagatgcaatgtataaaaataatggataaaagcaaataaataaaaaaactatatgtaaaggttatttacacatgaacatctctcgtgttctttgattatgcatgtgacatcttaatcaaactctatattagtatgattagtcataatatatcgttttagacttgatccgcatagacgcactagacaagttcataatgagcattttacaagtttgtgtactagtaagtttgtgtactagtaccatggattaccgaatatcactagaatcagggtgtgtttagttcacactaaaattaaaaatttaattgaaattggaacgatgtgacggaaaagttagaagtttgtgtgtgtagattagttttaatgtgatgaaaaagttaaaagtttaaagaaaaagttgggaactaaaccaggcctcagtagtgcatgcatgttcagaaagggaatttgattcgctgaaacatcttggtcgcggccccggttttttatttacgagaaacaaaaattgcagtgcaagtagtcaactcctgttgtgtaacggccatctggtgatctccctcgtgcatggtcaactattccgcgtcagttggtcgatagatttcgattccaacggattagtaatgtcgtcaagaaatagtactacagggctgagtcagtaatgcctaatgaagaaacgaaaatagctgatgggatctcgtcgctacataattaaatgagaaaattccctatatacccctgaaaatttactcaatcctttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaactttttttacaataaatctttttttattttaatgaaataatgttttattttcaaaaattcataacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggtatatagggaattggccctaattaaatcggaaatgtcaccatagtcacgttactatatggggaaaaattaaagtcattgttgatcatctcattaatgcgctgaacttaactggttaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15664 - DNA, 518 bp, Oryza sativa
  unsure (1)..(518): unsure at all n locations
nnnnnnnnnnnnnnnnnnnnnnnnnnnnnnnnnnnnnnnnnnnctcctccgccgcgaaactcttggtcgcctcgacaagttcgtagtatggaaatcgccttggccccgtccccatctcgatctctacgatggtctcgccgtcgtcgtcatcgtcgtcgtcgctgccatccatgcctccgttctttgcctcctctgtctccctcttcttgctctgacgttgtcgtacaaggactgctaccatggcgaagaggagtatgacgaacattaccgtgccaacggtggctcccgctacaactctgccacgcaccgcggcctttggttccaacgatgagctgaaataccatgaatgcagctgatgcagctcataggatgtggtcgtggaggcggagaagccaacggagaccagctccggcagcacgctcttgaggtcaaccttgtagctaaggttgtaatccggccggtgacgggggccactaagcccatagccgaggtgcagcctcatggccaggatgctggag

SEQ ID NO: 15665 - DNA, 723 bp, Oryza sativa
ctagattacaaacgatacgtcatcggcacatgtacgatcggctatcgtttatgaatttaactgtgtgtctttctttgtttattgttggttgcaggatcaaaccaactagcatgcctttgaactcgaaaccaagatttggacctgcactagagttaagcagatatctcaggccagtgtgtgtttttcgcatcaacatgcttttggcacgcccggtgggacacgagtgtgacaagcttccatcatggtggacatcaagtctaccgaggtggatccagacaatgtgattccaataaccatggacatgctaacatcagaacagaagcaagggtttgaagggatgataaatcaactgcaaaatcggtacttacattcatttgttctgactcgttcgggtacagtaattcaaagacacaaggtggatttgccaccggttgatgagaagcctcctttggggaaaaggtgttttcccaaaaaaaaggctctgtaatgatgataacttaagaagtcaaagctgaagactcaaacgggaggatgatggtgctccagagttcaacaatctacaagatcgatcagtgtggtcgtgacactgaaattttgatttaaaatttgattccattttgctctgaaaaattcaatttgaataattgccacaaaattcaaacctaaatgcaatttctttaaaaaaattcaaacatgctttgttgcagaaatcaaattgatgaa

SEQ ID NO: 15666 - DNA, 939 bp, Oryza sativa
ggagataagcccaccggggtcgctggggagtccatgccttgtttataagggggggattatgatccacgaaggtgcgctgcagtggattgtgttatgcgaggggtattgtccacaactcctttccgaggtaccgtggtggtattgaggcacatggtgacatgatgtggggttgtgtcttgtgggtacagtggtacacctctgatcagagtaaaactattcgaatagccgtgcccgcggttatgggcggtcgaccagattcaccgtgattagtctcacccctagttatcttttggaactggttagttcaggtggtggtttgggcctgtctcaacgtggtgtagcgttgagcagtgattggttaatattgattaattaacgcaattgttttactgctttcaacaactgcttttaaatgctagcttcatgcaaaagaacctttagcctcccttggatataccctgcatcatacctcctcttccggtatgacttgctgagtacagtgggtaatactcagtcttgctctcttttcccccacaccagagttgaagtccttctcagttgaagatgtctcgaagaggttggtttcgtcgctgccgtcaaggatgcctgtggaatggagtcgtccgctgcaggagtcaagtcttcaggcttagctcgcttttatcttttccgctgcatttgtaatctcttatatttttgtaaaacgtggatatgtatgtcaacaattgtcatttgtgtaccctggctggtcctggacaggggtttaatacacattcagcttagaaattctggttcgtgaatttctgggcgtgacacggagggaactagaggagagcttgcggagcgccgtcactgtctttgtcacgcccggaatttctatccaaaattccaaacgcttacatgtgtgtgaaccctcgtccaggaatcagccgaggcaca

SEQ ID NO: 15667 - DNA, 52331 bp, Oryza sativa
  unsure (1)..(52331): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaggcggtttcggtgcagtgtatcggggctacctcagagagcttggcctcgccgtcgccataaagaggtttgccaaaaattcctctaagcaagggaggaaggagtacaagtcagagatcaaggtaataagccggctacgccaccgcaatctggtgcagctcattggctggtgccatggccgcaccgagctgctcctcgtctacgagctattccccaaccgtagcctcgacgtccatctccacggcaatggcaccttcctcacatggccaatgaggtttattaattaactcattgatttagtaattttcgttatgtgcaatcgacacctttgaaattcaactgatcagctgacttggatgttgccacaggatcaatattgttcatggactcggatctgcactactctacctacatgaggagtgggatcaatgtgtagtgcaccgtgacatcaagccgagcaacgtcatgctagatgaatccttcaacgcgaagctaggcgatttcggccttgcaaggcttattgaccatgctgttgggatacaaacaatgacccatccctcagggacgccaggctatcttgatcctgaatgcgtgatcaccggcaaagcaagcgccgagtccgatgtttatagttttggcattgttctattggaagtggcatgcgggagaagaccaattagcttacaggacacccaaaacaattgcctcttccgactggtggaatgggtgtgggatctgtacggccaaggagccgttctcaaggcagccgacgagcggctcaacaatgaatacgacacaactagcatggagtgtgtcatggccgttggactttggtgtgcacatccagaccgatgtgcacgtccgtctatcagagctgtcatggcagttctccaatccaatggaccactacccgtgttaccagctaagatgcccgtgccaacatatgcaccgccgatggcctcagcggaggggcagccctcatcatcgacacgaatgtcgtcctcaagtttgacactaacatccatcacacctcgctaggtttgcaagttttctcactcataggatttatatagcgagacaattattgtcatatatagatttttatccatacccacaagttggtttgaaggactcatcttcgttaattgctccatacaggagtattagtcatgtttagttcattttacttgttctacatttacaaattgacgcttgaatgggatatgtacagctcgtgaggcaattggtttgctctttagagagctgcctaattggcaatgtgagcaatgtgtttagtttacatgacgctttcagttttccaagcatttatttattttgtccagaaaacttttcctacacctctccaacaatccaatcaaacagtccatatctctaactgatatttgttacatacttttcttgttttcagtcgatatcctagtccttatagagggcctggaattgttggagttgtaagaaactcagaaatattaacaaaacagaaatgatcgaaggcaccaacagaagagacctcttgcatgacatgtgttcattgttgatagatctcatatgatattcagctaatgctgtccaatgactgcatagattactactgaaacattgttttgtcctaattcatccccatctctggctgagatctagaatggttagttcagtctagaagatctaaatgtgtataacatgatcacaataatcatataagtatactaaaattcagaacaatagatctcaatttgcagaatactttggatacattgctgctatgctctcgttttgtcaagcaaccagcgtaacaaagataggtgaatttgaactttcagtgcagtttcgaactggtccccttctccaatcttcattaccccgtggaagaacaaagtcttaaagtgtagttcaaagcaaaaaaggaaaggtacaagaaagcgactaggttctctacacctagtaggtgtcatgacacccaacatttacatgtgacttaaatagttattatagaaaaaattaaaaaaatttagtaacatcaattatgatgatataagtctatacacaaacatgcaagtttctatctaatctacaagtaaaaaaataaaaataataaaatttgttaattttgtttcttcatgtgtctgctggggaactcatctttagtcctggtttacaacccctttaatcacaggttacaacccgggactaaagatgcccatcattagtcccgcttgaaataacccgggactaaaaattgtagcactaccatctttagtcccggttggtgttaccaaccgggactaaagttttttttcttttttttcagtgttttttgctgtttgcatattggccttttttttcattgttttttcacagatttaatgaacatcacaaatttatagatcgaatgaacatactcaaattcacatagtgaacatcacagatcaaatggacaccacaaattcacaaaaacatctgaaaaaatgttcatctaattatttttctattttcgaaatttattttatttgttattcgaaattttaattgatcccgtcatgtgttctaaatggtcttttcttttaatagttttaattttttattatgaatttttaaattgttttcctaactgaactcttatttttcttttttttaattaaatattttattttattttttatttagaattttaattcatctcggttggtgttaccggactaaaaattgcagcgctatcccggttggtgttaccaaccgggactaaagttttttttcttttttttcattgttttttgctgtttgcatattggcctttttttcattagttttcacagattgaatgaacatcacagatcaaatggacatcacaaattcacaaaaacatctgaaaaaaatgttcatctaattatttttctattttcggaatttattttatttgttattcgaaattttaattgatctcgtcatgtgttctaaatggtctcttcttttaatagttttaattttttattactatttttaaattgtattcctaactgaactcttatttttctttttctaatttcatattttattttattttctatttagaattttaattaatctcgttttgtgttctatatggactattattttcatattccttatttatttttttcaattttagttgtttcaaaattatatcctacttgaactctcttttttatttttctaatttcagattttattttatttttagtacaaattttaattaatcacaatgtgtttttatatggacttttctttcaatattacttattttaaatcaaatttcagttatttttacattctagcccanctaactgccattaccgtgttgcttaacgacttgcccgttgttcctccccttaatcgtcgttgggattctaaaaattgaacctaatcatcttttcggttttgttaatagttttcaccagatgtcccgttaaccgtcaccaccctattgctttataggtctgttgttcctcttctctttattgtcatttgctattattgtattttttaatggactgttcttttaaaattttgtatttttttcattccttttttttgttatttgaaaattttatttctatctgaactcttatttttatttttttattctttggaacttattttattttttctgaattttagttaattaacctcatattctattctacatctactgttctctcaataatcatttttattttaaatttctgttatttctaaattgtattcttactctaactctcatttctatttatctactttcagaatttattttaatttttattccaaatttcaattaatctcatgttgtgttctagatggtctcttctttcaacaattcttattttttatactgatttttttgttatttttaaatcgtattcttacttgaactcttattttattttttataattttcaaatgtattttattttttattcttaattataattaatctcgtattatgttctaggggattactcttttagaattttttattctaaattttagttatttgtaaattttattgttacttgagctttttttttataattttgaaatttattttatttttaattcttaattataattattctcgtattatgttatgcatggactattctttcattattccttatttttttattctaaattttagttatttctaaattatatttttcaaattttagaatttattttatttttattccgaattttaattaatatctaattatgttctatatggactctttttcagtattccttattttattttgaattttagttatttttaaatatatttctacttgacccttttttctttttatctaatccacagtgagcgtggtgccttctttcgagatttgcttttatagttttgtataatacagtagacaggtagaccgtagattcaagatttgatctaatactaacaaaaacatgatcaatatttaatgagatatttttagttattatcttttctcatctatgtatgtacgtggctaccaaaaatcaggagcattcagtctgtttgtttcctagtcctttccttgcatatggccatatacgtcagttggacttgatttttttttattacccgacgataatcaagccatgcaatccggttcagagagcacttggagttggaacagaagtatatgtaagatttctttctttgtcagtccaagcaagattagtctatagtatttttccttctcttatacatacatatatccgatcaatctcgactgttaaaatctgaagctatcatgatccgatggtgtagatttctctttttcttcgattaatgtggcaatttctagccttcaaagcgaacttggtgtcttctttcaagactgtttttaataatataacttgggtttcgtttttataatttttagaagtcccatcaaacgctgtcattatactcctctacgactcgtccgctgtctcatctctttattgtcattgggattttaaaactcgaacataattatcgtttgggttcattttttttactatctagaagtcctgctaaaccatcagcggcttttccattgtacttctctacagctcgcccgctgcctcacctgttactgtcattaagatttaatcaaacataattattattggggtttactttttactttttagaagtcctgccaaccgctgtgcccgtattgcttaactgcatgttcattgtcgctattaggattctatttggggttttcttaatagtttttggatttcccatcaaccatcaccaatctactcctttatacgcatgttgcttctctcatttttactatcatttatcatttgtgttctatataaaattttttgtttgaaaattccatatttttcattccactattttttttataaattatattcctacttgaactcttataactatatttctatttttgggaatttcttttattttttatttagaattttaattaatatcgccatgcgttctagatggtcgtttctttcattagtctttatgttctattatgaattttagttatttataaattgtattcctagttgaactcttattcttttctttttctaattttagaagtcattttattttttattttaaattttaattaatcttgtattgcgttctatatggattatttttttaatatttcttattttttatttctaattttagttgttttaaaattatattcttacttgaactctcttttttatttttctaatttcgaaatttattttatgttttattccaaattttaattaatatcgtattgtgttcttgtacgaactcctttcaatatttctatattgcttatttttaattccgaattttagatatctctaaattgtattcctacatggactctctttttctttttttcgattaatgtgggaatttctagcacccacagcgaacttggtgcctcttttcaagactgttttaataatataactagttaggcggcccgcgcaattgcgtggctagcatcaatttaaaattatctattttttacacatgattttatttaaagttatcattcccgtgattctaataattttatagtttttaaaagccacaccagtctttatccattacttccttgtcacctttttatttgcttacttgatctaccactacctttactcatcttctttagaacttttaaaattagtccttatagtttttagagttcattgttttgttgggtttcgttttcataatttttagaagtatcttccaacatcgccagtttactactctacggcccgtccgctaccacctctctttattgttattgggattttaaaaatcgaacataattattgtttgtgttctttttttacattttataagtctcgccaaatcattagtgacttcgccactatactcctctacagctcacctgctccctcccatccttattgtcattgagatcttaaaaatcggatatgattattattggggtatattttcactctccttaagtcctgtcaaccgtcgtgaccatgctgcttaacggcatgcccatcgtcactcctcttaatcatcattgtgattctgtttgggattttgtttatagtttttagatatcccatcaaccgctagtactctacctattgcttctcccctttttattgtcatttgtcatcgttgtgttctagatggactttttttttaaattgcatatttttcattctgataatttttattcataaattatattcctacttgaactcttataattatttttctacttttgaaatttattttatttgttattttgaactttaattaatctcgtcatgtattctagattgtgtcttatttcaatagtatttatttttattacaaattttagtatttataaattgtattatagttgagatcttatttttctttttctatttttctgaatttattttattttttatttcgaattttaattattcttgtattgtgttatatatagactatctttttaatagttttattttccaatttcaattgtttcaaaattatattcctacttgaactctcttttttattttgatttttaattaatatcgtattggtttattatatggactcttctttcaatattgcttatttttaatttcgaatttcagttaattttaaattttattcctacgtgaactcttcttttatttttttttctaatttcggattttattttatttttattctgaattttaattaatctcgtattgagttcttatatgtactcttttttcgatattccttatttttaattccgaatttcagttatttttaaattgtattactacttggactcttctctttttttttctaatttcggattttattttatttttattccgaattttgattaatcttgtattgggtgcttatatggattcttctttcaatattgcttatttttattccaaattgtatttctacttagactcttcttttatttttttcgattaatgtgggaatttatagccccccacagcgaacgtggcgtcgccttttaaagttgttttaataatataatcgatagatagatagatttgagatcgtcaatggtaatctatagaactggctccttgtcaatgataaaaaggtaagagtttctctaaaatcattggattgttacctattttctcctttttactttacgacagttcttgaccatctatctatctcaaaacaaagtacttgacgaattatttttgaatctcacaacggtgctttctaatggtagtaaaaataaatctagctaaaccgtagattcttttctattcaagggatcagacctattcgtactaccaccatatttaatggtagtagaaacgtgcatgggaggataattttgtaaatttgcatgttagttggaaacgctcggatttttgggtcttgctgggctgagcatgcggggtagcgttacagagcgaggagtggaggtggctggtgtgctgccggcagctgatcagcagcgatagatgcgagtagtttatttctttggttggccgtctcctgcctgcggaaagaattaggactaaacattataaaatttactacaagagataaagataaaagtctgaacttgacgtgctaaactgctactgttttttaatcagcatatcagagcgaagcttctgttctcttgctcatctgcttcaattgaatcccactctaaactatgggacctctaatagagtctacactgttataattcagagaatgtgctttatgatttacatgttaatcagcgactatactacagtctgcagtgcaacagtttttatcttctacttctctgttcatatttgaaaccggacaatgaattgaaaagaaaagggaacataacggccttgtgaacgcggccaccggagccgccggcgcccggcaggacgatttgccgaccggcaacggaaggatgtgccgtcgagtagccaagcgatagatctaaatgtacaaaaactttttttttaatgaagagtggataatatcctaaataccaaccttacctttaatcactaagttagtaaagtactaaaatgtccttatgaatcaacggtttaaatcaattctactagttgtataatactacgatatagagtaccggagcatcgctctttattttttgggaatgctatggatctggaatcgcagattaggtttcatttagagcaagtttaatagtgtagccaactgctgactctaaatcatctatagtcaacttaatagtcaattcatacaatagttacctataaacatatactacacaattaatatctagtcccacctgtcatacacacatgcattttggagtccgtgctgcagctggctacaaatctgtagcccgctactcttctctcttatcttttatctcctcgaaatgtgtttatagttagcttataggctgctattgtacctgctcttatacatctatagtcaaattcatctacacacacaaaaaaaccgaccgtaaaaattatgattgaattcccagttagatttgctatatactcctacctatccatatagattttttttagagaaaaggtcacaaggacccggcctatattgaaagccaacctcgagcagagtttttgctggggttaccagctttacaaaaaggagcacagaaagcactcggagatgattacgtaccaacagacaagtgatatattaaacctctgaaacagaccgaacgccaaaaacattgcatggggctagcaagatcaaccaactcctattctattttgtcttagagcaggtcctccctccttcaacctctttaccggccagcttctctagatcactcttattcatctccagccgatgcaaagtgttgaatagtctttatattgattgtggaaggacaaatgacataagatataagtggaagagcccctcacctcaaggctagcttttgtgatgggaaagactatttacgatcctacgcaaagaactccacggcaataagaaagagacaatttggaaaggtagatacgatgttgtttctcgttgttcatatatagagtccagcaaatggttaaattcagctctaatgtcagcaaggataaagaagtcatcaaaagctctaatgtcagcacggataaagaagtcatcaaagttaagaggaacataatcccagttgagcacatctctacataaacaccaaacaaccagttcagcacatctctacataaacaccgaacaaaatacgccaaagggcagctaaagattatgtacatctctacagaaacaccaaacaaaatgcgccaaagggcagctaaaaattatgtacatctccacagaaacaccaaacaaaatgcgccaaaggacagctaaagaatatgtggtttgtagtttctagatggacagtggagaaaaaaattctaattttaaaatcagtaacaccaaacaaaatgcgcctaaggtcagctaaagattatgttgtttgtagtttctagatggacagtggagaaaaaaaatctaattttaaaatcagtaactagagggtgagcgtgtacggtacggtgttaacacgggccacggccggcggggagcacaaaagttacagtctctatatttattttagtgctagagaagacacatatagtaaggccctgtttagattctaacttttttacttcaaacttttaacttttttgtcacattcaactttcctacacacataaactttcaacttttccgtcacatcgttctaatttctttaaacttctaattttaacgtggaactaaatacagcctaatatatgctactccctccgtcccaaaatataaatatttttaaacttcgacacggtcttcgagatactactttgacaaataatatctatgttttaactaaaaagagttgtatattatgataatttgtttaatgatcagtctagtaacatcaaattgacatgatcaatcttttttcttttgctattaatagtcaaaatttaaaaggtttgacatcacattactctaaaaatatttatattttgggagggagggagtatcaatcatttgaagagttcagtgacattgtaccctaaggacgaaacgaatactggtttgacttactcttgtttcgtcgtcacgcgccaggccgagaacgggtccaatggaggatacctcaaatacagactcagactggcagtataggaagttgtgtcgttgctcctccagctggagaagccgatcagtacacagtactagtatcacagtactgtatcagtatcaccttgcacacgatctatcgacgctggatcgccgacggcgatggccggcttttcgttgaccacttgtgctaccggcctcgtcatcttcttctccgtctgctacctgcagcctccggctcctgtcgccgccttgtccttcaactactccaacttcagctcaaacaaccagaacatcgaaattgaaggcaaagcctccatccgcgtcgggtatattgacatcagcgcgaacgacgctcgggacattttcaccagcgcgggacgggtatcctacaagacaccggtgcagctctgggacgccgccaccggcgaggtggccagcttcaccacaaccttctccttcaacatcgtcaccccgagcgataggaacaacaggggcgacgggatggccttcttcctcggcagctacccatcgaggttgccaaagaatgcctccagtagtggactcggcctcaccaacaagtcctacaccaacgtctccaccggcgaggaccggttcgtcgccgtcgaattcgacacttatctaaaccgcgacttcgaccccaacgcaacctacgaccacatcggcatcgacgtcaactccatcgtatctgtgacgaacgagtccctaccagacttcagcctcaacgggagcatgaccgccaccgtcgactacaacagcagttcgagcatcctgtcagtaaagctgtggataaatgacacaacgaagccgccttacaacctaagcgacaaggttgatctcaagagcgccttgccagagaaggtcaccatcggcttctcggcggcaacgggcgcatcagttgagctacaccagctgacttcttggtacttcaactcgagcccgtcgttcgagcataagcatgcacgtgccggagttgaagcgggagcaaccgtcggggcgacgttgttcgttgtgctgctcttcactgttgcagctatcctcatacggcgacgtcgaatcaaaaacaggaaagaggcagaggatgagcaggacataagctcggacagcttagacgacgacggcgagcccatcgtggagatcgagatggggactgggccaagacggttcccatactatgagctcgttgaggccaccaagagcttcgcggcggaagagaagctcgggcaaggcggctttggcgcggtgtaccgaggctacctgagagaacagggcctcgccgtcgccattaaacgcttcgccaaagattcctccaagcaagggaggaaggagtataagtcggagatcaaggtgataagccgactacgccaccgcaatctcgtgcagctcataggctggtgccatggccgcgatgaactcctgcttatttacgagcttgtccccaaccgtagtcttgacatccatctccacggcaatggcaccttcctcacatggccaatgaggttatcaaccctcgctagttctatctcaatctttgtgaccgtattaattaacatatattgttaaattaaacttaatagattagctaacttattttttacagggtcaagattgttcttgggattggatcagccctcttctaccttcatgaggagtgggggcaatgtgttgtgcaccgtgatatcaagccgagcaatgtcatgcttgacgagttcttcaatgccaagctaggcgactttgggctcgcaaggttcattgaccacactgtggggatgcggacaatgactgcagtgtccgggacaccaggctatgttgaccctgaatgcttgatcaccggcagagcaagcgtaaagtctgacgtttatagctttggcatcgtcctgctagaggtggcatgcgggaggaaaccgatgagcctactagacagccaaacggatggcgtctttcggctggtcgagtgggcttgggatctgtatggcaagggagatgttctcaaggttgtcgacgtgcgtctcaacgatgactacgatgttacagagatggagcgtgtcatcgttctcgggctctggtgcgcgcaccctgatccgagcgcgcgaccttctattagagacgccatggccatactccaatcgagtggaggctagctgccggtgctaccggccaagatgcccgtgccgacgtacgcgccgccggtgatctcattggatgggctctttgcgtcatctacagggttgtcgtcgtcctcaggtgtgacgcagtcctcgtccacatcgacgacgagtggccatgctactcacacctcgtgttcgtcggttccgtccgattcaaccggtttgaaggactcgtcttcattgctcaagcatcagtcctagcgtttagtttttgttttttttaatttgtttgttcttagtttagagtttacggttgaatggtccgttgatttggtctttagtgttgcctaattgccgatgtgagtaatgtatgtgtatttacgcgatggtttgaacttcctttttcaaaaaaactagctggtggcccgcgcaattgcgcggctagcacccatataaaattatctattttttacgtatggttttacttaaatttgttaaataactatctcgttatgttagaactttgaaagactgactttatcatgccggtgtttttaatagtcacgccaatcactacgccttatttctttgtcatcgctttatttgcttgctcaatctaccactgttttcattcattctttttggaacctttacaaatttgaccttgtggttttagagttcattgtatcgttgggtttcgtttttataatttttagaagtctcgccaaacgccgccactgtactcctctatggttcgcccgctgcttcccatttttattatcgttgagatttaaaaatcgaacatgattatgattgaagttttttttactttctagaaatcccgccaatcgtcgagacagtgctgcttaacgacctgctcatcgtccctcctcttaattatcattgaaattctatgtgaggttttgtttatagtttttagatatcccatctacctacaccactctatttttttgtgggtctattaattctctcatctttattataatttgtcattgttgtgttctgtgtggactattttttcaaaaatcaatatttctcattgtgatatttctttcatttataaattgtattcctacttgaactcttataattattatttttatttactttaccaccctcggcatgccctcctatggcaattgcctcctatctcatttatttgcgtacgctcgcctgcccattgcttctcttctttgtcatctctcactacaccggtaagactaaaaaatcaatccatattattgatatgatttcattttttataatttttttagaattcctgtaagccgtcgttgcatgccgccttatttgccgtcccttggcaatatgtttgttttcttttgattaaatgtggcatttttagtcctgcaaatgtgaattaattcttagatagaatatggtcaagaattgatgatcgaacattggcaggctgccaaatactgaccttgatcttgatgtcttgataatttctatacctcattatgtaatatttgaaatttatagtattctttaaccacaaaattatctcaaaaaaagaaaaattgggaatatatttttgtctttcaatctacgaccaacaaaacaattaaacttcttacttaacaaaattttgatcatactaaacttgcctttaaatgacatcgtgtgcgtgcgcgtggctgactaaatcacccgctgctgctgtgcaaggaaagggtgcattggttggcagagtgagtttgattgttagctgacacgtctatgcggtaagtgccaaggaaacatattgattttcctttttttttataagtttctggaaacaaaagaaacgttgactcagccctctgtccggttgggccattacagtccgaatagaatttttgttttgctgtatagtattttttttttacatagtttgagtaggatttgtcatgtatcctttcttacttatactattctgatcaatctcaacggttaaaatataaatctatcatgatctagcggtgtagattttttctttttcttcgattaatgtgataatttctagcctccacagcgaacgtggtgtcttttttttgagctgtcttaataatataatagatagataatgaaggcaagaagattgccttatatatactgattgatacggcagggatttgaactttactgccgttataatttgtctacaaagaattgtccagccattttctgttccagcagcagcggaagtcgagtgagggagacgggcagagatagtggctgcagcagcattaagggtgcgtttggttgctcgtattctcttagtctggctcatctcttctatccaggctgagtttggtctggctaaaaggatacatatgcagctgtttgattacccgcatccgatgaacctggatatgctgagatgatgtttggttggttgcagcaaaggattggtggaatggttgcatgcaggagatgttgtttggttggatggatacatcttaggtgtaaataccctctcttgtgagtggtgaggttaccctcataaagtttacatctgtgtagtgaggttactccgtgaggttgtgttaaaattttatttggtctttggctactattatttgtgagctaaattacttagaatattggcatacacgtctattttcttcggttggtaatttttgtaagaatcggtaagcagcattgaggaaacaaacgtgcatacaggaagttgttcacaaggaacagatcaaacattttggtatttgagtatataaaattacatcgatgttatacaaaactgaaccaattgttatacaagtacatacttattacaatccttttacagacatctttaaactcaacagccttatatatctgcaatctggtaaaatgacaagtgtatataagtatgttcttatgcatcacagctcagtactactagaatggtattgcctagaaaattaaatatcaaacaacacaggaggtcaaacaaaaggaataagcctaatttctgatattgcaatgctctgctttctgaaatttgtcctatgaacccaaaaaaaaaaagatatacatgctctaaacagaaatgctatgatgggaaaattgatcatgcttagtattttctgctgcttcctgctagcctccttttttgctggttgtttcttccagatggaactgggaaatcaaatggcagccacaacgactgagtatggagctgtcatctccaagtggccattttcagttccatgtacttacctttgttcttccaagcttgactaaattagtcagtggatgtcaacatctgattatattacaaagactgaaatgtaacttatgcagagatttagaagtatatgcttaacagcatagccaatccatggaccttgtactccgtaattcatataaaagataattggaccaagaaacataaacacaacatcctaaggagcacaacctgagtatgtatgtatacatccagtggcataccatcatcgaccatggatatttactcagacaaaacacaatcggcaaaataaggtgcacagccaaaagtgtaacacaacagcacaccataaaaaacaaataagcacccaaagtttgctctgacattgaactaatattaatctgtatgaaactgaaaaaacagtagatctgaaagaaaatgaacagctaaaaaggataccaacaatacacgttgacattgaactaatattcatctagccattgacacggtttcaatatttaaatctaccaaagtcaactaggaaaatgtataagcttttactagatctagcagatttatgaaggccccatactctcatccactcaaataacagcaaatcaaccaaatagagaagaaaaaactggggaaggagggacagggaagaggatgcccaaccttgcaatgggcgatggatagccatcaatgcacttaccctgctgctcgacagagagtgacagtggaacaacaggcacgacggagagaactggcaaacgaggggaaggaccgacgcgggggcaggaagtgagacgacctcggaacagatgaaggagagccagaatcgggggagagggctgccgcttatggccggagtgacgagaagagcagcgccgcgccgctgccaaagcctaggttgaaccctagttttttttcacgagagggagaagtgaggcagggagggagcgattctggggaagcagtggtgaccccatcccgcgagttgcacgcgtgggtgcaggcgcgggtgaagcggtgcacatcggtcgagccaggccaagcagcgaagtgggaattgaccgtttctgccgtgcctggctgagggggtatttttgcatccgcatggacaggctgggaggcccgagcaggcaaccaaaacaccacgaatttgcatggaccggtgcgggccaaccttggtgcaggcaaccaaacagaccctgaacgttcggccaagaggattactggaagcgaattaaacgatcggcccattacaattgaagaggtggccgccatcctcttcatgggccatggcctacagaatgaagttgggctgggccacaaccgctaggaaaagcctgatctacatgcctacccccaatggaaataagtccacttgatgttctcatctttccaataaatatggacatccaacgtgcaaagccgggttaaattaggttttttggcagcatagatggctggtttaactgacaaatataaaatgttcaaagctaatctaaggctataaatagacacctccaagagaaaatatatgtaagtgagagtttttaaggattaataaatatatttactttctttgtgtacacttataaatgcactgttgtcttcttagacaacaccatgaaaacttaaaatctggaccccgatccatgtacaatattttatttttatcaatcctaaattcagaaatcctttatcaagaaaaatactaaaagtaagacaccataacaagtacaactcagtattattaatttaaagcttcatattatttaataaaaaacatttatattccgtaatttcgaagtgtgtattaacataaggaaatagaaagtaagggataaaaagtattatattttattctatatacctatgatattgtaattaccaatttcaaaaattcgaaactatcggtttcattattgagcacttaaaagcaaaatacacacacttatgcagaacatacatatcagaagcccagcgaaacttttttatctttattcccggtaggtaacaccaaccgggactaaagattatttttattcccggtttgtcttttgtcaggccgcccaggatctttaatcctggttagtaacacagcactttaatcctagttggtacaaccgagactaaaattgaaaaaagcgcacggggagggagagagccgcatcgcgtcttaattatctctgatgtctctctttctctccctcgtccttatcttcttcttctcctaccccgtgtcgcgtcttatctccgtcgcatcctcctatcctctcctccacccccctcctcccctctcacctaggcgaggcgtggagatcggagcatggagtcggaggtggtgaagacggagatggctatgagcccgtgacgttgcgcggtggcctcatcgtcctccgtcacgcgcgggtgagcgacgacgacagcggtggccggcggcaggcggcgccctccgacctctgtgtctgcgaccctgtcgccagccgctgcttcttcctcccgcacctcgggatttcccaccgagcagcttcatccgcggacctcagctgctgcgtcttggctctctgcctcgactggtcatcgctgccggcgtagatcaagttccccctccttcccacctcatcgccaagccgagcgtggagattctcctcgtgtcgccgccgtcgccggccgacagtacgtgttggtatttcttaacgacattactagaaatataattcccagcaatggtgccagaaatagtcatggtatattatgattacagagtttatccgcaagcgcacggatataccattgtagcattttcacccgagagtattccaagggtatcgtatttgtttatcccgtgggaagattataatagagagaaccaaactaatatttatatgttacttgtattaatgatgtctaagcagggataaatataattgcagggtagaatgacacacaagcataagctactcatttttatattaaacctcctaagctaagtggaaagaatatagaaaagaatatattcctatacttctagtatacatcctaggtatatgattaactagctaatacctcctttccgatgccctcgtggtactttgagaagccacccttgactgccgagttccttacgacagctcgtcatgactatacaactggggctaaatacggaggagtaccctccccaaggaattaacttaggactatatacacgtgcggacgaatacccatactgagctgtcgccatcagcggcccacctctcatccgcagcatataaccccaaataatgatacccagtaatctagacaccacgcctaaacttccagatactactctaatatcatcgtcatgacatagaataattgcatatgcaaacattatacccgtaccaatgcatctcccagataagctagcagtataatcataatatctcggacatattgtaaagctggtagtcatataataggagagtattacaatactagagtcgtatacaaaagtatattctaaattaaatactagtcttacaaaagagaaagtaaagctgctagagccatacccgaactcttccgaagacttttggattccgactactattctattcctactccactagcttgagagcactaaactaacttgagagaatatgagatctttgttgcttgaagtgtgtgagagggtgaggagtttatatagccaaccaatgacggttgtgacggttggaatggtcggaaataccctccaaccgtcattgggggctaatctaagccgttccccaaaagccctgcatccaacgacgatgaggagggttcggccgaacctcgggctagcccaaccagcccactttttgcctggcggcttccctgacttcttctctctgcagatttgtgaattttgggctttttgggtcttctgaaattgatattttcagcccatcttcctttaagtctgattctcggcatcgtctgattgatcgatcgagtgttttgatgccgattcttctccatttattgcttattctctgcaagaggttagtaaaccaagtactagtggattttattttattctaacactatatgcattgcaagcatgactagctctccttttattccggtaatattgacgggcgaaactgatcgataacgaccatcaacaaaacaccccaagcttgaacctttgctcgtcccgagtaaaggacgaaaggaaacaaaacttggttattgatcaggagttgctactatgctgtatattctcaaatgtacaagtgcaaggtatatgtactctctctcaaatcaaataattttatcacgtggcttacccttacacctgattcccgcgagacattgctttaccttgccctgagcggttgaaagacagaacagcaatgatgagcactagtcacccaatctttattcaactttttattccgaaagttttcaaatgatttttcaaaagaaatctaagttcctcaaatgatcctctcgatcactcaaagtgtataaatatgaattcctcaccaaagtaaccttgttgattcctactctaaggtttagtatgtggagcttggtagggatcaaacatggcatacctgtattcacatttattattaagtcaaaaacttagactagagcatatgactagacatactcaagatcaagatcgtacataaagtgtgtgatatatggtggaaatggaatgtgaaaaaataaagaaaatacttctactttgtgctttctttcttctctaaaaaatccttcatttctttttaggagggggcatggctatattttttttatcatgctcaatattttgaggagcaagaatttattttcataaccatgtctttccctcttttctttctttttggaaaggatattattttgggaggagaaagcatataattagagagctttatttgggtggtaacatgatagatataaatggaatggatggatgctaacttctagtgcaaaagttcgcatgtgcatatatgtgggtgtatgatcttgatcatagagcatgaaaagtatctacacaagtctcaaaaatttgacaaagttcaatggaagtacaagtgccaaaaatatatatggtttgtcaatatgaatatttttggctctggtaggaatttatatcaaatgatgaacttctaagtttatcattttagaaaataaaacatccaaaatttaagtcaaacttagaacaggatcatagcagctcttatcactatctcatatctcacaacaacctagacttagttcagcaagtgcagcccacttacctcaggttcccggataatatgtggccacttttatttaatctttgagatattacttaaccgtgaatccatatataagagatataaaacagtgcaactattcatcatttcaatcaagagaactacttgtcttacctagcataataaaatctaacctatatttttggtattttctattttgcaaatttttatgtcattttttttggtttataggatgcaatgtggaaatgtaaatatgcaatggaaaaggaaaatatgcaatgtgatacaagttacctcagtggggggagatgtctccccccaagcttatctttcgctcagggtccctggtagggattgaacccttggaagcgaaggtacgcttgaagatcagcctgctgttgttgcatcagattgttgatgttaacgaactgagcattagcattttcctaccattcttgcgtctgaacgatgtgtccatcgaggtagtactggatctctcctgtctgcatatcaagggtgtctagcctcctcgtgatttcacccaagtcctgggaggaacttgagcgccaacagttggaggcgggaggcatcccgcttgatccagaggaacaggtgtgcgcgttcccccagtgtacttcacgcggtgcttgccagcggttctcactggcactgtgctaggacgaacctcctgtgttgtgtcgtggtgcttgggtccaaccgggtgcatcccccgttggttcccagtccgcctcgtacatctgcatgggtgttgatgatgatgactcctcgtgtttttgccttggtttgttgcgtgtttccctgtaggatgtacctgcacgagattcttctatggtctgcaggggaatggttagttcctgacagttgtacaaatgataccccgcattgggtaacgggatttcatttgtacaggggaaaaagtatatcaaagagccatcggctccatgcttaagtatatgcccttgcattaaatatgtttcatccacatagggatggacagtgaagatatactcgatttgatcagtggtgataactccatgtccgttcgctatgcgggtgatcaaggaagtgcactcaacaggggcattatacttaatactttctaaccattgcctaatcatatatttaacaggagcaactttagtcttcctaaccttggcaaacatgataatcaactcatctccccgaatgggtctaagatcacctcaaggaaacaaagtcatagcaatccatttgtgcataagcctaagtgtaggattatggatgtcatttgtcctaggttttctgcaagttggagcaccagaaatgtcttcccaaaatctgtttttctcgaacccggaaattcctttccgaagatcgattttacagttatcgtgaaaaccaagaagtgtgcttaatcctttccatgaaagtgtatactccttatggaaaaaacaaaaggatatgctatcttctgtttctttcaaagtgcacagaaattgtatagtaagcaaacgagaacctggctcatctactactacaaatctctgctaacagcgtgaaaatcaacatccatacctgtttttcttagaagttctggatcatacgccctggtgtggccgaactcccggtccttcagcatgtggtaggcttgtagctcccgatcaccaacaatgtcgaggtcggtgtcggtgttaaggaccaaatttggtaaatcatggatcggagatagagattaaaaccgaagcggaatcgaaggaggttgatggtttcggaaacagagtgcgcatcggctggagatcgaatcggctaaggtatgcatcggcagagttcgagtcggacaaggtagccgatgaagtcgattccgacaagatggcattgcaatcattgtcggatcgggttgatatgcttcatgaggattgccacgtgcgtattgagtctgaaaaaagcaattgtatctattaattagatattttatgtaatttacttacagtttgagttggtaagagtctgccttagggacttgttcgtatcctaagttgtaatagagttaggagtcgtgtctgacaagggcatattatgtactttgggttgggtataaaagtagcccaacccgtgttgggctgcttcgccaacctttcactttcgtttactttcgacgagttcttgctttcgagttgggctgcatcggttcgatctccgatgataaggtaaaacttgttatggcggcttgtgttctcgggattagtgctttcatctcaatgatactttaatcttgtttatgtaagttgtcaatttatcatatttcctatataatctagatcaatattgctatctaacctagaattggcaaacatctcttgttggaaggcaaccgatagggttaaataccaacgttgacttagattatatagtatatccaccatcctaggaatcaatcaatgacttgattatctagatattgttcttcttttcatactcattgctgcattagttaagtttgagcttataagttgtgattagaatagtaatctctagcctgtttattgattgccgattagggtttcatcggagtttcaaccgatcttacctgatttggttattttgtctactttatgtttacttaatatgctaagtctgccctttatattaagatctcactctaattaaatatattaagcacgttattaatctgttaagtcatcttaatacttgattgatctctgtttaatatattttgtctatattgatatctcagtataaagtggtatcggagtattagccgatacatgtcagatctgcaacatcggctatgctataaacatatataatctttatattgaagtacttttagacataagtgatttatactgtctcgacaagttgtccgatctatcccagtcacatggtttcaacatattttgatatactgattatatgttgttaatatctacagccgatcgactagatctaaccgtccttttttctttacatatcattaccgatctaattcacgttacatcggctagattacaaacgatacgtcatcggcacatggccgatcggctatcgtttatgaatttaactgtgtttctttctttgtttcttgttggttgcaggatcaaaccaactagcatgcctttgaactcgaaaccaagatttggacctgcactagagttaagcagatctctcaggccagtgtgtgtttttcgcatcaacatgcttttggcacgcccggtgggacacgagtgtgacaagcttccatcatggtggacatcaagtctaccgaggtggatccagacaatgtgattccaataaccatggacatgctaacatcagaacagaagcaagggtttgaagggatgataaatcaactgcaaaatcggtacttacattcatttgttctgactcgttcgggtacagtaattcaaagacacaaggtggatttgccaccggttgatgagaagcctgagtcaagctctgctaatgatgataaacttaaggaagtcaaagctgaaggactcaaacgggaggatgatggtgctccagagttcaacaatctacaagatcgatcagtgtggtcgtgacactgaaaattttgatttaaaatttgattccattttgctctgaaaaattcaatttgaataattgccacaaaattcaaacctaaatgcaatttctttaaaaaaattcaaacatgctttgttgcagaaatcaaattgatgaaaacaaatatgaggatacataccaatttacctattggcgagggcggcgtcgcttcaagtccgacgtgcaagaccgtacctccgacgttcatttcacggatttttcacccgtctccggaggtgatggagtgggcgttttctgcttcgcacgccataccttctttgttcttggtatgggcggcggcttcttctgagccagcttttcttccttcttggccggtgtcttgggttttaccggcgttttccaataacgggacctcatcctggatggttgaatttctagagatttcttcataaacacgatgaggctatccattttgggtggctccacttcgaccgtctgaatgttctacggggctggcccgtactttattcggaacatggagcattgttccgtccttggctggaactcgaacttctcctccttcccgttgatgcggaaacggatacttcccgttccgacatcaatgtttgcttccgcagtgctcaggaacggacgccccaggatgagcggtgtctccttgccagtgtctatgtctagcaccacgaagtcgaccgggataaagcaatctcgtatcttgaccggtacgtcttccgctatcccagctaggtagtgaaccgatgagtcagccaattgaaggcgcatcggtgttggtgtcaacaccgtgaagttgagcttgtcaaagacatccttgggcatgacacttacacttgccccaagatcgcagagcgccaggtcgaatttctatgtcccaattgagcaagtaattgtgggacacctcggatccttcggatccttcttcttctccgggagtttgtggaggatcacgttgctgcattcctccgtcagcttgaccacctcggttgttggtagtggtcgcttgttgttgaggatgtccttgagataacgtgcgtacgttggcacttgcatagcatccaacaacggcatgttgatgtggattttctagatcacctcaacgaatcgagcgaactattcgtcaactgacggtttcctgatcctctatgggaatggcagcaacctcgcgttgcagtagtcttgcggcacggtcttctctggctgaatttcttcttcagccgttgtgttggatggtgcttcccgcgtgttgcttgtacctgcagtgttaggatatggcggatcgcgagtggacttacctcccctcgtcgtgatcaccttaacattttcaatggagggtttgggttgccccgggatccttccagtttcatttgcaagtactagagcggcaagttgcgccaactgggtttcaatcatcttattgaaactcaactggttttgaaatgcggaagcaaagccatctagtttcacatttatattttctaagatcttgtcattggcagccatctttttgttgagtgcgtcggtagttttggcttgcgcaaagacaagatcctttaaggaagacagattagaaaagctaccttggttattgcctccttggaaatacggacggggatggtttcacccctgacctccttgtgggtgatacccattgttgttattgttgttgttacccatgtacatcacctcctcatgggttttcgggcagtcgttcccagagtgacccgtgttgccacagacttcacacgtaacgtgtgagtccaaggccttgacggtgccttggggcttcttctcgtgttcgtccaatctcttcatgaggaggtcgagttttgcagtgaacatttccgtctccttgacggtgtgcattccttgctgatgggactagagtcgtacctcgctccaccccatattagagaccattttctctatcagatcgacggcccctctgaccgtcttagagaaaaaggctcctccagctgccgcgtctaggtggtcacgggacgtgggagtgagtccattataaaagttctacaggatcagccagtcgtccatctcatgatgaggacaggcggccacgtactcctgcagacgttcccatgcctctggaatggactcatcacgtgtctgctggaagctcgaaattctcccacgaagggcatttgtcttgcccatcggaaagaacttcgacaagaatactatcgagcatttgtcccaggtattgatcacggcacgattggcataaaaccactgcttcgctttcccgaggagggaaaacggaaacagccgcagcctgacgacgtcaggactgacgccctttacggtgtacgtgctgcagatctccaggaaccattgcatatgtgcattagcatcctcgttaggcttgccgcagaatgggctagcctgcgccatcgtaatgaggctggatttcaggtcaaagtccacgtctcccatgttgagttgcggcccagtggccacgttctcagaggagggagcagcgaactcgcggagggtcttgtcagccatagtcttgaaagttggtggcgctggtacggctggcttctttgtcggaagagtcttctgcgggggaacaacccgcggctttacgcttcggaagaagacttctggattttcttgaaaattttccggcaagtcgaaacctgtcatgcactaccctgttttcacaacaaaaggtgaaaacaacatggttagcctgcaaagcacagtgattatatagaggtaaatataagatattagttttagtaatctctttttacaaatcttccccgggaacggcgctagaaatgcttgttggtatttcttaacgacattactagaaatataattcccagcaatggcgccaaaaatagtcatggtatattatggttacagagtttatccacaagcgcatggatataccattgtagcatttcacccgagagtattccaagggtatcatatttgtttatcccatgggaagattataatagagagaaccaaactaatatttatatgttacttgtattaatcatgtctaagcaggggtaaatataattgcagggtagaatgacacacaagcataagctactcattcttatattaaatctcctaagctaagtggaaagagtatagaaaagaatctatttctatacttctagtatacatattatacatacatcctaggtatatgattaactagctaataccccctttccgatgccctcctggtactttgagaagccacccctgacagctgagttccttacgacagcccgtcataaccattcaaccagggctaaatacggaggagtaccctccccagggaattaacttaggactatatacacgcgcggaggaatacccatactgagctgtcgccatcagcggcccacctctcatccgcagcatataaccccaaataatgataccgagtaatctagataccatgcctaaactaccagatactactctagtatcatcgtcatgacatagagtaatttcatatgcaaacattatacccgtaccaatgcatctcccagataagctagcagtataatcataatatctcagacattgtaaagcttgtattcatataattggagagtattacaataccagagtcgtatacaaaagtatattctaaattaaatactagtcttacaaaagaagaaagtaaagctactagagccatacccgaactcttccgaagacttccggactttgactacaattttattccgactccactagcttgagagcactaaactaacttgagagaatatgagagctttgttgcttgaagtgtgtggagaaagtgagagggtgaggggtttatatagcctcccaatgacgattgtgatggttggaatggtcggaaataccctccaaccatcattgggggctaatctaagttgttcccccaaagcgctgcatccaacggcgatgaggagggttacctcaggccggcccaaccagcccaccttttatcctgcggcctccctgacttcatctctccgcagacttatgaattttgggcattttgggtcttctgaaattgatattttcagcccatcttcctttaagtctgattctcggcatcgtctgattgatcgatcgagtgttttgatgcctattcttctccatttattgcttattctctacaagaggttagtaaaccaagtaatagtggattttattttattctaacactatatgcattgtaagcatgactagttctccttttattccggtaatattgacgggcgaaattgatcgataacgaccgtcaacagcgggcggcgccagaggagatgttgccgccattgacggcggacgatttgtgattttgtggttttttagatgatttgtgaatttgtggatgattttgttgtttagtatgttcattcgatctgtgacgtcaatttgatgtggggatttgggaatgtcggcaattagcaaaataaaaaacaatgaaaaaaagaaaaagagaagacctttagtcctggttggtgaatctttagtcccagttatttcaaccgagacaaaagatagatatctttagtcctgctttcagagtcccagtttgtaacccgggactaaagaggttgtaaaccgggagcaaagagggtatacccaacagtgtatagtactaaccagtgggtttagttaagttgcccgcatctctttcgataaaactgacatccagaaagtaaggcaagtgggggtaagcgtaagccaaaaacaagttacgtcaaagaaccaaagaagcacggcggtatcttcttctgttcacgcacatgcatttatgcatttccaactcgaatgtgtgccagtgccactcgcatatatcaaatcaacatattggctcgtccctccaattcgagacaatactacaacatctagaaaacaactttaaacattattttttattataatatatatgaaaacaataacaaataaatgatattattaaaatactttttaagactactctatacatataatctccatatttctaagataaatattttagaaattattatagataaagattttaaagtttgatcttatattctcatttgtgttcaaaacgaccagtattatttgtccggatgagtagtataattacttttagagtttaaatttatcttaaaaaatatagttatttcttctttatcttctcattacagtgaataataacaatctctcattgaatttctatacctactttctatttttaacaaatcataaacttctaaaatttatacacctattttctatttttaaccaatcaaaaccttccaatttaaaagtatttaagaatacttaaattttagtactgaggggagtagtctggtacccacactacctgcatgaaaataataataataaaaaactgatgccaccacactaccacagcaagtctggtacccacgctaccaactttctctaacttctactctctcgttttttatgcacatgttttccaaactgctaaacggtgtgtgttttataaaagttttctatagaaaagttacattaaaaaaatcatattaatttatttttcaagtttttaagactaatacttaattaatcacgtgctaatggacaaccccattttccgtggaattcaacctcccgaacgtagccctagttaacataccatcaagatttcagatcatctatctttggatatttgatcaagtaagaggagcagctaaattttataattttttttataaaatttggtgaaaaaagacgaaaaatttgcactcaatctgcagggcctatgccaatgtccaaagcttcacctttttttttataaaccagcttgatgttttatcattcttgaaaatgtatcagaagaaaattgaagataccaacaagaaacgaaacttactcttaacttcatttaaaattattaggaaaatatacaaaatatgatacagcactttccgaggaaccagagttgtcagagtcatggtctcatggagcctaattgatttgccaaccaccaaggcaccaacttgttaaattagtagagttcttctcactacgctaactcgctatgtccttaagatcttgactggtctctccgagtggcgacctgctgattcttcgagtagtagttttcgtattggcagtattgtccggccgctgattctgctcaaagaccggccatggccgccggcgtcctcatgacaaaaccgttcatggctgccgcttctgctctagcctgcttgctcgtcatgctgcgctgcttgcctagcgtcgtcgctaccacggtatctttcaactactccaccttcagcaacgcgaagaacatcaccctccagggcagcgcggcgttcgccggcggggggtgcatcgagatcaccaccggaagcaacctgccgagcagcggcaccatgggacgcgtggcgtacacgccgccggtgcagctctgggacgccgccaccggcgaggttgccagcttcaccacgcgcttctccttcaacatcactccgacgaatttggacaacaagggcgacgggatggccttcttcctcgtcggctacccgtcaaggatgccggacaagggcgacggtggcgccctcggcctcaccagccggtactttgacaccgtccagcccggcgagaaccggttcgtcgccgtcgaattcgacacttatctaaaccgcgacttcgaccccaacgcaacctacgaccacatcggcatcgacgtcaactccatcagatcggtgcagaccgagtcgctgcccagcttcagcctcaccgggaacatgaccgccattgtcgactacaacagcagctcgagcatcctgtcggcccagctggtgaagacatggacgaatggctcgactacactttacaaccttagcaccaccgtcgatctcaagagcgccttgccggagaaggtctccgtcggcatcttggcggcgacgggcttatcccttgagctccatcagctgcattcttggtacttcaactcctcgttccagcagaatccaccaccggcggtgcaacattccccgaccacctcaggttccggacttgccggagttatagctggagccaccgttggtgcagcactgttcgtcgtgctcctctttgccatggtagttgtccttgtgcggcgacgtcggagcaagaagagaagggaggtagaagaggcagaggaggcgagacacgtagggttggccagagatgacgatgatgacgatgacggtgagcccatcgtggagatcgagatgggcatggggccaaggcaaatcccataccaagacctcatcgaggcgacgaacagctttgcggcggaggagaagcttgggcaaggcggcttcggtgccgtgtacaggggatacctgagagagcagggcctcgccgtcgccattaagaggtttgctaaggattcctccaagcaagggaagaaagagtataggtcggagatcaaggtgataagccggttgcgccaccgcaatctggtgcagctcattggctggtgccatggccgcgacgagctcctactcatctatgaactcgtccccaaccgcagcctcgacattcacctccatggcaatggcaccttcctaacatggccgatgaggttagtacctgttctctttaacttcatctaaacttcctttgtgatgttaaattaattggcgtgttaaactcagctaacttggtcttaacttgtcacagggttaagattgttcttgggcttggatcagcactattctatctccatgaggagtgggaacagtgtgtcgtgcaccgtgacatcaagccgagcaatgtcatgctggatgagtaattcaatgccaagctaggcgacttcgggcttgcaaggttcatcgaccatgccgtggggatgcagacgatgaccgccgtctctgggacaccaggctatgttgatcctgaatgcgtgatcaccggtagagcaagcttagagtctgatgtttatagcttcggcattgtcttattggaagtggcatgcggaaggaggccaatgagcctacaagataaccagaagaatggcatcttccggttggtcgagtgggcctgggacctgtacggacaaggagatgttgtctcagcggctgatgagcggctcaacggtgattacgacgtgtcagagatggagcgtgtcatcgttgtggggctttggtgtgcgcatccagacccaagcgcatgaccatctatccgagcagccatggccatgctccagtctagtgggcaattaccggtgttacctgctaagatgcctgtgccaacatatgcgccgccagtggcctcagtggaggggctcttcacatcgtccactggaatgtcgtcctcaagtgcagcacaatcatcatcgacgaccagtggctacatcactcacacctcgagttcctctaacacatccacttcagctggttcaaaggactcgtcttcgttgctcaaacatcaatacttatgatgttcaattcatttgctttgttactaattttgacttgatgcttgaatgggatgtacaactcgtgagccattgattttccatttagagtagtctaattgccaatgtgagtaatgcatgtgcatttatgccatgatttaaattttactcccattttagtttttctagatagatttatcctgccattttctcttcaatgtctgactactataaagtgcataccttgcatgttttaagtgaatatcctagtccttagagggctgaattgtcgaagttggaagaactttaaaatgaaaaaaaaaaccaccaagagaagagaactcttacatacttcacatagtttgcatgttttcacttttcagtgaataacgcaaaggtgtaaacaacatgaactaaatataataagctaaattcaatagagatggaacatggcctctacagactatagacaatagtacaaagactgcttattttcagtagttcttatgcaattgtctcaaatcgtggatatttatgttggatacttcggtggtggaatcaagaacatccaagcaaaattgttaacactacaaaatagtaccagcatagtagttcactcactatgacctgtagattttcagctggttgttttgccctgtttttcagcttttcaaccaaaaggttgttctccccaaatcttaacgaaaattcgggcagcgctctttgtcagcctggcaaaacaaataataataaattagacattcatgcaagaaacatgtcatccaggattgacaactctgctacctcacggatcgatcaagtcaaatttggaaataaaagagttggttatgataggttcagcaatgggtttgctgctgcaaaattctcaacagaatctgatagaacaacccattggaccctactccttccagaagaaaggaaagatctggaaacattatatgatggcacagtagctagtgacccattctctttcacattatgtccttagccatgatcaaacgcgcttggtcaaaccaaccagtaccaggatgattgacagaagagtaacgagaacgaattttgacaaagagaaacagctccagtgatttacgcattcgaaattaaaaactacaatagttacagcaatttttcatctataaaagtccatgcatagcctcttttgaatgtccaagttagctattcaacattgatgcaggattgtgcttacctaaaattaagttgaagcccttacattcttttgttgaagggacatcagaaaacgttaagaggctaaactaataaatacgaagatacccaaccttagaggaaagttagtgttggacaccaaattgggcatttatcacatctaaattatctcacgaaaaaacaatttttttcacattggacaaaacaaaaaaacagcagtactattgtgaccaatcaaccacaagcatttttcacattaagttgaggttatgaggtaacggatgcaaaaccctcatctagtcacctattggaagaggaagctccggtagggacagtcggcggcgatgcactgtcgcagcctagcgtcctccgccgggcggtgcagcatcgtcagagaatccgctctcaccgccggcgtgaagtgcctgacaaggtcccgccattttggaattaggatagttcccttccagacctagctagcagcaacaacacctgcggaggcgggaggcgtggaggagctacaggatacttcgccaaccggaacttgctcatcaccggagatctcggtcggcgcgcggccgacgaccagagctatgcggcagcggcggcgacgcggtagaatacgcttcagttgcggaaagaagaaaaagcttaaaccgaggatggctatagttgggccgtgcaacgtccggataacattttattggggaataagtccaccggaggcgagactttttgagatcccttaaccacaaaaccagaaatgtgtatccctaaactcacacaaaccgtgcactcaaggtcctatggcagtatatatgggtggtttcgctgacgtggcatcctagtcagcaaaaaaaattaaaaaagtacgtggagcccacatgctagctacacatttttttttcttctcttttcttcttcttcttcttcagtaaggaaggccggcgggcggctgccctgcgtggcagtggagcggcgccgagatgcgggcagagcggcaatgagcggcggtgggcgagcagaagagcatgacgacagtgtggccgccgtgcgcgatgttgatgctgttgatgtggtagtagtcggagatggtggacttcatggtggtctcacagaagatgttctcgctgcggcgggcgcccttgccggacttcatgtggaggaggtgcgggcccgccgccgcccatcaccgcttcccccgccgcggcgctcgcctgctgcccgcccatcgccgctccgcccgccgcccgctggcctccctcactgaagaagaagagaagagagaagagagaagagagaaaaaagaagagaagaagaagaaaagataagaaaaaagatgtgcagatgacatgtggcccctacatactttttttaattttttttgctgactaggataccacgtcagcgaaaccacccatatatactgtcataggaccttgagtgcatggtttgtgtgagtttaggctatatatttctggttttgtggttaagggacctcaaaaaaatctcgctgttaagttgagggacctccggtgaacttattccttttattggactaactcaagtcctaaaatgggcttaggccaaagtttttgaagagcgggggagtatgttgggacccccgtgggggtgggacaagtctattttttgtcggagccatgtagctcggaggcaccgttggatctggcatgggaggatgacgatgcagaggaatggggaaggggagagtgaactggggaggcctcaggtgagcattgctgcctccttcttgtggatgagctaatgtggtaaggttgggatgacggatcggtggtggagctcacggaggaggagcaaggcaacagtgcagctctccgatgatcgcaccagtgttgttgtccccatcttcgttgtgaggatggcatctcatccttgcccacgttggctcgagtgctggccatctcgagctcgctacagagggcggtttcagtgatgtggatatggggaaacaacacacggcatcgctcgagacccctatgtcatgggcctattgggtccactaggttttttgtttttaaaatttttcaactcaatgacatgcgggtcccattaagtttttattctattattttagtgccatgtaggatgaacaattccacatagacacatgtgatcttcgctaccgccgttgtgtcatcgccaccgaagcctcggaactcccgaggccgacattgccatcgacgagctcccaagtgccagatccatgtctttgtcatcactgccgaggtcccaagcgccggatccgacgccgttgtcggcatcgctgccagatgtccctacagctcccgaggccagcactgccagggagctcctgagcgccagattcattgttgttgtcatcgctgccgaggttccgagcgctagatttgcctccgctgagtttctgagcgccggatccgccagttcccaagctcctagctcgcacctgccgtcgccgctgccagaagctcatcaacgcctttgcaagcccgtcaccccgctccggccatagtcatcttcgccggcggatctagagggggagaagtagatgcggagaaaagctaagtgagagagggagagagaaggagaggagagtggatcggggtaggggaatggttataaagaagagggttggctagaaagttgtttttgcattcaggtctcttaagtggctcgcatttgataatcgatttcttcatgtgggtctcaaccaaatagcatccaaatatttttatatgcggatgttttcttggcccgcttgaaactaagggcccctttgatttggaggaaaaacataggaattttagaggatttcaattttatcggaaaattttctatgaagccctttaaaacaaatgattgaatcctatccaatcctctgaaatttctatagaatggacaatcctatagagattttggaggaaatttagcaagagcttcaacctcttggtaactttcctttgagtctacatctctcattcaattcctacgtttttcctgcggttcattcaaacggtcattcctgtgtttttcctgcgttttgcaatcctctgttttacacttacattcctatcaaaatcttacgttttttctatttctacgttttctcaatcctacgattcaaaggggccctaaatagggggtgcctcaataaaagtcattttcgtagtagtgaacctttccgtcttcaagtgattttctcttcagtttcctaagtaacccagattatcatgtagattcaaaggcacataaattacagaattcagaaaatgaagcagagtagctttaagattctcactagctaaagctgcttcttaaacctccagctctttaaacagagccattgacttggtgctccaagctagagctcagcatttcggtcttcagtcccatatgaccaacaaacaatcgatcgttgactcaacgcaatctcttctgaccccgacggtcgaaaactatggccggagcacagaaagaagtaattcaatgccaatttggcacaattaatacaagtggaagaacaaatattaccaataaatcaacggcaagattgtgttacaattccttgttagaccgagccggcttctcgagtctctgtttgctagtggtggctggcaccagctgctcgagtgatatcgtggacatcagttgaacaggctaatgggtagtagaggtgatccatccacctgtgtattaattactaaaaccattggattgttacccattttatcctttatttaatgagaaagttcttgaccatttatgtcaaaacgaagtccatgacgaacattattaaataaaaagagattaattatgtggcatcacttgtagtgttgctgttaggctcattgttttgtgagtagcaattcttgttaccatttcttcaaactagttttgatgtcacatgagaatgatattgccaatttatttaagttttaatttttttactatcatccttcagtagcaccactaccaccatatagttgttttgtgatacatctcggtctctcaactcttagaggcatgtggcaatgtttcttgaatgttatcgaaaaagttaagaaaaacaaaagctgacaacgtagattaggtttctatcaataacacacaaaaaaaagcagaccataaaaaatacaattggatttggattcacgcactaagggcaaaacaacatcggtggaagggagaggaggaggacgcgacaaagagccactagcaggttcgccaaagattcctccaagcaagggaagaaagagtatatgtcggagatcaaggtgataagccggttgtgctaccacaatctagtgcagctcatcgggtggtgccatggccgcgacgagctcctactcgtctacgaactcgtccccaaccgcagcctcgacatccagctccatggcaatggcaccttcctgacatggccaatgaggttagtaactgtcctctctaacttcatctcaacttcctttgtgatgttaaattaatcggtgtattaactcagctaagatggttttaacttgtcacagggttaagattgttcttgggcttggatcagcactgttcaatctccatgaggagtgggaacattgcgttgtgcatcgcgacatcaagccgagcaatgtcatactggatgagtctttcaatgccaagctaggcgacttcgggcttgcaaggttcatcgaccatgccatggggatgcagacgatgaccgccgtctttgggacaccaggctatgctgatcctgaatgcgtgatcaccggtagagcaacctcagagtctgatgtttatagctttggctttgtcctattggaagtggcatgcggaaggaggccaatgagcctacaagataaccaaaagaatggcatcttctggttggtcgagtgggcatgggacctgtatggacaaggagatgttgtctcagcggctgatgagcggctcaacggtggttacgacgtgtcggagttggagcatgtcatcattgtggggctttggtgtgtgcatccagacccaagcgcacgaccatctatcagaaccgccatggccatgttccagtctagtgggcaactactggtgttacctgctaagatgcttgtgccaacatatttttagataatagaatttaacattccgacctttgcttaaaaagagctacaaccaattattacaaagtagcactctagaaaagagtgtaggggaggggctcagtggaggggctcttcacatcgtccactaggcgctgccggtgaccttagtggaggggctcttcacatcatccactagaatgtcgtcctcaagtacatgcaacacaatcatcatcaacgaccagtggctacatcactcacacctcgagttcctctaacacatccacttcagctggttcaaaggactcgtcttcgttgctcaaacatcaatacttatgatgttcaattcatttgatttgttactaattttgacttgatgcttgaatggatgtacaacgcatgaaccattgattttccttttagagtagtctaattgccaacgtgagtaatgtatgtgcatttatgccatgatttaaattttactcctattttagtttttctagacagatccattgacttggtgctccaaactagagctcagcactttggtcttcggttccatatgaccaacaacacaaaaatagcaactcgtattgataacaatcgatcgttgactcaacgcaatctcttctgaccccgacggtcgaaaactatggccggaatacagaagaagcaaatcaatgctaatttggcacaattactatacgtggaagaactaaataatactccctccttccctaaattttgacgttgttgatttttttaaatatgtttgaccgttcatcttattcaaaaacttttgtgaaatatgtaaaactatatgtatacataaaaatatatttaacaataaatcaaatcataggaaaagaattaataattacttaaattttttgaataagacgaacgatcaaacatactacctatatattttaatgtatgacaccgttgactttttaaccaacgtttgaccattcgtcttattcaaaaaatttatgtaatcatcatttattttactgtgacttgatttatcatcacatattctttaagcatgacctaaatattttatatttgcataaaaattttgaataagacgaatggtcaaatgttattcgaaaagtcaatggcgtcatacattaaaatacggagggagtatttaaaaaagtaaacggcgtcaaacattttgagatggatggagtataaccaataaatgaatggcaagcgtgtgctacaattctttgttagacgagccggccgtcttctcgagtctctgtgtgctagtggtggcatcagctgctcgagtgagttatcgtggacatcagctaaataggggtgatctgtccacctgtgtattaataattaaaaccattggattgttacccattttaagttcttgaccatttatctcaaaacgaagtacttgacgaaagagagattaattatgtggcatcacttgtagcgttgttgtcagtctcattgtttagtgagtggcaattcttatgaccatttgttcaaactatttttgatgtcacaaggttggagacctatttctggacatcaccttaccgggggaatgagaatgctattgccaatttatttacgtttttaactatcgtgcttgataggcaccactaccacaataacgtttctagcttgaatgtgatcgaaatagttaagaaaaacaaaagctgacaacgtagattcactagaacgggattggatatctctaacgggcttaaagcatcatctctttcgggcagggagcaaaggtcagtaataagaaaatatctcaatcgggcatccggccgtcacggatgacacatctcaatcaagccaacataaaagcccgtcatggatgactctcatctctaacgggcctagattatagcccgtcacggatgactctcatctctaacgggtctagattatagcccgtcacagatgagtataattcaaaaaaaaataaattttgtttttttgttagcctaaggcctttgccctcactagtgtgccttcctggtcggtcaccaatccagactcgtgtgcacccaggatgaattttccagtcggtcacccatcccgtttaacctcacagttctttggagattggcttccgagaaagaaattgtaatttgttggtatgagtattctattaatcctattaagcactgggccaggatgtcacaccctagcatcgcctattcatatacattcattcacataacacaaccacattcacataacatccattttgatcacatatttcaccagcgaatctgagttaattggatcaaatatatatttagcaagtattatcatgagtaggaggcaaatcagacttttaagaaaaaatgaatttcgaattgaattttatgatactaaatgaactcatatgaaaaagctatcaaaaacaaagttgtagaacacattgagatctaccatttttattttggtcatttcaccatccgggtttgattgaactatataaattttgtattttaaaatataagaaattcaaatattttttcgggtagtaaatgatttcaaatggaaaaattgtcaacaacaaagttgtataactcatcaagatctataacttttattttggttatttttctatataacgtctttttaacagtttgaatttgaatttaaaaatatgacaacttcaaataatattttcaaataataaatgatttcaactgaaaaagtcatcaacaacaaagttgtataactcatcaatatctataacttttattttgttcatttttctatacaacatttttttaacagtttgaatttgaatttgaaaatatgacaaactcaaacaacattttcaaatactaaatgatttcaactgaaaaagtcatcaacaacaaagttgtataactcaccaaaatctataacttttattttggtcattttttcatccgacaaagtgatagtaacattgttcacaaaattcacatatctctcatctagttttataaactataatacagatatgtaaattttgtaaacaatcttactaacactttatcggatgaagaaatgttaaaaataaaagttatagatcttgatgagttatacaactttgttgttgatgattttttcagttgaaatcatttagtatttaaaaatgttgtttgaagttgtcatattttcaaatttaaattcaaactgttcaaaaaatgttatatagaaaaatgagcaaaataaaagttatagatcttgatgagttatataactttgttgttgatgaccttttcagttgaaatcattaagtatttgaaaatgttgtttgaagttgtcatattttcaaatttaaattcaaattcaaactgttaaaaatatgttatattgaaaaatgaccaaaataaaagttatctctaacaggcatcaacaaaagcccgacaccgatatgagtcatcggtgacgggctttaaaatcatctcaatcgggccatatttggagcccgtcaccgatgaccctcatctctgacgggctcggtgtctgggcccgattgagatgtgcgaggtcatctcaatcgggcctaaatctttgcccgtcacagatgagtgtcatcggtgacgggctatatgtacttgggcctagagtgagtacatctacaacggtgcaaatttaccgattaagatgacttcgttctgacggtccaagtagtccaggcataattgagcccgtcacagattctaggatcggtactagtgattagttttcaatctacatacatgtaaagtcaaattcatctaaccaaaacaaaaacagaccataaaaaatacaattggatgtgggttaacgcactacaacagatcagcttcctagacagattctctgtgacaaatggggaatccgtcattgatttgtgatgaattcacaaaaagaaaatcattgtaaagttcaccttcagcctatcctagcgacggttggaggtcttccccacgacgaacaagattgtcacgaaatgatggtgatttcgtcgttagcagttgggctatcatatattaaaattgttaggggtatttttgtttctcaatctagagatagatattaatttgacccactttttatgatatcaatcactttaaggagtttataaccggacaaaatttgctctaggtcattctagaattgtgacatttatcctaggataatataattatgcggctcgccgtatgatggtctagttttgcgtctctttgccaagacacactttagcctttgttttgacatatactcttcaaatgaatttctaaaagaagagattgcccgaagacctaccaggcaggcctgagggcagtttcatcttttcaaaagttttctcttcccaattgaagaggataggttaaaagaagtggctatatatctaacttttgacagataactatgtaacacctatgtaaattaaaacttgcgttgtaacacaatcggagaggtggagagcatatgccccctagctggcatggcatcacgatttcgacgcctggtcacagagcactccatcaactttttattcctgatcatgcgcacaaatctccaggccaatccaacggaagaaaatttgaaagtttttcctccacttttcttaacatagtaaaatagtaagttcttttggcaaaagaccacaagtccataaaacaaagtgtattttggcaaaagaccacaatcccgtgacaaccgtaaactatagtgccttagaacaaattttgccttaggctataagccaactaactatatctaaatgtggagcagagagatgaaaaaaagtgttagctctcatgtaagagctagctctacacagtacacagctataagataaacacattaaatatataatgagacaaagaaaggataagaaaagcatagataataaaataacttgtctatttatatatgttaggtctaatactattttaagatggacttacttagcttatgactttgtatcataaggaccaaacgagtattacatagcttaatatccacatcatctgcttacctctttgttttgacgtactcttctttcgtcacgtatttacaggctgttaccctagcgcgagcggatccaaatccgtccaaagtcattggttaagttcgatcaccagcgagtaaatagttccatcaacttcgcttgtatcatcgtgattaaactttctcggataagtatgatattttattaaggttgatgtaagcgatacctatatgatatattgattctatttttaactgcatcactatttagagtcgtattggcttagttaggactttctcggtttttatgcaatgtttcatcggagttctagtcgatgagttatcttgttactacttctaaatgttgtattggcttatactcaaactcgcataatcactagttaaatctctttttatgaactttacccttatactatttcggtttggtctgatctatcaagattgtttttataaagaacagtttattcataattatgcatagtttagttatggccaataatagcacgaattttattgtttgtctgattattatgtgaatctcaattgagcctatagctgattgatcaaaaccctatcatatcggctggcctagccacatcccattggcttactggctaattggcaccttgatcatcgatctattcaaactaactggcacatccttaactcgattgataggaccggcactggacctaagcagatctctcaggtctttgttgttgggaatagtcccacattgcttatctagggggagttgaaccaacttaaaaatggggggagtccttcacctcttgagctagcttttggggtgtagcaaggctttctcctggttgggccaacgtctcccggttttgggccaacaagtggtatcagagccaaacccacaatctctagtgcttgtgcacactcagggtggtgtaagcccaaagcccagtggaccgcgggtgtgaggcccgtatgtgcctgtgtgtggggccggtcagggctaaggggcaccaatgtgtgaccacaatctctagtgcttgtgcacactcagggtggtgtaagcctaaagcccagtggaccgcgggtgtgaggcccgtatgtgcctgtgtgtggggccggtcagggctaaggggcaccaatgtgtgatgggggagattgttgggaatagtcccacattgcttatctagggggagttgaaccaacttaaaagtggggggaacccttcacctcttgagctagctttttgggtgtagcaagactttctccccgttgggccaacgtctcccagttttgggccaacatttgtgtgtgcaacagttagctagcccatgcatcgtagcgcatgagccaactcatgtgtttgaacccccccccctccccccaaagcgcatgatgcaattttttttaaaaaagaattagcaaatccttaaaataatagctaaagtgtgttttgacaaatgatcacaatcaaataaggagtgttatctctcattcaaaaggtagctctacaaatatataggatgaatgcattaaatacataactgagacaaagagagaataagaaaagtagagacttgtctgttacgtactcccttcgtcccaaaataagccaatctcgaactatatatatgtctagattcagtatagtccgatatatgtactttgaggttggcttattttggaatggaggaggtatgttagatctaatgctatttttagatgaacttagttagcttatgactttgtatcataccacatcatctgcttacctgtgttttgtcgtactcttcttttgtcatgtatttactggctggcgcaagcgcgggtccaatccgtccaaaggtaaaaatggcggggggctgatcggttactttaaatccgtactccagactgcattgtcacgtaggaaggctcccgagcattgtctctcatttctccccagctagtcacgccgatcagtactggtagtctatcactagctagctatatcgttgtcacccttgcgcgccgatcgacgccggcggtgatggccggcttttctttgatcagttgcgctgtgggtatcatcttcttctccgtttgctacctgcctgcggctcctgccgccgccttgtccttcaactactccaccttcagctcggacaaccaggaggacttcacattcgaaggcaacgcctccatccacgacgggtgtattgatttcgttgcgaacgggacctggggcaggggctacaggccctacagcaccggacgggtgtcctacaaattgccggtgcggctctgggacgctgccaccggcgaggtggccagcttcaccacaaccttctccttcaacatcacgccgatgaatattagcgacaagggcgatggcatggccttctttctcgtcagctatccatcaaggatgccgctgaccgccgacggcgacactctcggcctcgtgagcaacaaacccgaaaacgctccggccggcggcgaccaattcgtcgccgtcgagtttgacacctacccaaaccccggcttggaccctaacgctaccggtgaccacatcggcatcgacatcaactcagtccgatcgttgacgaccgaacccttgaccaactccagcctcatcggtaacatgaccgccatcgtccactacgatagcagttcgagcatcctgtcggtgaagctgtggataaatgacacgacgaagccgccttacaaccttagctacgaaattgttgatctcaagaaaaaattgccggagaacgtcaccatcggcttctcggcggcaacgggcgcatcagatgagctacaccagctgacttcttggtacttcaactcgagctcgtcgttcgagcataagcatggacgtgccggggttgtagcgggagccaccgtcggcgcgacgttgttcgttgtgctgctcttcactgctgcagctatcctcatacggcgacgtcggatcaaaaacaggaaggaggcagaggatgagcaggacataagctcggacagcgaagacaatgacggcgagcccatcgtggagattgagatggggactgcgccaaggcgattgccatactatgagctcgtcgaggcgaccaagaacttcgcggtggaggagaagctcgggcaaggcggcttcggttcggtgtaccgaggctacctaagagagcagggcctcgccgtcgccattaaacgcttcgccaaagattcctccaagcaagggaggaaggagtataagtcggagatcaaggtgataagccggctgcgccaccgcaatctcgtgcagctcgtcggctggtgccatggacgcaacgagctcctccttgtctatgagctcgtccccaaccgcagtcttgacgtccatctccatggcaatggcaccttccttacttggccaatgaggttattaattatccgtgctaactttctcatctcaactgcttcgatgagtgtcaaatctaattctatttttatcttgcttaattggttgtttccacaggatcaagattgttctcgggctcggatcagcactactctacctccaccaagagtgggaacaatgtgtcgtgcaccgtgacatcaaaccaagcaacgtcatgttggatgaatccttcagtgccaagctaggtgacttcgggctcgcgaggctcatcgaccacaccatcggtataaagacaatgaccgccatgtcaggaacaccgggctaccttgaccctgaatgtgtgatcaccggtagagcgagtgccgagtcctacgtttacagtttcggcattgtcctactggaggtggcatgcgggaggagaccgatgagcctactagacagccagaataacggcgtcttccgactggttgagtgggcctgggatttgtatggcaagggagatgttctcatggccgccgacaagcgtctcgacggcgactacgattctgcggagatggagcgtgtcatcgctctcgggctctggtgcgtgcaccctgacccaagtgtgcgaccgtctatcagagacgccatggccatactccagtcgagtggaggccaactgccagtgctatcggccaagatgcccgtgccaatgtacgcgccgccgatggcctcgtttgacgggctagctgtttgcgtcatctacagggatgtcgtcgtcctcaggtgtgacgcagtcgtcgtccacatcgacgacgagcggccatgctattcacacctcgtgttcctcggtttcctccgattcaaccggttcgaaggactcgtcttcattgctcaagcatcagtgctagtgtttagtgtttgttttttaatttgcttgttcttagtttagagttgatttggtctttggtgttgcctaattgccgatttgagtaatgtatgtgtatttaggccatgatttgagtaatgtatgtgtacttatgccatgaatcttatggcactgtagtttctctagaaagatctgtccggccattttctgttccagcattagaataagtcgagtgagggacatgggcaacgatagtagctactgcagcagcactacaattgaggcgaatcaaacgatcggcccattacaattgaaggggtggtcgccatcctcctcatgggccattgcctacagaacgaattgggttgggacacagccgctaggaaaagcctgatctacatgcctatccccaatgcattaaatcaactttacatcccttatgtttccatcgagtttaaatcgcatctctgaaccgcaatacaagaagtctagacccacaacttgtaaaactaacttaaattaggttcttcggcgatatagataggtgatttcgctgataaatataaaaaaatgcatacctaactctaaggctataaatagacccctccaagagaacatatattgtaagtgagtttcaataaatatatttactttctttgtgtacacttagaaaccactgtttgtcctcttagacaacaccatgaaaattcagaaaatgtgcaatattgtatttttatcaatcctaatttcagaaaaatcctttatcaagaaaatgttggaattaatggatgggccttagcccactcgaagattaattctttggaaaatcacaaaagctcacctcatgagatggcatgcgtgtggagtttagtaccaccttgcttattttaggagaaggggaccttcttaaaagggaggatgccctcctagccacttgaagcatgtgtggtggagagaagagggggaacacacgcgcgcgctcgctcgccgggcagggcaggcggcgcgcgtgcacgacgtacgcgtcgaatggtccgcaaaattggctcctcacccttgcgcagatgcagcctccttttgcagttttgttttgctgcaagaaaattcggatttgttttgttgtaggaaacattccgaaaaatccggtgcgtgaaaacggcgtggagtccagataagttacgcgcgacttatccggttcggttacgcggagtggagatcgtgcgggcgccctgatcaagcgacctatctctatataaaccgagccgctgccttcacgcaacacacgtgaaatcaatctagggtttgcctcctcctctgtgttgtgccgtcgctcgtagactactccatcccgatcgtcagcgtgcaccggcaatcgggagagcaggtctccggaacctctgccttcgacgtcctgcaccgggagaaggcggcaataaggtttttgggaagcgctccgcgcgactgctctctgtttgttcgcgacggctcgccttcctctccgctcgcgtgctgcacgccttcgtcgacgctcgcaacagcgagtagttcctgccgagcaaccggtctttccgccacctcggtacgtgttcgacatgttgcgcatatttgatctgttcatgttttactgcttagtttacatgtgtagatctaatgatgtgttactgctagtatacatctgcaatgttatgatttatttatggaatatattaaatcattatatgcctatattctcaacaatccaaaaaccttattataggcgctgtgattttactatggctggttttgccgatgcactgaggccggataaattcaccggtgtgcactttaagagatggcagatcagggtcgctttgtggctgacagctatgaaatgcttctgggtgagtactggtaaacctgaaggaattcttgctgctgatcagcataagcaattcgagaaagccactactctctttgtgggatgcattcttagcgttcttggcaatcgtctggtcgaggtgtatatgcacatgaccaacgctaaggagttgtgggatgcactgaatactaaattcggtgctactgatgctagcaatgatctgtacatcatggagcagtttcatgactacaggatggctgacaaccgttctgtagtcgaacaggctcatgaggtacaaaccatggctaaggaactcgaactccttaagtgtgtcttacccgacaaatttgtggccgggtgcattattgcgaaactacctctatcttggagaagtttcggtactgcactcaaatacaagagacaggaatactccgttgaggggttgatagtgtctcttgatgttgaggagaaagctcgggaaaaggacgccgcgtctaagggcgacggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtagccaacctagtcatctggctaggaagtgtccacagcgcaaggggatgaaggcacctgcagggcagacttctaagtctgctaatgtgaccattggcaacactggagatggaagcgggtatggtaatttacctacagttttttcagttaatcaatctactaattagtgggttgatactggggctaatgtacatgtttgtgtgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgataggaatcttgttagtggctcccgtctgactagagacggatttaagttggtttttgagtctaataaagtagtcgtgtctaaacatggatattttattggtaaaggttatgagtgcggaggcttgttccgtttttccctttctgatttctgcaataagtctgtgaatcatatttgtggcagtgtggatgatgaggctaatgtatggcactcacgtttatgtcatattaattttggcttgatgtctcggctttccagcatgtgtttaattcctaagttttccattgtcaaaggtt

SEQ ID NO: 15668 - DNA, 1468 bp, Oryza sativa
cctgcagcccatatttcatgacgttgattgatgatgctactagatttttctatgtgtacttgttgaaaacgaaagacgaggctctagactattttaaaacttataaggcagaagttgaaaatcaacttgacagaaagataaaaagacttaggtctgatcgtggtggagagtttttctcaaacgagtttgacttattctgtgaggaacatggcattatacatgagaggacgcctccctattctcccgagtctaatgggattgccgaaaggaataaccgcacactgactgacttggtgaatgccatgttggacaccgcgggactacctaaggcatggtggggggaggcattgttgacctcgaatcatgtgttaaacagagttcctaacagaaataaggacaaaacaccatatgagatatggattgggagaaaaccatcactttcttacttgcgcacatgggggtgcttggcgaaagtcaatgtactaataacgaagaagcgcaaacttggacctaagactgtggactgtgtctttctgggatatgctcatcacaacattgcctatagatttttaatagttaaatctgaggtaccagacatgcatgttggtacaattatggagtctcgtgatgctaccttctttgagagttttttcccaatgaaggatacacatagtagttctagccaaccctgtgaaataattcccagttcaatcacaccaccagaacaaactgaacatacacatgaacatgtcactgaggaggatgacagtgaagctcctcgaaggagcaaaagacaaaggacggctaagtcttttggtgatgatttcactgtgtacctcgtggatgacactcctaagtcaatttcagaagtatatgcatctcctgatgcagactactggaaggaggctgtccgtagtgaaatggattccattatcgctaatggaacttgggaggtgacagagcgaccctatgggtgtaaacctgtggggtgcaagtgggtgttcaaaaagaagctgaggcctgatggtaccattgaaaagtacaaggctcggcttgttgctaagggctatacttagaaagaaggcgaagatttctttgacacttactcacctgttgtcagattgaccacaattcgtgtgctactttccctagcagcctcacatggtcttctcgttcatcaaatggacgttaagacaacttttcttaatggagagctggatgaggagatctatatggatcaacctgataggtttgtagttgaaggtcaagaagacaaggtgtgcaaattgttgaagtctttgtatggtctgaaacaagctcctaagcaatgccatgagaaatttgatagaacattgacatctgtaggcttcgcagtcaatgaggcagataaatgtgtatactatcgccatggtgggggtgaaagagtcattctgtgcttgtatgttcatgacatactgatatttgggac

SEQ ID NO: 15669 - DNA, 16540 bp, Oryza sativa
ttcttgtctcaaaaatttgatatgaaggatttgggagtagctgatgttatcctaaacattaagctaattagaggtgagaatgggattacactcttgcagtcccattatgtggagaagatcttgaatcgttttggctacattgacagtaagccttctccaatatcttatgatcctagcttgttgcttcgcaagaacaagagaattgctaggaatcaattggaatactcccaaatcattggctcgctgatgtacctggctagtgcaactagcctgatatctcctttgctgtgagcaagttgagccggtttacctctaatccaggagatgatcactggcgtgcgcttgagcgagtaatgcgctatctgaaacgtactatggaattggggcttcactattctgggtatcctgcggtactggaaggatatagtgattctaactggatctctgatgtggatgagatcaaagccactagtggatatgtcttcacactaggtggtggtgctgtttcgtggaggtcttgcaagcagaccattttgacgaggtcaaccatggaagcagagctgacgtgtcacaccctgaaaattcaaaatttataaattgttgtttaattggaatttttagaaataattttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaaccgctctctctctctccctcggcccaagccggcccagtccgtccgcgcgcgcgccctcgctgccgctgacaggtggggcccacctgtcaggcccgtcgtcttcctccggccgaaaccctagcgcgccgccgccgccgccgctttccaatccggccgttcctttccttctccggtcgaattgattgaggggaaacaatctccgggatctcctctaccttttctcctttggaatctttggctaaatcgttttggaaagcgttggattcgagtttgtctcggattcattcttcccgatctttccttcctcgtcgtcggccgccgtgggcctttgccgccgcctccgagcccctttaaaagcctccccggtgtctcctctacccgccgccacccttgccttcgcctctcgtcgtctgaatcgttctagcgccgtgtgccctagctttgccgtcgccgccgccgctccagccgtgcgccgccgttgtttcagccatcgccgtcgctcgggaagaccgccgtcgtggtcgccaagtcgtcgccgtcctcgtccgccccttcgctgtcgccggagatcgccggagcttcatcgccgccgtcgacccgaaggtttcctccgtttcctcctcgtcgccgtcgccgtccgttgatcttccgccgccgttttggtcaccggtgagttcgccgtgtcgtcctctacgtgctggtggcctccgtttgcgtcctagtgccgccgttcgccggcgagcgtgcgccgcccgagctgtccgctccgccgagcccccgccgctgtcggtgacgtcattgccgacgtcatcggggtcgtccgccgtgagccggtcgtggaccgttcgatctcggccgtccgttttggattggatcgatctcggccgtccgtccgcgtgaaccgccgcccgtgcgcccggtccaccgaaaccctagcccgctgacgcaataaaccttcttttccttttcaaaaataattcattattgcgtcataattcaatttaaaccgatataagtgtccttttcaaaaatatccacatgtactgttcatgcttatttatgtgttgttttggtgattttgctcttttctgtttagattccgtcgtttccggagagtccgttttcgccggagaagaatttgaagagttccaaggccagcaaggcaagtcacacatatcccaaacaaccctttgagcatgttgatcctatttaaagctattgtttcttttcaactattgcatttattttcgaatgtcattgggtggaattaacctattgtttgttatagcccttttgttcttgattactttattccttgataccttgggttataataatttgactggttgaactttatttatattggttcaactagatattagaaataattgcttagccctgcttagaaacattagcacactattgggataactcatgattcactattatttcgtgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatagttcattgcggggcaccagactgagaagtggcggagataagcccacgggggtcgctggggagtccatgccttgtttataaggggtgattatgatctaggaaggtgcactgcagtggattgtgttgtatgcggggtattgtcacaactcctttccgaggtatcgtggtggtattgaggcacatggtgacatgatgtggggttgtgtcttgtgggtacagtggtacacctctgatcagagtaaaactattcgaatagccgtgcccgcggttatgggcgggtctaacaatgtctttcatgattagtttcacacttctcaccatagtaaatgatgctttaactggtaataatttgattagctcctggtttggaatggtatattcctggtttggagatagaactgtgcagccgggatggttgttcagaatggttgggcctatacaacagggtacgttgtatagcgttggattaatattgttttgttacttaactgttttattaaattctcaaaggtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggagtagccttggtcaagctgcctgtggagtggagccgtctgcgccgtttatttcattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatgacggcactggatactgctactgttgaggcagaatggctgcgtgatcttttaatggatctgcctattgttaaaaaaccggtgccggctatccttatgaactgtgacaatcaaacggtaattgtcaaagtgaatagttctaaggataatatgaaatcgtctagaaccgtgaaaagacgattgaagtctgtcaggaaattgagaaactccggggttataacgttggattacatccaaacagctagaaacctggcagatcccttcacgaagggactatcacgaaatgtggagtccagataagttacgcgcgacttatccggttcggttacgcggagtggagatcgtgcgggcgccctgatcaagcgacctatctctatataaaccgagccgccgccttcacgcaacacacgtgaaatcaatctagggtttgcctcctcctctgtgttgcaccgtcgctcgtagactactccatcccgatcgtcagcgtgcaccggcgatcgggagagcaggtctctggaacctctgccttcgacgtcctgcaccaggagaaggcggcaataaggtttttgggaagcgctccgcgcgactgctctctgtttgttcgcgacggctcgccttcctctccactcgcgtgctgcgcgccttcatcgacgctcgcaacagcgagtagttcctgccgagcaaccggtctttccgccacctcggtacgtgttcgacatgttgcgcatatttgatctgttcatgttttactgcttagtttacatgtgtaaatctaatgatgcgttactgctagtatacatctgcaacgttatgatttatttatggaatatattaaatcattatatgcctatattctcaacagaaaaatactaaaaaagtaagacatcataacaagtacaactcagtattattaatttaaagctttatattatttaaaaacaacattatattcagtaatttcgaagtgtatattaacttaaggaaatactagaaagaaagtaagggattaaaagtattagattttattctgtatacctatgatattgtaattaccaatttcaaaaattcaaaactatcggtttcattcttaagcacttaaaagcaaagtataaacacttatgcagaacatacatataatactgttgcaaatatatgtactaaccagtgggtttagttaaggccttgtttagttcccaatttttttccctatagaatagctaatatggtccctaaaatttcgttcctgggtcattttagtccttaatcttttatattattcaaacaagtcctttaaatttgtcacgtgggctgatatagtcctcggtcccacaaaaaattgccacatggacataccatgttaccctcctatgcaaaatctgtatgatttgtccaatttatccttatatatatcataggagaataaaaaaaggaaaaaaagtttatatatatatatatataccccatatatatatatatatatatggggtatatgtaagagaaaaatatacgtcaaaagggtgaaaaaaatggaaaagtatttttttcctatggttatgtctaattcacccttacatttatttttctatgatatacgtaagggtaaattggacaattcatcatagattttgcatgaatgatgacatggcattccatatgatgattttggtggacccaaggattattctaggccttatgacaaagtttaagggtttctttggaccatttaaaaggttagagattaaactgatcttacagagaaactttagggactatagtagctattctccctttttttttcccaaaacatcacattgaatctttggacacatgtatggagcattaaatatagataaaatgaaaaactaattgcacagtttgcatggaaatcgcgagacgaatcttttgagcctaattagtccatgattagccataagtgctatagtaacccacatgtgctaataacggattaattagtattaataaattcatctcgcggtttccaggcgagttatgaaattaatttttttattcttatccaaaacctcttccaatattcagtcaaactttcgatgtggcatccaaaaattttatctatatataacactaacacccagaaagtaaggcaagtggggtaagcgtaagccaaaacaagtcacgtcaaagaacctaagaagcacggcagtaccttcttctgttcatgcagatgcatttatgcatttccaactcgaatgtgtgccactgccagtgccactagcatatatcaaatcaacatattggctcgttcctcgaattcgagacaatcattgtactccaatcgctagaaaacaactttaaacactatttttattataatatatatatatataaacaataacaagtacattttaagactactctctatatatagtcccatatttttaagataaatattttagaaattattatagttgaagattctaaagtttgatctctttcatgtaaaaaacgacaagtattattaccccggatgagtagtataattacttttagagtttaaatttatcttaaaaattatagttatttcttttttttatcttctcatctcaacgaataataacagtctctcattgaatttgtatacctactttctatttttaacaaatcataaacttccaaaatttgtacacctattttctaatttctaccaataaaaaacttccaataatttatttaaaagtatttaagaatacttatattttactactgagagagtagtctgctacccacactacctgcctgaaaataataataataataataaaactgataccaccaccactaccaacatagcccctggtttttaccctcaaattgaaaaacgtggaataacaaggagaatttggtatcattaaattaaggaacaacgtaatttacttacatctccgaacctggtatcgataaattaaaggtggaacattatttttccatgtatttaacccagtaatccgatctaacacatgatcaattaggattactctccgagttaagatctaacgcgaaataactaaagatcatttcctattttgtgagaaattcccaacacaatctttcttttagaattacacagtacaacgcagacactcacaacgcacacgtactcacccatataaacatacgcacgcaaaccctacccctatgagcatcttcgaagactggccggcaaattctggagagattgacgaagtcaccacaggcgcctcgctgtcgacgggtacgtcgcctaccactgaaagcacaacgccgttaaatcctagaaaattcgctcccacggggagtcgaacccaggacctcaggtgctactgagactcttgtaaccattaggctacatgccctttcgcaatcttatttatactagcaacatatactacttatattgtacctaaaagtccccttttttatacattgtttagctatagtcctcctaggctgttcctttcccaactttctcaacttctactctttcgtttttcatacgcacgcttttctaaactgctaaacggtgtgtgtttttgcaaaagttttctatagaaaagttacattaaaaaattatattaattcatttttcaagtttttaagactaatacttaattaatcacgcgctaatggaatacaaccctattatccgtggaactccacctcccgaacgtagccctagtcaactatgcaaaataccatcaagattttagatcttctgtctatggatatttgatcaagaggagcaggtaaattttatacatttttttataagattaggtgaaaaacgacgaaaaaattgcaatcaatccgcaggcctaggccaatgacgtccaaagcttcacctttttttttatatataaaccagcttgatgtatatataaaaaaaggattttatcattcttgaaaatgtatcagaagaaaaagtgaagataccaacaagaaacggaacttacgcttaacttcgtcatttaaaattattaggaaaatagacaaaatatgatacatttcagcaccttccgaggagccagagctgtcagagtcatggtctcatggagcctagttgatttgccaagcaccaacttgttaaattagcagagggagatctcgactggtctctctgagtggcgactggccacctgctgatttgaatactactagtagttttccgtttttggcattggcagtattgtccggccgctgattctgctcacagaccggccatggccgccggcgtcctcatgacaaaaccgttcatggctgctgcggctgctgctctagtcagcttgctcgtcatgctgcgctgcttgcctagcgtcgtcgctaccactgtatctttcaactactccagcttcagcaacgcgagcaagaacatcaccctccagggcagcgcggcgctcgccggcgccgaatggatcgagctcaccaaaggcaaagggaacaacctgtcgagcggcggcaccatgggccggatggtgtacacgccgccggtgcagctatgggacgccgccaccggcgaggttgccagcttcaccacgcgcttctccttcaacatcaccccgaaaaacaagagcaacaagggcgacgggatgaccttcttcctcgtcagctacccgtcgaggatgccgtacatgggctacggcggcgccctcggcctcaccagccagaccttcgacaacgccaccgccggcgaccggttcgtcgccgtcgagttcgacacctacaacaactccttcctagaccccgacgccacctacgaccacatcggcatcgacgtcaacgccctccggtcagtgaagaccgaatccctgcctagctacatcctcatcggcaacatgaccgccatcgtcgactacaacagcaattcgagcatcatgtcggtgaagctatgggcaaatggctcaacgacgccttacaacctcagctccaaggttgatctcaagagcgccttgccggagaaggtcgccgttggcttctcggcggcgacgggttcatcctttgagcagcatcagctgcgttcttggtacttcaacttgacgttggagcagaagcagccaacaggacaacattcgcgtggcggagttgtagcgggagccaccgtcggtgcaattctgttcatcgtgctcctcttcaccatggtagcaatcctcgtacgacgacgtcagagaaagaagatgagggaggaagaggaggacgactcggaaggcgatcccatcgtggagatcgagatggggacggggccgaggcggttcccgtaccacatacttgtcaacgcgacaaagagctttgcggcggaggagaagcttgggcaaggcggtttcggcgcggtgtaccgtggcaatctgagagagctcggcctagacgttgccataaagaggttcgccaaagactcctccaagcaagggaggaaggagtacaagtcggagatcaaggtgataagtcggctgcgtcaccgtaatctcgtgcagctcatcggctggtgccacggccgtgacgagctcctcctcgtctacgagctcgtccccaaccgcagccttgacgtccatctccacggcaatggcaccttcctcacatggccaatgaggtaattaattaactctcattaatactccctccgtcccaaaatatagcaatttttagctatgaatctggattttgggacggaggtagtatatcagaatctatttttttccaatgtgcaatcaacaaatgtcaattgaaattcaactgatcaactagcttggatattatcataggatcaacattgttcttgggcttgggaatgctctgctctacctccatgaggagtgggagcaatgtgtcgtgcaccgtgacatcaaaccgagcaacatcatgctggatgaatctttcaatgcaaagttaggcgactttggtcttgcaaggcttattgaccataacgttggggtacaaacaatgacccacccctcagggacgccaggctatcttgatcctgaatgtgtgatcacaggtaaagcaagcgctgagtctgatgtctatagttttggcgttgttttgttggaagtggcatgtgggaggagaccaatgagcctactggacaaccagaacaatagcctcttccgactggtggaatgggtctgggacctatatggccagggagtcgttctcaaggcagcagacgagcggctcaacaatgactatgatgcaaccagcatggagtgtgtcatggctgttgggctctggtgtgcgcatccggaccgatacgcacgtccatctatcagagctgccatgacggtcctccaatccaatggaccactaccagtgttaccatctaagatgcccgtgccaatatatgcaccgccgatggcctcgtcagaggggcaactttcatcatcgacaggaatgtcatcctcaagtttgacaataacatcaattacacctcgctagggtggcaagttttctcactcataggatatgtatagcaagacaacttttgtcatatctagatttttatccatacccacaagtcgaactacctgcatccctacacctcagttcctttcgcatactttagccggtttgaagggctcatcttcgttaattgctccgtacagtagtattagccatgtttggttcattttacatgttgtacatttacaaattgccgcttgaataggatgtacagctcgtgaggcaattggtttgctctttagagagctgcctaattggcaatatgagtaatgtgttcagtttacatcatgctttcagttttccaaccatttagttattttgtccagaaaacttttccttcaatttcctctccaacaatccaaccaaaccgtccatatctctgaccgtccatatctcttcattaattttctactgaagcagttcttatgcaatcgtctcaaattgtggatatttatgttcagtacatacaccggtgttgattgaacgctgaatcgagaacatcgaagcaaaattgttaacacacaaaaataacaacagccaattgtcagatttaagacataagagattcatgcagcaagcatatcgtccaagattgacatctctgctacttcacagagtgatcaagccaaaatttgaaagagaagagagttggttctgatagggtcagcagtggctttactgctgcaatttcctcaacaaaatctgataggcttttacggtgtttgcattccaaaaaaaggtatagatccaacgctccataatcataggtatcatgtaaaaggtatttaaccattggtattggtgcttaagtactaagggtaaaaatataattttactagtagagaaaaagggtagaattgtctcccaaattagaatcggtaccgcgtaggtactaccatacgaagttaacatttcccctttaccagctttacaggttattatttgcgtattttctcttttgcatggttttatctagatttacgttgtgtttgagttaagtcatttagccagcactagcattacaggttcttaagttgcatcattttatctagagttactccgttctttgatgttctcatttacgtggttttctctatatttatgttgtgttcttataacctgtacatgtcaatcagatcttgcctcctgttcaaatgctcgaccatgccagatcttcttcctcgaccgtgtctcctcatgggtgcgcccgttcgaacactagaaaaacaccataggaggagatctcgtttactatcccacaaaaattccagtcccttatataaggagtttatgaactacatgaataactaatcaactatgtgaataagcataggataactttcagatgcgctagattgagcctagtcatcgaccgggctatcgcattgtcgacgtttgatgtctcgactacggtgtttgggcaatatggagatcgtcggtgctagggtatacgcaagactgaggtaaaagagatggagacagggatttttatacaggttcgggcccctgagctatcaggtaatagccctacatcctgttggccggagccgatgttgctttttattcatgataatcacaccagtacaatgtttggggtagcctatctaactgttgtcgacatggcggtctgacgatctgactcgtagtcgacaacagggtagccttcctcctcgaatccgtgcccggcgagatcagagatagtgctttcgtctctcctgacagtatccggagacaccgtagggtactagccgtgtttatccctgaagtcgatatccggcggcgtgtcttagcgtatgtaggcttctatgttgtggcttctatgtcgattgtgttaggtgttgatcccttcatggtgggtgtatgttgattgtgttggttctccctggcgggtgtccccctgtcctcctaggggggcttgtatttatacccataggtgtccccttgtccaagtagaactagggaaaccaatatggatacaatccgagtagtccttgtcgtttccatgtagaactctggttatctttccttattcagaactccctcgaggttagtttccatataagacatggtatgtggtggatcctgccgagatttagtcaactactattaggtatgtggtatccataaccctgacacgcatctcctcaaccctcaaccatgcagacgcttttttctctgtctccttctagtgaatgttcaaaccctagaacaagaacgaagcgaaaggagagaagaatggagatgcgatctttctgtttattttggtacagatcgaattgatcgctgctaaatcaacagtgtatctgtgatttactttttttcctcacgacgtatcaatctgcataatgatatactgatcgatggatataggtattcaattcacgtataatgcccatgttttactagttaattacgtcatcatattataataactaggaagaaagcccgcgcagatgcgcgggcagttttatgaagacaattttttaaaaaggttatatctcaccatttataagccgagaaatatattgcatactttaatatatttaagtaataaggttatctcctagattaaataaaatcactttgcctctggttacatataaattttcttgttgtcacttcaacctattatcactgtttaaaagccaagtacctattcatagatgaactacgtaatgtatcaataaaataagcctaatatatcattaatacattgaaatatccactacacgtaagtgtttcgtgcctcaccaattttcaaaactatatataaatattgtaaaaataccacttgtacaaattaatagaataacatcaagttatatataaatgcttctctaatgcgtgaagccgattgcagtggcgagactttctttgtccgttgccttgaaacataggtcccatatcgatgtagttgtgcacctccagactaacctggagcacaattttaatgcctaatttactatcacacccttatcgagttgtgcatcggtaagtagtaagttgagcactattggtgactgtggtctccactgggaccgccttaactcccatatgtacatccctgttatacttatagcaacgtagcaaactatgttattcatgcttatgcccttcatgaaaggaaaaagagaagatggaggtgatcaaaagaatgttttttttatgttttgagagtagattcatggtatagagtaggcaccacgtgtttatggtgttaaacattatgcaatttgaaaatgagcgaagttgtaatttgacggtactaaaagagaagatggaggtgatcaaaagaattttttttttaagttttgagtagattcctggtatagagtagacaccatgtgtgtttatggtgttaaatatttatattttgacaaacatctatagtttagcgcttggtttattttcaatacttattgttgataatgacatgagacacctttactaattcgaagaatatatttattttttttaaatttattaataataactaatgcgtgggagtatatgggagttttttattttttttgtatgatactatatacgtatattttttttggttctatctttttttgacacgatggctttattcttttaccgtacgtatgtaggttttattgttccttttcaatcttacgtacttactttttttttggcgaacctattctctctcgtatgtataggtggaaagtattagtattagagatatatatctaatctaatgatctaaataacggatccatcaatttaagtgaaaatcaacggtatagatatagatataatctaatggtctaaaataacgggtccaccaatttaaatgaaaatcgacggtgagattaaacagtgccacgtggcggtttaggagcgtttataagaatgccacgtgtcgtcttgagagtgtttgtaggacgtttaatggacttttagtatataatagatagatagatatattttgttccctaccttgcccctctcttgattaacggtacacattattccatctccaggtacctctaagtacctcgcaaacggtgtaaaaagtctcgaaaagtaattgaaagctcatactgtcagtagagagttcactgtctttttcaacacggtgacggtcgtgcgtgtatgctgcaggctggaactcaggacttaattcggtcttcgatcggttgtactagatgacatcaaagctcaaatttgcggagactctttactccacggccaaaggggagtctttaaagtctttctgcgatccggatcgaattcggatcctctgcggtggaggagaaaattcagaggttgctacagtacccagcattaggagtactgtgggccgtccgatcaagaacggacggatcagaccgttcgctacagtaaaacagtgcattgatgcacagtactttcatccctgtagatacagtaaatcatcactgtagcggtactgttctgtgcattgaaacactgtccccctcacatatcactgtggccacagtgcctctctgcggtaatgcagaggatccgaatccatccggatcactctccatcgatcgatcagtggagttggcacaatatagtttcagataagctgggccattgactgacctctgggctcttgttctgcgtcaaacgactgcatgaggcaaccctgaatatctctcaagtctgaacattacgatttacttacaattatgcatgtttctccgtctctccgatggatcatggagattgtagcagcatcgttaattttggggtattgttcttttcagctcggcatggacaattattgtagtccagctaggaaccgacgctgataaaccgacaattattagttaagtcatcgcaatgatcatttccggtgcgcaatccttttccgtattaaaaaaaaaaatccttccaagttccgacccctgcgaaccaacaagtacagaacaagcaattcaataccaatttggcacagttaaaccatacggaagaactaatagcatttatatgccgtgttaacaccagctgtgttacaatgccttgttagaccaaactgtgttgagtctctctgtgctgctcattgtacttgaggaaaaggtctttattttcttacgtcccttgagttaatccctctcattagagaaatgaaaacgaattatgaaacattaatttcacacctgtcaatccccatctcatgtggattaatcgagcaatgtctttaatgagatgacactcgttttcttacatgccatcaaatagttgtaaaattgtttttataaaaaaatatcataatgcgatatatttgttggattctaccttttcagattgaaaaacaacaaattttgtttcatcttgcatatttgtaaaatgatatcacacatttatctatgttgttgaatcttttaaagatttttctatgaatattgagacaacatatataaaagagtaaaatacacggccggtccttaaagttgagcgcgggtgtcacttaggtccataatcttgtaaattgcacatctaggtccaccatcttgtttaagtgactcattgaggtctaaaagacctctgaccaggttgactggcttacgtggcggtgcagcgtggcaacatatttgcattttgccccctttttgattccccgtgtccgatccaatcccttctttgcgtggcgcacgcaggaacgcgccgacggcaacgtgcgccagcacgcacacctgtggcacccacctgtctcaaccacgctgcgcccgctgacgtgcctcgtacccctctggcagccgctcgccggtgttgcgcagcgcccagagaaaccgcacaccgtcgtcgacgggaaggagaaggagcaggggaaggggaaggcccccgctctagccagccgtgggtgcacgcgacaagtggctgcggcagctgctcaagtcaagcttgccctgccgccatggagctcgcacccgcccagctcgcgccgaactcgccgacgcctcacccacacacgcggccgcggtaggcgacccctcctcccaggcgtggccggcgacacctcccccgcgcgcgccaagctcaccgacgcctctagcaccaacgaccagcgggaagggagaccgatggatctggctgtcagtgaggcgtgagcgccaccggcacgctagctacgaagactgtcacaccctgaaaattcaaaatatataaattgttgtttaattggaatttttagaaataattttaaaaagtcttgaaaagaagatctaatttttaattaataaatttcaatataaaatgggcccagataaaatttccttaaatactttgcttaattctataattcctagatttttctgggatttatttgagctaagaaagtatttttaataaatggaattgcatttaagaaataatttaaattgaaaaaaggttttaaaaagtcttcttttggctttgggccgaaagtcggcccaaaacctctgttctatctcctcggcccagccggcccagtccgccgcagccgagcgcgccctacctgtcgctgacaggtggggcccacctgtcagtcgtcgtctacctttggccgccgccgcggaaaccctaggttcgcgccgccgcagtttcattacaaatccggccgccccattccgtctccggcccaatcaatagagg

SEQ ID NO: 15670 - DNA, 12295 bp, Oryza sativa
cttgataccttgggatataatttgactagttgagctttatttatattggttcaactaaatattagatataattgcttagccctgcttagaaaccttagcacatttatgggataacttatgattcactattatttcatgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcatgtgcacttgcatatgggctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaaagtagaactgttctcctccctttctcttttaattaaaccaaaataatggcacatgcatttcagcaaaatttcataatctcttttaatggttctcattcaaaatttattccagtgttattattactgtacatctattactgtactaatggctcatttaccagcaaaagttttacaatgttgttttatttaatcttgctgcaataaaataaatttagcatgttgattttataactttccttttatttcttttgaaacctgttattcaaaagcacaaaatttgtaaccttgttttcaactatttcaaattatcttgcaagtttggtttaccttatttacttaccttttactttgattttcaaattttattcaagttaatccaaaaacttgtgctgttaattggatagatgtcttaactctctcctttcacttgtctttagatgccgcgctacaagcctgagtacctgtttggtgttgagggttttgtccaggagttgcgtacgatgtcctttgccattggatttgggactgcccctttttatgcccagattcctcatgatcgtcatgaagagaagtgccgagtcaaagtcaccttaaacagcaatagtgaagatgtcccctcagtgatgttcgaagctggaggaagaaactacatccatgcatgtcaggaagtggcaaggatcgccataggagagctccgtgatcgctacagtgatcagttggccgatactgagtatcgctaccatcctcgtcaaccccagggaagtgaccgtggcagttaccttgagactgaaggaattgagaatgatgctaccacaaggcatttggttgagatgttgtgggctatggatgaaagtcgtgcggagactgtgttagcggctcaagatcgtgaagaccggaatcgtggtaagatttgcaagttagaggacaaggtggatcgtttggagaaggaactcgccgcattgaagggagaagcaccgccgcagaaggccaggattcgtctcaccgcaaggaagagagctctatttgtccctcgctatcaattggcgccaaaggttcgtgtggtggagaaagaagttgccccagctcaagcggatcctccggtcatcatcataagtgatgaagaagaagaatccaagcgcacccgttccaagattgagtgggtagcaactcaagatgatgaagacgagccgaacgagcctacaatcgacctccgatgcttggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctatcctaagtagttccccggtttctcttcttgtgccctgttcctgccagatggtgaatactcgcagcaacgggaatggtcccaacaaccccaataacaataacaatggagagaacccaactctggcccaagttcttcctcaacagacacagcttatgaacatgatgatgcagcaattccagaatcagcagaaccaaggaaataaccatgtacctccccagaataagttagcagaatttcttcgtgtgaggccacctgttttctttagtaccactaatcctattgaagctggtgattggctgcatgccatagagaagaagttggatttacttcagtgcactgatccggagaaggtatcttttgcatcacatcagttgcatggctctgcctctgaatggtgggatcacttccgcctgaataggactactgctgaacctatcacttggcttgaattcaccgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattattctgatttccagaaattagtggataaggctatacgtcaggaggacaagtacaattgcatggaacagaggaaacgtcggattgctcacttcaaggcacaacaggggagtaatcagaagccgcgtcttactttaggaccccagtctatgccacagggaggttcttcgtctgttgttcgtccgccgcgtcagttcttcaacaacaatgctggcaataacatccgcaatcaaactccacgtcctgttgcagctccaacacagcaacagcctgccaagagggagcaaggcagcaagcccgtggtgtgtttcaactgtggagacccaggacattatgctgacaagtgtccgaagccccgtcgcgtgtaggttgtccctgcccagagtaactctgctgtaccagcatcaaaggcccgtgtcaatcatgttgctgctgcagaagctcaagattctccagatgtgattttgggtacgttccctgttaactcagttcctgcaacagtacttttcgattcaggtgctacacattcattcttatctatgagttttgcgggaaatcatgggatggaagtagaagatcttagacatcctttgatggttagtaccccaagtaatcaagcactctctttgcaacgtagcccctcggtcagaatagaaattaaaggagtaccatttctggccaatcttatcttgttagaatccaaagaccttgatgtcatcctagggatggactggttagccagacatagaggtgtgatagactgtgccaacagaaaagtaactctcaccagcaatgatggtcgagttgtgactgttcatgcattgtcttctgagtctttaaggtcaagactgaaccagataactttggaagagattcctatagtccgggagtatcccgatgtgttcccagatgatttacctggtatgccgcccaaaagggatatagagttcagaatagatctggtaccaggaacaactccaatccataagagaccttatcgaatggcagccaatgagttggcagaagtcaagaggcaagtggacgatttgcttcagaaaggatacatcagaccgagttcatcaccatggggagctccggttatttttgtggaaaagaaagaccatacccagagaatgtgtgtggactatcgtgcgttaaacgatgtgactatcaagaataagtatccgctgcccagaattgatgatttgtttgatcagcttaaaggtgctaccgttttctccaagatagatcttcgatcagggtatcaccagttgagaatcaaagaggaagatatacctaagacagcttttaccactaggtatggattgttcgaatgtacggttatgtcttttggacttaccaatgcccctgctttcttcatgaacttgatgaataaggtgtttatggaatacctagacaagttcgtagtggtctttatagatgacattcttatctactctcgaaccaaagaagagcatgaagaacatcttcgccttgcattggagaagctacgagagcatcaactgtatgctaagtttagcaagtgtgaattttggttgtctgaagtgaagttccttggtcacgtcatctcagcaggaggagttgccgttgatcctagtaatgtggaacccgtaaccaactggaaacaaccgaagacagtttcagagattcgcagttttctaggcctcgcaggatattaccagaggtttatagagaatttttccaagattgctaagcccatgacacgattgcttcagaaagatgtgaagtacaagtggtcggaagaatgtgagcagagttttcaagagttgaaaaatcgcttaatatcagctcctattttgattttacctgatccaaagaaaggtttccaagtgtattgcgatgcatccaaacttgggttaggttgtgttttgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacggagatgtacaccgatcacaagagtttaaagtatatttttactcagccggatctgaacatgagacaacggagatggttggaattaattaaggattatgacatgggaattcattatcacccgggaaaggctaatgttgtagcagacgctcttagcaggaaaggctattgcaatgctaccgaaggacgacagttgccattggaattatgcaaggaatttgaaagattaaatttgggaattgtcagtagaggtttcgttgcagctttagaagcgaagcccactctaattgatcaagtcagagaagcccaaattaatgatccggatattcaagaaatcaagaagaatatgagaagaggaaaagctatcggtttcttggaggatgagcaaggaactgtatggttgggtgaaagaatttgtgttcccgacaacaaagacttaaaagatgcaattctgaaagaagctcatgatactttatactccattcaccctggtagtactaaaatgtaccaggatctcaaggaaagattttggtgggcaagtatgaagcgtgaaatcgcagaatatgtagcagtatgtgatgtttgtcagcgagtcaaggcagaacatcagaaacctgccggtttgctacagcctttgaagattcctgaatggaagtgggaagaaatcggtatggattttatcactggtttacccagaacgtcatcaggccattactctatttgggtaatagtcgacagacgtaccaaagtggctcatttcattccggtaaagacaacttattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaattttagtactgcttatcatccgcagacagacggacaaaccgaaagggtgaatcagattttggaagacatgttgagagcttgtgctttagacttcggtggaagttgggataagaatctaccctatgtagaattttcgtacaacaacagttatcaagctagtcttcagatggctccttacgaagcactgtatggtcggaagtgtcgcactccgcttctgtgggagcaaacgggagaacgtcaggttttcgagacggatatcctaagggaagcagaagaaaaggtgaaaatcattcaggaaagattgcgagtggctcagtctcgtcataagagttatgccgacaatcgccgtagagatttgagttttgaagaaggagattatgtgtatcttcgtgtcacgccttttcgaggagttcatcgttttcacaccaaaggaaaattggcaccgcgttttgtgggaccctataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatgttgagaaaccaatccgtatcttggaaataaatgagagaagaaccagaaatcgagttatccgtttttgcaaagtccaatggagtaatcactcggaagaagaatcaacttgggaacgagaagatgaattgaagtcagctcatccacatctgttcgccagttcttccgaatctcgaggacgagattctgtttaaggggggtaggtttgtcacaccctgaaaattcaaaatatataaattgttgtttaattggaatttttagaaataattttaaaaagtcttgaaaagaagatctaatttttaattaataaatttcaacataaaatgggcccagataaaatttccttaaatactttgcttaattctataattcctagatttttctgggatttatttgagctaagaaagtatttttaataaatggaattgcatttaagaaataatttaaattgaaaaaaggttttaaaaagtcttcttttggctttgggccgaaagtcggcccaaaacctctcttctctctcctcggcccagccggcccagtccgccgcagccgcgcgcgccctcgctgtcgctgacaggtggggcccacctgtcagtcgtcgtctacctttggccgccgccgccgaaaccctagtttcgcgccgccgccgtttccttccaaatccggccgcccctttccttctccggccgaatcaatagaggggaaacaatctccgggatctcctctaccttttctcctttggaatcttcggctaaatcggtttggaatgagttggattcgagttcgtctcggattcgttcttcccgatctttccttcctcgtcgccggtcgccgtgggccttcgccgccgcctccgagcccctttaaaaggacccccggtgtttcctctacccgtcgccaccttcgccttcgcctctcgtcgtcggaatcgctctagcgccgtgtgccctagcttcgccgtcgccgccgccgctccagccgtgctccgccgccgttccagacgtcgccgtcgctcgggaagaccgttgtcgtggtcgccaagtcgtcgccgtcctcgtccgccccttcgccgtcgccggagatcgtcggagcttcgtcgccgtcgacaacccgaaggtttccgccgtttcctcctcgtcgccgtcgtcgttcgttgtttttccgccgccgttttggtcaccggtgtgttcgccgcgtcgtcctctacgtgctggtgccctccgtttgcgtcctcgcgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaaccgccgcccatgcgcccggtccaccgaaaccctagccgctgacgcaataatccctcttttccttttcaaaaataattcattattgcgtcataattcaattttaaccgatttaagtgttttaatccgatttaatcttcaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccgaagagtccgttttcgccggagaagagtttgaagagttccaaggccagcaaggcaagtcacacagatcccaaacaaccctttgagcatgttgatcctatttaaagctgttgtttcttttcaactattgcatttattttcgaatgtcattgggtggaattaacctattgtttgttatagcccttttgttcttgattactttattccttgataccttgggatataatttgactagttgagctttatttatattggttcaactaaatattagatataattgcttagccctgcttagaaaccttagcacatttatgggataacttatgattcactattatttcatgatggtttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcactgcagtggattgtgttatgcgaggggtattgtcacaactcctttccgaggtatcgtggtggtattgaggcacatggtgacatgatgtggggttgtgtcttgtgggtacagtggtacacctctgatcagagtaaaactattcgaatagccgtgcccgcggttatgggcgggtctaacaatgtctttcatgattagtctcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagacagtgacggcgctccgcaagctctcctctagttccctccgtgtcacgcccagaaattcacgaaccagaatttctaagctgaatgtgtattaaacccctgtccaggaccagccagggtacacaaatgacaattgttgacatacatatccacgttttacaaaaatataagagattacaaatgcagcggaaaagataaaagcgagctaagcctgaagacttgactcctgcagcggacgactccattccacaggcatccttgacggcagcgacgaaaccaacctcttcgagacatcttcaactgagaaggacttcaactctggtgtgggggaaaagagagcaagactgagtattacccactgtactcagcaagtcataccggaagaggaggtatgatgcagggtatatccaagggaggctaaaggttcttttgcatgaagctagcatttaaaagcagttgttgaaagcagtaaaacaattgcgttaattaatcaatattaaccaatcactgctcaacgctacaccacgttgagacaggcccaaaccaccacctgaactaaccagttccaaaagataactaggggtgagactaatcacggtgaatctggtcgaccgcccataaccgcgggcacggctattcgaatagttttactctgatcagaggtgtacaactgtacccacaagacacagccccacgacacgttcctgtgcgccgacatgccaccacaacataccggaaagaggccgtgacaggacccttcgcataaccccctctaaccgatcgcaccacaccttagggttcgcccccgtccccagcaggcaacgggcagcccccctttcgtgcctcggtgaatccggaagccgatcaaccggacaccccggccgacccaactccatcacatccaccctcgcctgggtacgtcggctagagaaaagctacactacaagcccagccgttgcccacgctggcttgtggtaagtacgataagttcttccagggcatcccgtgaaccggtccttaattgccatgggcacgactagcaaaaccatgcacccacagcccaccatgacgtgtattttaattaaccaataccattacggtggcaccaaaccaaagctatgccgataatcaaagtctatgctttaatgtgattccctttttgtgtactagtagaactaagcatggctaagcatttcctaaaccaacatctagtcattttaatacccaagttatcaatggcgtaagggaaacaacataaagctgagtaataggacccatcccacatgatattgtaaaacgatgcaatatttaatagaaatacaggacatttgtaaattgggtacaatatgctcaattgtaatgtatgacttgccttgctctcgcactgatgagaccacagcaacgtcttcgagaaaccgcgaatcgacgaaacggccgaaatctacgcgacaaacaaagcacaccagcaaaacatgctataagactactgaaacaggaaacaaaaccatttttaatggattctacacatttttatgaatttactgagacttgaatggacttaatcggagctcggatgaattagttatgatttttagaagattatctgtgtttttactataaaagaaaaacccttaatcaatttattgcgcaataattcctcccagggctgacgtcagcaaggggtggggcggcgccgacatgcgggccccactggacagaggcacaagagagagggagagggggcggctggcaggcgggacccaccgggcggcggctcagggggggagacgcccggtcggctcggctcggcctcaaaccggccgaccggttatggcgagggcggcggcgcgcgagcacggtcgccggcgacggcaaccggcggcgggaggcggcggcggacggcgcaaaggcggcggcggcggcgcgcgcacggaggcagcggcgatagggagctcgggagcggacggcgaaagagggaaaaaggtggagagaggcgcggtggtcggtatatagaggtggggaggctg

SEQ ID NO: 15671 - DNA, 6005 bp, Oryza sativa
ggagaggattcaaatcaaatcctgtccgtccgggagcgagcatggacgggagagggcagggcgtggggcggcgacgtggggacgtgtgggcacggagtggggcgcgtattcggagaaaacgccggcgtggtcggcggtttcagcagcggatggtggcggctgccggaggttagggacgaccgacaggtgggccccacctgtcggcgcccgggaggagaggggaggtgggctggacttcggggaggggaggtgaagcgggccggcgcgggagggaatgggccgggctcaagaaaaaggaaaaaggagggaaaagaaaagataaaaaggaaaaaggattttcccagggatttatatattgcacatgctcatttttaattggttaaaattatttccaatgctctgaaaattccgctaaaaatcctgttagcgtattttgacatgtagaatccaagaaaaattccacatgccgaatccgattattatttgcatttattaatttagggtttctctcttgcctttaaacaaataatttcttccaaccatttattaattgaatttttgctagggaaataacttctgggcgcccgtcgccgctccgctcgcaccccgccgccgcgcttgccctccaccgttccgcccgccgcccattcgtcaagaaggatttgaggtccacgacggcgcgacgtcctgatcttcgagctcgtccgccgctcgcttcatcccctctaatactgcgtcgttggcaatcatgcgtcgcttcgtcgaggtccacgatagcggcggcggaggacactgatgttggcgaggcgaggccggagaacgtgacaagcgaggcggtgcagccgtggtgtgcgactaggcgctgcaacagctcagccatcggtatgacatggccggcgaaggggctgacgatgaggatgacgtgcggcggcggtgggcgatgtgacgacggaggcagctgagggatttgggggttctttttggtgcccagggctctactgaatgcaatgtagatggttagcttcggtcaaaccgggtatggaccttaatgagtcacttaaacaagatggtggacctagatgtgcaatttacaagattatggacctaagtgacacccgcgcacaactttaaggaatggtagtgtattttactctatataaaaaaagaggggcgatcctaaacgtagaaaaaaccacctcctcctattatgctatgaattatcttaagaaagataattcatagaaaaaaagctgctcatgagaatatagaaaaacatgctttttctatcttgtggcttctaacacattattttaatttcatagttatattgatgggaatttaggtgaaaaatttctaccgtctagagagccataaattatggaaaatgttgtattactataaactctcccgaacaaggacgaaggagtgcaagcagcttaaaatccacataacttccttaacgcctcgttattttctgattaagttacagatcttacccactactacaaaacattaaataggtgttgccactatagatactgaaagtactaaaaccagcacctataggccttttccaatttccgcgggttgaaattgcaaaaaccggcacctttaagcaattataagtgccggttctaaataagaaccgacacctattctataggtgtcggaccgacacctataatatattataggtgccggttttttaaaaaacgacacccacagaaatctagccgaggcggcatcggatgagccaaccagcgggccccaccacaacgaggcgaggaggagataaggttcgctctcgcgtcatctcgctctcttctctctctccctcccttctctctcatctctatcttctctctctccctcccttctctcccgctaccggcggaggcggcagcggcgaccgcgcccttccctcgctagatctagcgggaggggaggtggcggtggcaggaagggaggcggtagcagggatcttgaggggagcccgtggtggcccgacggccaggggggaggcggcggcaacgccttcccctccgctagatccggctggaggggaggcagcggcgcctccgctccaccagatctggccgggaggggagtcagcaacggctcggcggcggcgggaggggcggcagcagcaagtggcgtggctcacaggcatcggcggcggcgacctcccatctgccaaatccggcgggagggaaggcagcagcggcggcggagccccccctccgccagatccggcggggtaggcagcggcaacgacagtggcgggctcccttgtctcttctaccactggtgagcacccccaaccatctcctttgcttgccggctgtgtcattgttgatgtttgattcgatgattcaataatgtttgatgtttgattcagtgatttaaacttgttgatgaatatttgattgtgtgatgtgtacttgtctttttttttttgatttttgatttttttttttggctttaaagaattggctcgactcaaatcgagccgatcgggcttttttttttttttttgcaaatcgtatacctcaaaggtgtcggttcctaaaccggcacctttgagtcatctcatcagtgccgccttggtggtgctggttgggaaaattggcacctaaggggatttcccaaccggcaccgaaggctctttctgtggtagtgaccctggttttgttagcacgtttttcaatctgctaggtgtatttcgtgcgaaaactttttatacataatttaagttgctttaaaatatcagataaatctattttttaagtgtataataattaaaagccaattaatcatatactaattaatggatttcttgttttcgtgtcctagctacttcatctttagtaaaaacgagcatcaccaaactatgttccccggactggttggagagtggatatattttaaactttcgagaagacgttcccttgttgtttacatatcactcaaaatagttattaaaaaatttaaaagatatattaatatataatatatcagtatttaaaattcaacttttacaagttgtaaaaaaaaagtacagctagttaatgtatattgatagtcattttttttttgcaacatgtagaagttaaatttaaccttgcatgtttgtttggtgatctatcatatattaatatatcttagtgactttttttaaaaaaaaaattaactatctttatataataaaagtccattaaacttcctacaatcactctcaagccgccacgtggcatcctaaaaatactcccgagtcgccacgtggcattctaataaaatagagaaatctgaccatcgattttcacttaaataggtgggcccattattttagatcgttagattatctttaaagaaaaaaaaccccctgccgtccctacctccgtgcaggatgcgtattgtacgctccctatcaccccttctttttttttctctttgtttctttcttctttttttatctttatgaaaaaaaatccctacaaatagacatcgtacgagtaagtccattaaacttcttagaaacgcttttaagccaccatatggctcctacaaacgctcttgagtcgccacgtggcgctctgataaattagagaaatctaagaaattccaataaaaaaaagaaaaacatcgtaccatttattttctctttacacaccattagatctatatatgtaaaaaacaaatgtcacgtacgaccacacctctccctaggtccctcatctcctaacatgtacgtgcatccaaagtacgtatgtctccccacccctctcttcttccttccatttatggtagcaaaattttgtatataaaaaacacaacaactaaataattagaatatcttataatatattcgattttaatttgaactatgtttaccatattttggtatgtacatatataagaaacatatcatttgacataaacccctttatcgcaactaaatagtaataaaatattacaaaaagtaacatatatcatgccattgtaaatgatctcctattatctctcgtgctcactttcttatccatattttctagcgagcagttcagtacataaagaaccaacaaatgctatattaactatctattatatacttaaaaattcattaaactccctacagatcctcttaaactgtcacatggttttctacaaacactcatgagatgccatgtagtgctcaaataaattaaaagttcctagaaattatgataaaaaaatcaaaccattgattttcctttaaataggtagatccaataattataactgctacatctcacaaaaataaatccggtacccccacctccacccctaccgtatgtgagcatgcatgtacgtacgtacctccaccgtcctactcatctctgggatccaattctcatatcctatttttaagataacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatactgctatctaactacaaatatttgagcaaaatagcacttcgaaaatgatgaatgaattcaaatgtgtgggtctaaagtccaagttcaatcatcaccaaagaagcttggaaccagaatgcacactctgggcctgaacccgatgaaggcggagctataagacattattagcaaggtggacactgacggcagcggcatcatcgacttctacaagttcctggacctaatagcgcactaaatgattagatgaaggacaaggactaagaggaggggaccagagggagacgttccatgtcttcgacaaggactagaaaacagcttcatctttgccaccgagccccaccacgtcatgtctaatgtatcaagagaggctcactgatgaggaggtcaacaatgatccgcaaggctaatggtgacaggtggatcaccacaaggagtttgtaattaaattcagaacaaaaatataaaacaagcaatttgattaaaatacacaaacaaaaaataaaaaacactaaaactataaaaaaaaaataacaagattccatgtagaatataaaatatcaagagtccctataaaagtataagttataaatatctaaaatttggaataataaaataagtattaaaaaaagagatcaaatacagcacgatatgagattaagcgcaatttaaaatccctaaaaagacaatttagaataaagtaatttgatttgaatacaaagtcgaattaagaatcactcaatcactaaattcagaatacaataaatattttttaaagaatttttctatctttattgattcacatgcataacaaattgcatatatatgaagcaattaaagagagggctagcagaatggtaaaaatatatatttattaccaatgaaagtttatcgagatttcttcacgaaaaagagatataataaatactcaattaacagtagagaatacattactttaattttggatagactagttcttccatgctttgcttgctctcccttgtgaacacagagtacactcctctaaactaccaagtctcacttaagtcgacggcctccacacttcagtgaatccactccccaattaggaagactctacgcactgactcgttgctccaagtcaagctggtatcaccgtgcgcaccgacgccggccggccgcggcggcgatggctggctttccgctgatcacatcagcgatcacttgcgcagtgggcatcatcttcttctccgtttgctacctgcatccggcaccggtcgccgccttgtacttcaactactccaccttcagccaggacgacgggaacaccatcagactcgaaggcgacgcctccttcggcgacgggtggatcgacatcagcgccaacaggtacggccacaggggacacagcaaaggccgggcatcgtacagcgcccggccgatgctc

SEQ ID NO: 15672 - DNA, 833 bp, Oryza sativa
cgcagataagcaaatttttatcaattgcatccatgcaaagggggagcttctggcggttgcttcagggcacaaagtgagatgtttaaacaaatgaactttctatggatcgttctgatctgtacttcatcagtaactgttaaagtttaaattttgaaatacatttcagctgttcatatgggactacaataaacgagatgaagcttctgacccaccaatgatattaagaactcgccgttcactgagagctgttcaatttcatcccaatggggctccgtatctactgactgcagaggtagaatttgtctctctgaattgatgatttatttatattagttttctaattttctccgtgtctccctgtcctagtgttgatgtttaatctcaccccaaggttcacttgcaggttaacaatcttgattctgctgattcagaactgacccatgcaacatcttctggctattcaaactcgccttcggctgtattttttgcaatcatgaactccgcatgttgtccatactctgagtctaggttttcatcaccgtgcttgatctggcctgcatatgtcagagatgatggaagcatatgtctgcttcgcaatgactgggttagtggttcatccgatgtgcagcagccatcagattctgaaactcaacaggctggccatatggttacacctatggatgtatgccctggagaacctggggtgaataattatgatgatgaagattctgcatctttatcaaatagaatagaaatgcatactcccagttggcagaatagctcaagatttcacaacagtagtgctgctgtgatcttcacaaaactgatataag

SEQ ID NO: 15673 - DNA, 1239 bp, Oryza sativa
gtaaaagatcaatgatattaacacaaaaaatgatgcatttatgtgtctacatattatgcagagttaatctaaactaattctatatcatcttactgttgcctcattaactaaaaacttttgtggcaatattattaacattttaccggaggaatcaacacatgatttttttatgacaagccactgaatgagattcatggatgtcagtgttcagtcttttgcctgaagcagcaaattaatagttttaaggctgttaactatggacttacgcataagccttcccttgcaggtcaactggagaaggatggataactggctttccagtaggaacagctccaggactgcgtgagtgcctcttcacactcatcattgcctggtaagatttagaaacagtgtatcacgtcacaaactcgaacattttaaatgagcataattaatgaaaacaatacagtcaactaaaaagcatactgttagaggaacggcagcgcatcgccatttgtttgttggttccttcagatttgttgcaaaagccatgtaaccattcagcccagctgctagtatgtgcatgcagatatgaccaagaacctgcattcttcaaggtttagagcctatagcatgtgtgtgtgtgtgtgtgtgtgtgtgtgtgtatatatatatatatatatatatatatatatatatatatatatatatcttttatttgtgacgaacatagttcaggtttactacttacataggcgtaatcacaatcgaagtttgatggtaaggatcctcgcgcttgatacccgaaaaagtggcaaacggagctgaatttccttccaatgtatttcccctctttctgagaatcaagcacaatcaaattaaaaaaaaaaagaactgaatactgaactgggcacataaagctcaagttttaactgaacttaccattcgcttgttcatttctgcttctactaaatgagctaagagttgctcagtatcaatctgaaaatttcaataaaaagtttgacatcaaaaattgcatttccatgaataactgactgctgagcattccagaaaacacaaacctgggacaattgtgctgagttatcggagtcttgatgtagcagcaactataacagaaagttccaaatcttcagaccacaatttttattaataaaataaattatgttagtaatttaatacaccaatacctctcttcttatgaaaggaggcaagtaattatacaaggcagtagcccatgga

SEQ ID NO: 15674 - DNA, 752 bp, Oryza sativa
ttgagcgtcactaaaatatgaagattttgtctttagaagcaaaggaacgtgatctgataaatctctgtttagagcaacaacagaagataaaggatacttttgctcccattccgttgatactaacactctatccaatttctcataggttgggtttgctagattatttgcccaagtaaagttcctaccagacaactgtatctccctaaggcacaacccatcaataacagcattaaacaaaaagggccatctatcatcataattgttattactcttatcattaggactacgaagaatattaaaatcaccaccaataagaattggtatagtctcatgactgcacatgttaactaattcttcaaggaattgatctttaagctcattctgtgcaggcccatacaccaaaactaaagcccatttaaaattatcagccttatttcgtaaatgaaatttgatataaaaatccccctcatcaatcaaaccaatgtcaaaatttagaagattaattcctaaaagaagaccaccagatctgcctctaggagatttacagtgccacaaaaaatctttactaacacaaagattattcagagcagatgtagaaaattccttcttaaccgtctcagataaaacaataaaatcaagttgatgttctttggttaaatcagaaacaaacttatgtttttttcgggtccttgaacccgtcacaattccaaaaaaactttgccactattagacctaacgagccacatgctcaa

SEQ ID NO: 15675 - DNA, 722 bp, Oryza sativa
ttctttaacggccatactttagagggctgcataaccaaattgccacacatatgaaccttacataggtgaagtgttcatttcctataaattttcttattttaaaaaaatgaccataaggttggcatttataaattgcagcatgagcaaactagaggtttctcaatcgttgataggaacatcatgtaatttgtggcatgacagactaattatcggtcagccagacagatcgcaatagcaacagggtaggaggtgattatctccaccttgaactgaaattccaaacatcacacatgttttcagtaacacacaattgtgttgaacgaaaccgaacaagacttaaaaaagaaagattacaatatactacaataaattgttggatccaataaaattatgactggacagtacacttgctatcatccgtgtgcgtggtagcttgagaaggagctatggtgtgcatcgaaggcggacgatgaacaagagtgaagctttctcccacatcagccgacccatagatttttcgcttgatgtagactgctatcctactatggcctcggctgtatgggaattacttcacaaacatgcagatatcatgctcttgaatagctcatgtagttacagcatgattcacttgcagcatctccaggattagtcttccatatagttcatagatcatacaacctacaaggtttcaatgaatgaaatagttaaaacacgggggatcc

SEQ ID NO: 15676 - DNA, 1169 bp, Oryza sativa
gctacattgtagtgcttacctgcctactgtatatttgactatccagttatccactctagttacgtcaattgatgaagggaaattaacgctataattttgtaaatgagtattaatgtatgattcagggtgattcaatagacagtgcaagtatctagttactttgttgtttactcagtctgttataggtacatgtcattttagaatgatacacgtaaacgtaagtctgaccagaattatacaaaaagttggaaattgaatagatagaataagtctgatatactaatcatgattgcaaatttgtaatctttaggttatgatattcttcagtgcacatggagtaccacttacctatgttacggatgctggagatccttacagagatcagatggaggactgcattgctttgatcatgggagagttaaaatccagaggaatcttaaacagccatactctggcttaccaggtataagacaaattaatacttatttttatgaggccatcttgtttagaatgaggaaagcatcttaggatatttctaggatatataaagtgttcgtttcatctctttttaaatggctatttttactttgaatgtatcaactgaactttcaccatctagaaaattttgtactagtgtgttttattcctttgctttactggttaacacatcattaacctttgtgtgcacacatggcagagtcgagtggggccagttcagtggctgaaaccatatactgatgaagttctagttgaactaggtcaacagggtgtaaagagcctcctggctgttccagtaaggtaataataactgcacatatttcatattttggcgattcagcgttttcttttttttctttggtatttccttaagaacagcaacttaaacctgtatctctttatgatagtttaatcttctgcctgcacttatctcttgatgcacatatattattgtaacccagcaatattttctggtataaaatcattatcaacgtagaaattttgtttcatatggcataagtttcttgttgatggaaggcatatgccattgcttgtgtgtgtgtgtgtgtgtgtgtgtgttgtgttttattttgaatttttctcatgttcactatttactgcatggttaatttgcttatccatcaagtacttacaacgtaaaactggaaact

SEQ ID NO: 15677 - DNA, 2931 bp, Oryza sativa
tttagatctataaatcctcaatttcaatctgacgtaagggtatacgatcaaattttcgcactatacgcaggccccaatattaattaacctcaccttattatgctctaggatgctagcgcctggtactgccattgtgctttggtttaaaaagttgatcgctgcataacagtataagaagcttgaagtaaattcaggcgatatttcataccgccagcttaaagaaaagcatgcacggactatattcatgtaggcaatataaaggacctgcagttacacatttcttgacacagcatctgtttccaattttacatccctcatactgccaattttgccaaaccagatcacccttttcatccgactcatctccttaatcaacagccacccgacgaatcacgaggcgcaaagttggactcggttgttggtacacagaaagcagggcatatatcaaattgaactagaaaacaattaagcgcgggagccagataaatacaagttgatgatgttgaatctgaattctggagatgagccaggaggtaaatactcctctagaagaacgtcccttctggaggttgcaccaacttgcgattctgcggggttgccatctccttcttgagctgggtaaggatagtctccatggtgtactcgcgctgccagtttgctagaacaccaaacttcctcgagtcaacctataggatcacagcaccaaatgaatatcaatcagagggagtagcctgcacaaaataaataaacttggcatctacatttgggaggagagaataccgctccagtctcatgattaacacacgacatattgattcttgaatgaaaccggacagatggtggcttctctgggtagtccttgtcacagaacagcttcagctggtagatgcgaccttcatggacactctgccagattgaggaagaaacagacacttagtaaaagttaataatattttatataagcagtacaagaggagctaggtggactctcaaactgtcaaacatgagaaagcatctagagctaatatatgtaagttttagcttgtagtagtgattctcctgcctttatggtcaacataaggaagttgaaaagctcaagtgtgcctcttcccagaaatataattccataaccttgtcacacatatcttaatgccattcaaatagcctttttccactaataaagacatcttctccactaataaaaacccaagatgaagcacagtacgacggtaaagatataaagccacaggagaagattttccatatgagtaatatgatatattgtgagtgtatcaggatagagtccataatctcacattatgtggaccaatgatggtgccagtccaagaccgcatgtagatgtcatctgcatcatccattccatagctcacggttccatctccaatgcccttttcaccacgttcaagctcttctagcaacctgaagtttcgcggaactgcaggcattttacatattagtcaactcctcaggatataatgcagttaccctcttaaatctacttatatagaaattgcataatggtgatatcattgcacagaacaaaagaagacaaaatcaacctagaaacagcatgagaagttttcatacccatgcatcaagtactgaattacagagcaaagacggctacaaccgagataaataaaatggcaatatcgattcccagtttcagaatttagtggatttgtagatgattactattttctgaagaaaaaaaaagaataacaccaatgtatcattctcccgaatgagggacaagagcactgcagctcagctgttgttttcttgtgaagcaaaacaaaattgaatatatctgccattggcgtggggggttaacaacaatgcaaaaaaaaaaaaatgtattgttctgtttgcaagacgatgaagaatcttgtgactcgaataccatacacccagaacagatatgtcggcatttgttaaacgcaagtcattgttttatctagtgcacagacactcagagtgcagtggctctaaaacgggcaatcatggttttgacttctcagattgaagcctgaactttgacttgagattgattatacaatgtattatctcaaaacagaatagtagacagaaatagtgtaacttcacacacaaagttcatcagtggaatataatgaacaaataacatgatctttggcaagtagtctgaatcacaaggccgccgaggtgaaacaatttcagtacaattgtttgaatggtgcaaagttccaacttgtgattagaacacaaaaaggcattacgttcaaacctccaaaccggagacgctaaaagctatttaattccatctaggaaagaaaatattaagagaagaccgaacttaacactgcaagaaaaacgcaatatagcattcaatacccaggtttttataaagcacacaacctgcatgcccacacgaaaaaacagatccagcaaaaagaaaccaacacagtctcatccagccgcgatgaggcctatacaacagctatctaaggaaaccatgatcagaagagcatatctatcttcattaaaaacatttccacttaaagtcaagtgatacaactaataatcccgctgataattatgcctcatagtccacttagagctaatggtcccaggcacttctcagctctccccttgtaacacccaagcagctaaaggaccacttgttagcaaagggaacaatttcatcctctaaggataccacaaatttactgccaaagccaaaccatcatcaacatgccgtaaataaattcgcaaaccgagcaaaccaggccatctagagagatcccatgaccgctgcacgcatgcaaaccaagctaaatcaccagatggatggaacccatatggtacaaaaaccgcagatcgctaattccaacaaacaaaccaacgcgtcggcgtctcgcctgatcacca

SEQ ID NO: 15678 - DNA, 2222 bp, Oryza sativa
gggaaggcaggcgaagtcggaggaggattccttgcggctgtggcctcaactgcggttaaatcgccgttttttttgacaaattgacccttttggaaaacttatttcgaaactaacccctgccaaaaacttcaaccaaaaataggccgtcgcttcagcgccaaacacattggcgctgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagccttctggatggcttgcgggctgggacctctgcgccagccataatggcgctgaccgtgggacactcagcgccagcccacctggcgctgaggtgggacttggccgcaacccccaaggcccagaccagcaagcctgctggatggcttgcgggctgggacctcagcgccagccataatggcgctgactgtgggaaactcagcgccagcccacctggcgctgaggttggacttggccgtttcggccgtggcccagcccagcaagccttctggatggttgggctgggacctcagcgcaaaggtgcactggcgctgagtttggacatgtcagcgccatttagcatggcgcctgacgtcccagccctgccaaactttagcaaaactttgcacacaacagaggcaaacatcaaatcacagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgtttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcacaaaataaaacacatt

SEQ ID NO: 15679 - DNA, 4383 bp, Oryza sativa
gtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataatatgtgcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatatttttagatcatccatcgatcgaaactccaaccccttccttggttcatcacacattggttcgaaggcaccgtcatattgtggatccccatcagcaattgctagcccagatctggtaagatcctcgaattgtgttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccggcacattctcctccacattaacttcctcccttaacggcacattgtcctctgcatgtacttcttcccttaacggcacattctcctctgcatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctatgagtggactttcattaaggtctataagttctttcttccctatcctaccatatttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaaccccttttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacggaggaagaactggctggggcgacctcggccgggctctaagtagccaaggtcagcgccaacttacttggcactgaggttgggcacctcagcgccgaagcggttggcgctgaggtagctgccacgtcagctaggggatcggcccggccgccacggtggcacaatgtcagcgccagtctcgttggcgctgacacggccaacctcagcgccaatgcgattggcgctgagccgatggcctagttttggttgaagtttatggcaggggttagtttcgaattaagtttttgaaaagggtcaatttgtcaaaaaaaacgggttaaatcggacactatatacggatgaaataatgtcgatattatatttgttttcatattcctttttaaaatattgtattacagttttgacccatttttattgccaaagtttttactttgagccaccgttaaatcaacttttttttttattttggattgggtaactgtggttattttttcggtttgaatcacccaactctctttattattcatgtttacccttcattttggtgattttggtgaatatatggctttgcacgtagatggagaagtttaacggtgtaccaaaaccgatttaattagggttgttgatgggtgctaaagaagttatttgggatagtctaaactggaaaaaaaaccgagacaaagttatgcagtccaaagtgaaaagattggtttaaaggtgatttaaagtgaaactttaacaataaaatatgttccaagctgtaattcgctctattgtttatataggtaaataagtatattcaatatgaaaccaatataaattaattttaacatagatatgaattgaataagcctaaatggggaggtctaatgagcaccgctcaagcgtgacaagaggcacaacccatcacacgtggatctagccattcacttttctaaaataaaaaaagacttcatatatgtaaacttcgtacataaactttaaatccgaatcgacatatatattagcttgttgttgtacaaacttttagaactctaggtatataaagctttggtgtatttttttttaaaaaaggaaagatgcaaatgtaaaaaagaaaaaaaatgtaggtgtttgcgcgagtataccatgtgcgaacatttggtaggtagtagcattttcacatcgaaatcgctcactgcgacaaacactatcacgattaacacataattagctcatttaatggatcaaactatgttcattgagtccaacaatacaatatgacctgtataaatgcatgttgttttatactctaattagtaaatatgcttatagcactgagtaatgttggactgttggcaagccagactataattaa

SEQ ID NO: 15680 - DNA, 14085 bp, Oryza sativa
ttaatgttgcttgaatttttatgaataatattaacatgtgggtcattttttggtaatatttttttattatattctaaatctgtttttgtccatgatttgtttaggattgctttgaatgctggtcatgattttcttctaactaccatatcaacatataaattctacactaaaattatttgaattcgtaaaatgttgagtttatgagaaaatatcgtatcgtggaaatggagttgattcacatggacctatcatttgtactatacgtgtttttaatatttagtataacttatttttggagtttctaaactttaagtaatagcttttcttgtgtactatagatatctttattgaatttaggatattttaatggaagaaacgttcaattaagatatatggtaagaggaaaattgtatccaattatgacaaatttatatttacttctactacctccttttttcatatgcttactatgttcttggaaaaatgaatttaaaattgaaataagagagtaattatataaataaaattagtatgtgtagagtatttataaataaaattgttgatgacatttgttgaaattgggcattggtcaatagcatttttggattttgtcatcctatttggtcgtaaatatttgtcaactgataacagatatataatgatatactttctactgtcatttgttatataattttcatgtatgtttggattacatgaaaagaatcaaaatgtgacctaaaatataattttattttataagttgaaatatattcaaaacagatagtaaaatataatttaatggtaaataatatgatggtctaaacttcattttcaattgtagagcaaatttagttatgtatgtttgtaaaagtgatatatgataaaataatatatgtcgccatttgtttgtcatatatgatgaaaagggtcaatatacgacccaaaaaacatttatttatttattataatttaaaatatgtcagcaccagtttaatcatgtctcaactattacattatatgtatgtaaaaattgtatgcgtaattttgaatttatagttgtttagaatttattatgataaataacaaatattatctcaactactataaaatagattaaaaagattaaaggaaaaggaagagaaggtgaggagggtcggttgcgtgcatgcattatgaggatattttataagggttaatggaatccatgccactacaaatatgccattttagaaaaataacattactattcacgatattggctacgtgccactggaatttgagaaaattagaaccatgtcactccatcacattatctgtcaaaaatctccgttagccccaactgcacgtgggacctaagtgtctgtttcatcttcacctccctcccatcttttctctttcctcttcctctctctccaccactgtcgtcgaccaccactgtcactgccgccgtcatcgaccacctccgtgaaggcctcgggagccacagccgtcgccgatatcatcggccctatccacggcaggaggcttgggagccgtcgccgccgctgccatctgtagcaggaggctcgggagcagccgtcctcaacgccatccacgcgggagggctcggaacatgcagccgccgctatccttgacgccatccgcgtgggagggctcgggagccgccaccgccatctctgtcctcgatcgcatccacgatgggaggtcttgggtgccgtcgccgccaccatccttgacgccatccgcaatatcgtgaatagtagtggcatttttctaaaatggcatatttgtagtggcacaaaatataagtgattttggttgaattggatatcctattactacgaatctaaatccatgtccatgcatccaacaaaaatatcttatattttgggacgggggaatatgtattttctaattaagttcttattattttaatcttattaattagttttatgtgttttatattgtctagtgtaaactacgtgttgttaattacatggtttaaaaatctatgtgtttttccaattcaaaatgtgtgttgagtggccaatagctggtccaaagcaatgtatttcttttacttgttaaatacagttaatttgggatttgaattataagttttgttataaatgatctaatagtatacatggataaaaaaaattagctatatatatgatgtagatgttatagttgttcaagaaaaaatttacaacaaaatatgtttcaatctaataaggcatgaaaatagaaaagaggagatgcaccggccggttatgggtgtacgtatgtgcagtttgcagcacatgtacctgtacagggccttttcttttattattaaagtaaatgcaatgaaggaaaatagtgggtcctttgttaaataaaaaaattggtgggtccaccttatttaaaagtgccacgtgttgaatcaagagcgtttgtagaaagatatgtggcggcttaggagtgtttatatgaagtttaatgaacttttagtatataatagatagatgtatgtggacaatttttacatacaaatatattttagaaaacaaacaaatgcctttacattttgcgaaatggcctgtagcctagtggttacaagagcctcggtagcacctgaggtcttgggttcgactccccatgggagcgaattgactccccatgggagcgaattttctaggatttaacggcgctgtgctttcagtggtagacgaggcgctgtgctttcagtggtagacgaagcgaggcgcatgtggtgactttgtcaatctctccaggatttgccgatccagtcttcgaagatactcataaggttcatgggggtgagtgcgcgtgcgcatgtggtgactttgtcaatctctccaggatttgccgatccagtcttcgaagatactcataggattcataggggtgagtgcgcgtgcgttgtgagtgtctgcattgtactgtgtaattctaaaaaaaaaggcctttacattttagaatactgtcatacagcaacagagcgagaaaaaaccgggtcacttgcacacctttcaggccgagcccgatcgagacaccggagtgtctgcaaatgcgtctccgaatacgaatacgattacgaaatacgacgaaatggactcggaataccttctccgagacagacttgtacacgcacacacgtagtgcaagtcgaagtagacgaagtgaccgtatcgctataaattcaacgctcttccgcgcctcgtctcctcaacacaaaaccaaccacgtcctacgaattcgatcgcttcacaccaagaaaacctcgctagctagcttgtagctcgccatgccgggcggcggcgcgatggtggcggcgagcggcgccggccggcctgagtacccgggcgggctcaccatgttcgtgtccatggcgtgcctcgtggcggccaccggcggcctcatcttcggctacgacatcggcgtctccggcggcgtcacctccatggacccgttcctcagcaggttcttcccgtcggtgtaccgcgcgcagtcggcggcggctgcggcggccggcgggaaccagtactgcaggttcgacagccagctgctgaccatgttcacctcgtcgctctacctcgccgcgctcgcctcgtcgctcggcgccgccacggtgacgcgcgtggcgggtcgcaagtggtccatgttcgccggcgggctagtgttcctcgccgggtgcgcgctcaacggcgcggcggcgaacgtggcgatgctcatcgtcggccgcgtcctgctcggcgtcggcatcgggttcgccaaccagagcgtgccggtgtacctgtcggagatggcgccggcgaggatgcgcgggatgctcaacaacgggttccagatgatgatcaccaccggcgtgctcgccgccaacctcatcaactacggcaccgcgaggatcgccggcgggtgggggtggcgcctcagcctggcgctcgcggcggtcccggccgccgtcatgaccgccggcgcgctgttcctcccggagacgcccaactccctcctggagcgcgggaggcgcggcgaggccaggcggatgctccagcgcgtgcgcggcgagggcgtggacatggaggacgagtacaacgacctggtcgccgccggcgaggcgtcccacgccgtggcgagcccgtggcgcgacatcctgcgccgccgcaaccggccgccgctggtgatggcggtggcgatcccgctgttccagcagctgaccggcatcaacgtgatcatgttctacgcgccggtgctgttcaggacgctggggttcggcggcggcgcgtcgctgatgtcggcggtgatcaccggcggcgtgaacatggcggcgacgctggtgtccgtgctcgccgtggaccgggtggggcggcgggcgctgttcctggagggcggcgcgcagatggtagcgagccaggcggcggtgggggcgctgatcggggcgaggctggggtggtcggggacggcggcgatcccggcggggtacgcggcggctgtggtggcggccatgtgcgtgtacgtggcggcgttcgcgtggtcatgggggccattggcgtggctggtgccgagcgaggtgatgccgctggaggtgaggccggcggggcagagcatcacggtggcggtgaacatggccatgacgttcgccgtcgcgcaggccttcctgccgctgctctgccgcctcaggttcgtgctcttcttcttcttcgccgggtgggtcgccgccatgaccgccttcgtcgcgctcttcgtgccggagaccaagggcgtccccatcgaggacatggccgccgtctggagcgaccactggtactggaagcgcttcgtcgacggcgacggcgacggcgcacgacgccggggagacattgagatgggacacaagtagtagtagaatttactcactgcaccgtactacacttcatgtttttcttttgttgttattcagctattattagatgcggattttctttaattactactaaatttcaatgagtgaagatgttgtaacaaggattacatatttgtgttgagttgagtatgccaagtacatatgaagttatgggatcataaacgagttaacacgtttaaactttaaccattaatatctcttggaataattttgatttaagtttttgaaaacaataagaccgaaagaaaccaccaccgaaatagaacctttacgacactctttttccttctcttgtttgtcattaacatacaccaacattttaacttgatctcgagatgcgtgcaatgataagaagtgtatgatttcaactccaatatctcgtgttaaatctccaacacgctcataattttccttttttaattacacggcagacgcatacgcacacacaccactacatacgtaacaccacactcatacccctacaaatgcatatcccaacacatgctctaagagacggaaactaacagcacattcctaatctcactaaagtcctattaaaaatccacttgcatatgcgtagtatttgtgggcaccaggatttaaatcctagtgagtgaattcatgcacccacgactccatcactacaccgctggtgcttccccaacatgctcataatttctttttaaaagaatatttggagagatatctctcggcttcaaatctcattctcggtttatgagctgacttatgcttccatcttcattgcacctctgttgctggcatagtatttcctaactgcattctccaaatctgcctctgcaaccctggccaatatcgaacaacaaacaaatacaaacacacaatttcagtaagagtattggtaattttaactcaaagcaagttttcttacgttctaaatggcctaataaactgcaatcgagccgactatataaaccttcttatagttaggccgataaatgcatatccaaccaaaatattgaccaaaattaatcgggcagcaacctactccaatagcagttccgaattccaactacacaaacaaaaacggaaggcacgtattcaaataaaacaccctcatgttgttgacagaagcgatacactaagtctgcattccatctatttttcaaaaaattatacttaaacaccctccccagtccccaccctggttcaaaaataagtcacataaagactttgctttaaaagtgatttttgccttctccaaactttgcaatggacaaattgttaagtgatcttacacaaacaattacaaagggctctaacagtgtacctaaaagatttttcccatttccaacgcatcatcaacaatggtccaactctaataatttaatttagagtaaattttacaaaactatagatttagcattgaatttattatgatcctacagatttaagataagacgaagtaccataaatctacatgttcagtcacaaaattatcacaaagctacaaatttagcaccaatttaatcacaaaaccacaacacttatagctccaacacaatggtagtactagggactataatttcaatataaaatctatctgcggttttatgataaattactaaatctgtagttttgggtttgcatacatcttaaatgatagtttgatcaagatatctatagttttatgaaatttactttttaatttataatacaaggatagtaatacttccataaagaaacagagataatataacgttatattgcacgaaatttattgatacaacaaaataattgactgttcaagcataaggtggtaaagaagacacaaaaaccttgccacgattagcacgctagtaactcaactacaaacgatacacacagcagcatcagttcactggatggagcttctccaaggatcattctaagctaaggcactcattccgatggcgtgtggcaatgcttctacggttcttcacgatagataccaagacacaatcaggcagtcttgggcttgggtttaagccgcttcaattgtgagtacaggaaaactccggcaagagcgactccggttcctgcagggcgcaaatatttggatatgtaaaggaggtgcgatgcagtcaatttgatacagaagtgaacagaaaatgattcttacccagagagttgataggcgaaacaggggtgcggaagaacagaacggatgtcacaatgaccaccactcgcttgacacagttacccaccgagtgagtaacaggggacactcttgccaggatcatgtacgacaccttcaagaaattatgtgagatcagcaagacatgggctttgcacatgtatgatgattcatcaatgtaacaactgtaatgtattcagcacatagaatctatctgaaatgaacaagcgcatccagagatttcaaaaggccaagctatttttagaaaatcaattagatggctgacctgttggtatgcatggaaacagaacgcagcaatcagtgaccttgtgtatatctgttttaagttcagaccctacataagaaagaaaatagtcaaaaattgcaccaaacaatatgtaaggagcaatttgtctataattaaatatcaaggtgctcacagcagactgcagaactgtcggagtgactttgacaccctctgttagcaaggttactggggccaagaggaagaatgacatcactgtaatgattgagaagagggtaatgttgtccagagattcctgatcagaaattgggaaagaagatcattagaattaagttatgtaagagccatggtgacaaacaatagaggttcaaggaaaaagccacagataggcaagtgtggacataaataaaaagctctgttaaaatacaaattttatcttgaaacagaacattatgaagtgacacatcctaaaataactgatgaatattactaaagcagactattcaagagaaacacacacttgtactaattctgcaattcagttgccaatatctatgatgaccgcactctaattattcagttacctccttcttcaccataagcttcttgctcaacacattccttgactggaaggtgacatttgaggccattgcactccaaaatccagccctgatatcatataaattacagacgaatcaagcatatagcactttgttagctctgctatcagcaggcttatgttatatttgcagtttccacagcgaagacaaaaatagctagctatatcccttaccagttaaatgaagcttcagtaagagatgccaatgccacaccaccaacaattggaacaagagacaatacaacaaaaggagtaggcatctgcaaagtgattatgtatgagaaccaaaccaagaaacagatggtttttctaagattatatgcggttgcatagttatcactgggcaccagtgcagaacattaaaaaattacctctccgaggaaaagtgctgaaagcagaactgaaaagaaaggctccatagccttgatagtatgtgtaaatgacactgcaacctttccaaggctcatgttcgtgaaaagattgcccatggtgtggaccatagcgagaggaaggatagcagcaagctgaaataaggacagttacaatagttggcttcatagtgcaatacatgtgtatcgaatgttgtcacgatgtatcttatagagaaatataattacctgcgcaccggagatctttggtcttttaaggataccggtaatccacatgaacagagcaatgacagtgccgacagcaaactggacatttgtgatgtttatggggtatggaaaaaccttcaaaacctgtcacacataggaacaataaaggaaagttgttttatctacacgaagccaatgaggagatcaagaaatttcaacagattaaccataagtgacaccatatataatgaacgaaaacaaacttccatccctagcacaatttgttttggtagaacattggatatactcactataagacatggatacatatgagtctggacaactttgaagaaatgtttgttctttttccttctatattctatatttctaccagaagacatgggaaattgtctactgcactcactagaagacatgattttagcaatattacccgttcgacatcttataccagatacaaacataaactatccacaaatgtaccttttagaaagttgtgacaaaagtttgatagaaaaggtgtaacgtgggggaacatctctaaaagcccaacgaaataaactaaatcgctcttctttccacaatatacattttgagtttgtactaatccaagatctagacgagcttgagcaaattcttgcacccattcagtaagtgggttagaaacatttacagaaaacgacatataccagcatatggaggcaaaaaaggttataattagaagtgattcacaagacaaataaaatcaatttcaaaatagttccctcttttgctcaacaatctcaacggagcgagtagatctttgctgaatctaaaaggcgaatgcccgatccaagatcagattgccatcagcgaaccattcaccactaacagaatcacatgtaataaatcccaaatgaaacatcctagtctcccccaaatctccgccaaattggcgacggcaatggatcaaagttaaagccgcctcacctgcttgttgtagatgttgaagtagatgttgaagaggtaccacagcccgaagagcgcgccgagctgcagcgtcttcgcgagccctccaccctcctccgcccctgcctcacccgccgccgccgctgtcgccgccacggccacgtcgcgtgcgccccgccgccgctcatcctcctgctccggggaggccggcacgagcccgatgcgccgggcggagatgcccgcgcgcggggccacggcggagaggcggagccccctcggcgggagcagcggctgcccgactccgacgccgaagccccgggggctagggttgcggagctggagcggggcggcggcggtggtggcgccgcatggccggaggagcccgacggccgccgcgctctgcattgccgcccgtgggagccgcggcctcgaaggttctagaagcttcggctcgcgtggggggaagcggatgcgtcgaggcggcggcggcggcggcggcggagtgctcgaggatggcgagagcgtgagagtgggagagaggttttaagcagcgacgcggccgagctgagctggcaccggccgagtctgcatgctcaatgacacgtgggccccgctgattttgtggaccaacatgtcagtgtgttggtggctgtgacgttggctgggcccgcgcttgccagctgctgggtggaccgggagcacggtggtccagcgaggggcagttgtaggtaatggctgcggggcccacttgtcggtgacagtgtggttgtcagatgggtggtggagcaagctcagcgacgagtacgagggtgagactgtgaggtggggcccaagtttggcataggtgcggcgacggcgatgaccagctagctcatcgtggaatgcagattcgggcagaatattcttgacgccgatgctataacagatcttaaatgaaggttgagtaattattcatttggaaatcctgttagtatataagccaaactaatccccttttgtaattttattgagttcatgtgctacactgctctaaagttgtactatgcactaattttgtagtttaactaaaaatgtctgtgcgttgaaatgagcaagactttttccaatgctataacagctattaagagctaagcaacgaattaaaacattggtatcactatacactttaattggaaaaaattaactaaaatcattcattggttttgggtcgaaagcattccttcattccttttcaacccccggcccctagcctaatccgttgcttcctacctccttccgctcgacctaacccattatgtgacattctggcctaattaagatatagcatgtgtggtccatgagagctgtgtgtatgtttagtaccaccttattgtttagcaatagtggagccaacttatagggcatcttccctccaaccatattattcctgagttaaccctttaacacgaaacgatgacaaaaagtgtaaatgtgatggtatgtgtaagtgagcccgcccgtcgaatgagctggctacgtggactagtgacacctataatattagtgtctaaataaaaaccgacacctataatattagtgtcggtcttttcagaagaactgacaccgataattaagatcccaatttttttaagaaccaacacttatatttatactataggtgctggttttttaaaaactaatgcctatgaaaaaaccgatcgaagccaatcaaccttatctccgattccccacacctcctccaccaccatctcctcctcctccatagttgctcccactgccccactctcacccaccccaccaccactgcacagattgaggtccagtgcagttgctattgtgactgcacaatagcaactacatataattagccctctatttcttgatccaatgttccaaatcgcttgctatagtgaattcagaaatatatatattttttatagtaaagcgctacaatacttgctacagtcatccatttcaagcccagtagtgcttgtgtgactgcttaacttgcagtcacactagctactgcacatgaaccagatcccagttgcacgcccacttcctcaccaccacccccaccacctgccgcatccgcctcccccccacccccccacctacctccgccagcctcctcggccttgtcgtcattgccttcctcatccctttccctctcaacatctccctggtgcagtggccgcacggtggctcgggatctagctcttccctctccctctcggcatctccccggcgcagcagcgagtcggtggcttcctgacacaatggcgagttaggatctggccctgatctcgagacctccatgccggtgaggcagcgaggagcaacgacggcctcccactcacccctccctctcctatcatctcttttgtgatttattttgtcatttctgcttctactctcatcttctgtgtgacttattttgtgattttcaattgaattctcatatcctgtgatctatccggatgattttgtgatgatttcgattggattgggatttagtttttgagtttgatttgtgatggtttgggatttgaagaggtgtatgcgatgtggatgatggactaagacggacgaaaatcctctaccagaatccttattatgtagtatttttttattatactagcaaatatgcccgtgcgttgcaacgggtgaaaaaaatataatgataatatatgtttttcatgcataaccatatatgacaatcagaaaatcagaaaattggaacatcttaaatgtaatatcccaacctcgatgatggcaaccttacgatgtttgttttacctaaaataattagattattcatgtgacaacatgcatataatgtaaaatattcttttaatctcattattgcaaccaatcaaatcctaatcactgtgcactcttctctaaataacaattaaaatatgtttattttataagattatttccatataatatgttatcaagaataatagctatacttcacaaaatagtatgataattgcctataaagatgtgcagggtctccaatacgggagaataggggtggaaacgagccgagccgagttggctcggctcagctcgtgaaagcttgctcaactacaggctcggcttggctcggcttgattagttgaacgagcaaaaagtgcagctcggctcggctcgtttcaaagctcgagccggctcgagccagcttgtgatgtacagcagcaagtaaatacttcaacaatagagcaatcaattagcaagccaaatcaacatgtacgatcaacaagacagcaacaacatattatacatttcacaagctgacaagatcacaacttcacaagaccacaattccacaatctccatcattcattcacagcctcacactcacaggacatgccccaacatgacacacataatcttaatagtcatgaccacaccataatagaagcatagagtaatatagttatagtcttatagagagtacataacttagagtagaccacattccaaaagtccaaagtctccattctcaaattcacaaaataattatagaacatctaattattatttcgcaaaatattaaaaggaactctccaaatctccaactcctagactttctccacactccacagcaacatgttccagccatgagccatccatttgcctacataaatgataaatcatcatgtaattgaataatatactacacaaaacacatggctcaaagcctcaaactatagtattggtacaacatttttgatttatttgcctcattctttctgtaattgaatcattgacagtttgacactgacacacacacacacgctactccactgaccacaacaatctacagctacatgcctacatgtacatgcatcacaaaaatgagaaaatacatcacgaacctcttcatcctaggctcgtcgttgcggcgtgatgcatgaattgtcgtcgatcggttggcgacatggcgtctcggcgaggtcatgatggacggcgtcgagtcagggacgccggcgacgcagggggcgtcgagctcggctcgagcggcactggggacggtggacggaggccggaggtggtgcagggaactagggaagggaggcggcgccgcggcgggccgacggcacagggggcgtcgccggggagggaggacggagccgacgcagccacagacccacagtaggggaggtaggcggcgcaaggagcgaggcggcaggaagggaggtggcgggccggcggcggcggcatagagggggcttcgaagttcgaacggcgctgccggcctgccgctggcggtctggcgctggggaggggatggatgcggcggccggcaactcctcttgccagtcgccgccagcgccagtggctgaggaacggaggaaggggattaggggagggatcggatctggggcgtcaggcgctcacgggccacggctcgcgctcggctcagctcaggacttagggtttctctctttcatgggccagacaattgttaatgggcttgggctcgcttagggaactcagttttccataggcttgacaagcctaccgagcagcttgcgagctagctcgggctcggctcggtttgga

SEQ ID NO: 15681 - DNA, 9355 bp, Oryza sativa
tttctcgcgcaattttttttcttttttaatatacggtagaaacttctctttttaaatatttagattagattagattagagataaagaagatatataaaagaactactaaaacgacgaatagaaattagacttttttccgccgctcttttttccgtcctttttattttttttctcttgtattttttttacgaatggttttttggccactttattagtgtcggacctttcataggattcgatttttttatcgagtcacatataattcctttttctttggaatcagatattttttattttttcgcccttttttttaccgcggcgacggagtcggattagtttctatttttccttttttttatcggacagatttgtttttttttcacccctctttttatcggattttttttattttttcgcttggttttttcgttcggtttttttcgtccagtcgatttttttaccatgtcatatataatttctttttctttggaatcggacagttttttaaaatttttttcgccctttttttaccgattcgtttcgtttttttccttttttttgccccgtattttttttgatcggactgatttgttttttcgctcggttttttggatcggacttttttctcccgtttttttcgctcccttttttttatcggacttttgtttcacccggtatttttcgctcggttttttccgcccgatttttttttgacagacgaaggaatcatcttttatttttttaagtagtagagagtagagatagagatagagatagagaagagatatagatataaatatatagatatatatatatatatatatatatatatatatatatatatatatatatatatatatatatatatatatatatatatatagattaaaaccaaaacataaaattgaaaccgattcaaatacggatgacgtaccaaacttccggtaaaaacatccttaatttataacagtagagataggtaatagagatcagatggtattttttccttttcttttgactttttttggacggtgtttctttttcttttcttttttgcatcctgaacggactttagcgtttttctgtttttttccgtttattttgactttttttagggtgtttgttttcttttcggttgcatcagatcagactttttttccgtctttttagtttcttttacagccggcatttttttccacagtttttttcgcacggtttgtttttcgcccggtttttgatcggacaatttgttttttttttaattttatttttttcgcccttttttaccgtgttgacggagtcggattcgtttttctttttcttttttttttgtcctttttagatcggacagatttttttttcttttctttttccggttttttcgcccggtttttttatcggacatatttggttttttttcatccggtttttttacggacgatggaagcatcttttatttttttaagaggatagagaatagagatagagagaatagagatagagataggtacatagatatggtttcttatatggattgaaattggaaatgaatttttaaaacatgcatgttaatggtggcaatcttctgggatctctagcatataatgataaacacatgcattcggattacaggagctccgaatttgactaccacatccacaagcaactgcaagagcggaaataacaggttaattaattaattaattagattaattacgtcgtaccaccctgtgcagtgcagaaattaattaatttcagatatacatatgatcgatggggtcgatcattcaggacacgataagcatcaagaacgcggacacggcggcgagcacgggccgcgcgacggcggcgacaatggcggcggcggaggaggcggccttgtcctctccgggcttcatctggggggtgtcctcggggcactcgaggccattggcgccctccttgcaggtgttggcgaagaggcccggcgggtacttgccgtagaggttgatgtagctgaacatggaggcggcgcaggtggtctgggcgtcgttgatgtaggcggtgaaggggcacgccaggtccttgagcgcctggcagcacagcgccggcgggtacatcggccccttgcacctgctcgtgatcaccgtgtagttcgcctcctcgaagttcaccgggcaatccttcttcgcctgcagcaagctccgccccgcgccgccgctcgccgccgacgacgcgcccaccgcctcatctgcacacatacatgcatatagtgttcgtcagatctccagatgttgcgtttgacgacggtgaggaggacggacttgagatgaagccggcggtggaggcggcgaggacggcggcgagcgcggcggcgaagagcgcgacgcgagcgtgcagagacatggcgcgcgccctggcgggatgactagtggccgcgcgccgcgccggccgcctctcccgttttctcgcgtgcagagagacgacgacgacgacgacgtgcaggaggaggagaggagttaatcgctcggcggcggcggcggtggcggcggaggtggaggtggtggtggctcgtgcgggaaatgggaggaggcggtggcggtggcgggagagatggagaggagagcggaagcggcggcggcgggcgcgcgcggccgagccaaatttggcgggaagagcgctcaaaatagccaacggtttttggacggtcacgaggaccacacctcacagtaatctaatgatagagttattatgagtttcatcagtttcagagtttgaaatttgagacatgtcgagtgtttgaattttgaatttttgaacatgagtgtcctcgatctcctatgtttctattgctccatcttggccgatttatgaagaactgcagttcaggtttcctatgaaatgtagagaattttttttgttgttcttcgaagaattgaactggtttttgcgagaatcgtaaaaatatttctgatagaatttttattcgcttgaaattttgtgacggtgtagtaaaattttgagcaaatttgaattggcaattggattaattcaacgggttgttcgtttcttgtttcattggtactccctccgtttcataatgtaagtcattatagcatttcccacattcatattgatgctaatgaatctacgcatatatacttatttagattcattagcattagtatgaatgtgggaaatattagaatgacttacattgtgaaacggaggaagtagcaagatttcggcgtgcgcgcatgattgcaagattcatggagaatgccagatttgccagcaaaaaaaaggcaccaaaatccatacgaaattggttgatttatctcgcaaacatcgacaccttgggatgcttctgatctaaatcctaacaaaactaatcagaaatttattacaaaaaaaaatctgatcagtccgtcagattcttcagacggcgaagaactccaaggcgttgcggaggagccggccggcgtacgggtttgggtggtcggggtacgtgcacccggtgctgaacagcagccagtgtcgccggcagcgcttcaccggcaggtcgccgacgacgcgccgctcgccgccgggcgccacgacggacaccgcgtcgtcctcgaacacgaggcggcacagctcgccgccgctcgccgccgggtcctggcacgccgccgcctccggccactcggtgtcgaacagcttcaggttggcgaggtagttcccctcgtagccccagctgcagagcacccaagcgacccgctcgggccccggctcgatgaggacctcggcgacgcgcgcgccgccgcggggaacgcggccgcgcggcaccacgctgagctccgggtagacgtcgaatcccgggccgagcgcgcggcagacgagctccatgccggccgcggcagggaggcggttctccaccgaggcgtagtaggacacggcgctgcggcgggcgggcaccgtggccgtcgccggcgacggcgccaatgcgaggaggaggatgaggacgccgatcgccggcacggtcgtcgtcgccgcggcgaggcggcggcgcgccatggtcgacgatcggtcgccgccctcgcttgggcgcgaacgtgatgtggtggcttggcgcgttgcgtgggccatgcctccgcgcgttttttaagatgcaaacttagctcgcacgtgctgtgcgttgcaacggaagaaaccgcatggaagaggatactcacccctctctgtttagtttaggcatcaatcgaaaacatgtgaactttttcttttttttttttgctactaccttcgttttaggttattttacgttttgagtttggttaaagtcaatctgttttaagtttgactaattttatagacaaatatattaatatttataatactaaattggttacatcaaatcaataattaaatatattttcataataaatttgtcctgggttgacaacgttactatttttcaacatacttggttaaacttaaagcagtttgactttaaccaaagttaaaacgtcttataacctgagatgagggagtatttgatattaaactgttggtctgtttttgcctctaactctgaccgaagattatctgaaattcttgcattccgtacggggtgctagtaatatttttttcgcatattagaaaccgaggaacacaatctcgatccattttcaaaattttgaatcaacttttggggaaaaaatattgaactttcatacgaatttgacagttttaattataaatgttgcctgttttagagcatagctcttagagcatcttcaacagaaactccaaatctcactcttcaaatgactatttgtccaacttgccaaaccaaatggaaagtctaatttgcatttcacttcaacagactctctattacactatcgaatctaaatgtgggtctcacctattagcctctctactatttcaccgcttcttcaccctctctctcctctctctctcccccctctcctcttctctgtcgtgccactggccaaatccccgcgggaccgtaggcggtggcaatggtcactgtcgccaccaccatcctcgtcgtctcgggcataagcggtgaggttgtgcatgggcgtgatgatgacgaagcggtgacgcagatttgggcaaacggcgacgacgtggattcagccaaatgggtggtgcaggacctcttgctcgcaccggcaagggcggtagcggcactgggccaacaaacaaaggcggtggtcctgtagggcgttgcttcttcttcggattctcctgcagggtgccgccgcctacggagatcttgccattggcttgccactccgaggggaccaggtcccgtgcctccgtatggtcatcggagatctcgccatcctcaagcttccgccgtcagccactacctctcccttttggccactctgctcccgaacggagaaaaagtgaatagaaggttgtgggacccatggatggcaagtgggataggttggccaagtttggcaagtgagggaaggagtttggccatccgaatggcttagagagtggaatggagaggctgttggagtacgattttctttcaaaataaagttgctaaattttgacttggagagtgagatggagaggctattggagatactcttaggcttggttcgaacctattggttcgcaactcattccccgcatggaaaacaaggtagcccattagcgtatgattaattaagttagctaaaaaaattgaaaaatgaattgataaaatttttaaaacatttttctatcgatttcttttttacaaatgccacaccatttagcagttggggaaacacgtgtgtagaaaataagagtgtagaagatgagaaaggagagtgtcaaatacaccctttgacgaatatagaatcactcatacttctttgttaaaaaaattcggacctacctatgtaataaccaacatttcaaacttcaaaaataaggaaaaataaaataaaattactcatagaaaagaaatattttggcacaattttggatagagctaggcgttagtcgttgtttcgtaagttggagaaaattgtttcatccctggattaaatgtttcagctcagttcatcaattgttttaaaggatgcaacatttaataaatattggttgcaacaccaacaaaccattgtatgaaatgttgagcgccaaccacactcatccaaaaatattacaaaatcaaaacttaaaatgtgcaatagatgtatgaaacatcaaattttatttgttaaaacatatatatttatcaatcggaatataattacatgagatcttattgtaaatatttaattacaatgaactcgttagcagatcatatatcagataaataatttagaagagaaaattgttttaaaaatatatttggagagatgcatccatgcatagtcctccttggaggcggtgttgaggtatgccctctttccttctctgacgagtttccccgaggaaaaacctcgctcaagagtccttgggcgggtgatggtgatgctcccgtgtcgcaacctccttggaggcgtcgtccgtggagatacctatgcctttttcgctttgaattgttggtcctcaactgcaacggtgcttggttgtcatgatggtggcgagtctgtgtgggggaagagcgcatctttcttctctctcacatttttcctccaaagctctaaattgtgatgatgttcgggagtcctcacttttggtgattagctgcctagcaaggcttatgctggttgggcggtttgcggtgctcttggctctatgttgacgggtgggtctatagggggatgggaagatctttctactctctcaccctctccctatgcaatctaatatcaggatgtcatttgcgagcgcttgtgtccttcagttgtttggctctatcagctttgagcggtgtcgcgatgttgtaggcctagcagcgactggtctcgcatagcagtagctagcttggtgcaaggttttctccctagtgatgtgtggtggtaccgtcggcatgtggttggcttgtgggtgagctggctgagtttttcttttcagttttcttttgcttttccttgattttagtctccccaaggttttaatctaactgcaggtgtgcgcgcagtctgagtggcgaggctacggcagtctgatcggcggcttgggagcggatcgaccgatggcaacaggggttcgtcatctactatgttcgaggaaaatcttttattccgcaaaagattttgggtttttggtttacctaccattaacaccccctcccccggtagctttgtttggtcttgttcaatcctggggctgtttggttcccagccacactttaccattacttgccaacaaaagttgccacactttgcctaaggtggggtgatcaaattgttagccacaacttactaagcctaagggaatcttgccacacttttttgagccattgacacgtgggacccaatttgttggaggggaatcttgccacaactgtggctacaaccaaatacctgttaaatttgcctaaccttaggcgtggcaaactgtggcatagtgtggcttgcaaccaaacacacccagcattcctgcactcctaattaatatatataaattcattagccataaattattttccagctcgtgatacacgccataatctgaaactcagatagttaatttgcagaaaacgaaaaggaacattagaatgagatggcaaagccaatttgctttgttgtgacaaagaaaaaagagaaaaagaaagatggccaaggaatgtcttgccgagagatgtaatccaatgtatttattgttgaaagaactttcaggcaggggcgttcttacgttattctacctggatctccgaatcccgagtagaattttaatttttagttgttttagcctattaccatattattagttcaaaattatagtaatatactccatatgttatgatatgtatgtgacttctgatgatttttttctgggttggctattgctttcacatactaacaaaatgaaaaaacagacatcacatcaaattttgcattacatgaaaaataagcaacacagtaactaatcaggattcaggaggaacataatactgtttgcaatgcaaattgtttccagcctgccaagttttgagcaagcctctgtgcctgtctgcagatggaatgtggagctgagcctatgtgggctatgtgtaggcgtgtagcctgacaattctgacggcgcctagctatgcgaaatgttcccgcgacaacgacgatcgatcgtatcaacctcgatcgtccaaacccgtgggatcctagctacgaatgtcctggattcatcaatcgaatggcggaatgggaggctttcagagattctgcgcgatcatctttcctgttcaaatctaaccatatgcaggcaacacagattcttcagcgtgaagaaaaaaaaatcatcagcaaagtgagcatagctatcaactactccctctgtttcaggttataagatgttttgactttgatcagttaaactgttttagtatcaaagttaaatttattatataaatatgtttaattattaatttaataaaactaatttggtaatgtaaatattactccatccgtcccagaatataagtatttttagagttggacacggttattaagaaagtaggtagaagtgaatggtggtgggttgtgattggttgagtagtgaaagtaggtgaggaaagtaaatggtggagagttgtgataggttagaaagagaatattggtggagaagctgttatattttgggacaaatcttgatggctaaaagttgttatattttgggacgggtggagtactatatttatctaaacttagtcgactttgaccaaagttaaaacatcttataacctgaaacggagggagtagttaggtcttttgtaatgcaacgtgtttatatatctcggtccaagatataaacttaacatggatactctcgtttacagctagctgtgttttaagtggtaagagacatacccttcaacagcaagatattcatgataacttcgtcgatatcaagatgcgccagcctagtcttcggaggttatcataggggtaaaatgtgtttgtgcgcgtttataaaagtgagtgttcacgcatttatatcagcgcatgtgtctgtactgtgtattgaaaaaaaaagaagaaagaagaatcactattgtatcaaccgtcccttcgaaagtccgagttagaagacttcacatacgccggcgaaacgagtgaaaaaccacccacagagaacgcacgaaacggcgagagagcaaaaacaaggtttggttttgttgctttctttccaggaggccggcgacgtgaaagggttccaacaggtggatgctgaccaacgcaatgcgccgacg

SEQ ID NO: 15682 - DNA, 583 bp, Oryza sativa
aattcacacagttgcacccttgaacatcgaacacacagacaaatgcaacaatggaatctggggtcaaatttctgttggtgtcatcagagggccaagaaactgcaggagcaccaaaaagtctcactttcttcttcttcttccattgtctccctacaaaaagggctgcaagaacacaaggagaaaaaaaaaaaactgcaccaagaacaaattgcaaagtaagtttgtactttgtactttctttgcagcaagaagagcaagaagggagatgtccatgaacgcggacctcggcaagccgagggagctcaccgggttgcagcagaggagggctctgtatcagccggagctgcctccatgccttgaggtttgcaagctctccttcatcctcaccacttgcaagctgcatcaagctactttttttcatcactaattatgaaaagttgcaagttttgaacacagtatgttcactttgtatttaggtccttgtatttgtattctctcaaagtttttcaaccaacatgttcagggaaaggccatcagagtggagtttggcgattcgacgacgaccatcgacccgacatgcgca

SEQ ID NO: 15683 - DNA, 653 bp, Oryza sativa
cactgggtttttaaacatattcctcacctatgcgaggcctacatcgaggtagtgcctttcttagatcttattattgctccttctatgaactccggtggatggaagccaatcgggtttcaagatgttgtatggtttcgccttcgtgatggcatgaaggcaagatacatctctttccaatgccacacatcccggagccaatggaggtcgagatggttctatctagagctcaaagaacttgaaccggttcttgtcatacccgaggttcagccggagcattccgagaactggacttctaaacctccgttgacaccctctctccaagcctttgtcaacgctgtgagcgaccttcgagagcaaggattgaccggctatgaagtcattaaggactttgtcagcggtcggatccaaccgctacaagcccgtgctcaccccgtgttcgactacacgggagcagcaggatataactcgaatctcttcgcggggtatttgaccttatgttgtaatcttcttcctgctttcgacgatgattgcgaggccaagccctaactcatcctctcatatcttcatttatctcagatctccccgccaacatcgtggcgcagcgggtcaaggaagtctcgatcagtccttcctctacggtcgatgaaacaccg

SEQ ID NO: 15684 - DNA, 7761 bp, Oryza sativa
agattggacctcatgtttaaaaaaatcctccaaaatccctatgcttgaggcaatcttaaggaatttcataggattttggaacaagtattccattgtttcacataaacatgtacgtaaaaaaattcatagaatttgaaccctatataattcatccaaaattgctttgctccaaattagccctaaaagaaaaaaacactagcacataactacagataatgttagataaaagattatgttggcgagaaaagtcacatttacagctactagcaatatatttgtacatcacaatggaccatacagccgaggataaagccaatgcccaggagtgtgaatcgagcaaaaggttccaatccaaccgtttgttttaaccaactatttctatttagttttctatcactcaataattttcatggttttcttccgtggagacgtgttacacacctaagggaaggaagacgactacgctttttcagcacgagagaaatgacccttgtgctatcataattccttccacttggatggaccagaaaatccaaatgaggaaaatgacaagggctatactgcaaatctgctcacctcctacctagagagacagagagagagagagtccctcagctttgctgcgttgttcttacttcctcccatggagtacaaaaggcaacaagcagaaaacgttgcgttcacaccaccaccaccaaggaggccaggacagcaagaccaggcctgggctgtagctagctagctagcttgtagagaaagagagagaaacactggagctttagagagagagagagagagcaagaagagctgaagaggaggaggaagagctagctatcctatggtgctagctgtagctagctccgacgactgaggtgaggagacgcaatggcggggagatgcgccggcggcggcgacggcggcggcgagggcatgctggcgcggctgcggagggcggcagccaggcggatcgggctctcctgcgcctccttcttctcccacgccgccacctccccttccccgcctcccaagaccgtatgcattctctctctacatttcatagattttcttttcttttctaacggttcagatataatttagcagcaatttgttcttaagaaagagtccagctacccaaaatgcctcattttttttctgcattttggggtgtttcttcccagttgggtcagatggttcaagcataccactacagaaggggaataaacaatggagggctgtcttttatttctctttatctgtggcttaacttacagttttgggattttgttttcaccatcaatgtatcggtttctggttgttcttggctttcagtttcttgctatgttttgggactgggcattttttgtctctctactaccatctgcaggtgattttcaagttcctttccttctagcagtaaaactcaatgagctgtcactgcctgtccttttcacctcccacattgcaaccctgcttgattctctccttccatttcagatgttgtttcatcaaaagcaaaaaagaaaaaaaaaggtctcccattgccacatctccttgcatttttttccaaaagagaaaaatctcctcccctagtggcctgctgcattgctgttttgcattttccaacagaaagatatgtcctggtttgttttggtgatcttggcctacaaaattttgtggttaaagttacatacgtttgaacatttaaactttgcttctcgttttttatacttttcttttgggcattctagaaatgagtatcttgcatgcccttctattttatctgtattctgtactgaagttccaaccagaatgaggtgtgtactccttttgcatttccccccttttcttgagtttgcgttgtgaacagtgtgctaacagtggctgtgtgtggcctacctggtttatttgatactgatcattcatttattggaattattgttctaggagtagctctcatccatcccatcttgtactagtatcctgagaaaaaagaattgcaatagggggggggggggtaccattcttgtggttcggtccatgtttatggtcccttcatttttctcccagagatctactttggatctacaattctagacatatatagtagtagtagtagtagtttgatgttaaaagctgtgaacaagttgtattttgggtttatttatacttgagatattttttttttgttgttgtttcagttgttggtgaaagttgtgcattctctctggtcttcgtacattttccacgtagaccgtctgttgatggttgttgcgaattgggcacatatttccacggagcttttatgtcttcccttttcctcaattttttttttaaaaatgggcatttatatttctttatcctcccgaagttgtgttttcttggaattggttatcatctttacatattgtccacttatcggtgcattgtactaccttgctaacaaactctagattaatatctttcttcagtaacttaactgttattagtgttaatgtgtaggcactaggcagtactgttactgtatgagatcagtgtgtggggactgaattgtgtgtctagattttctcgcttaacagttaccaaacattgtcgatgcccatgtgcattttatcatatcattgataggtaaataggaggggaaagtaccaaaatacactggaggagacaatcttgtttttcatttactttttctgatgtagaagcagattattctactagtcaagaacagtaggtattttgcctattagctgtattgcaatgtagtaacagattgtggtgtgtatgcagatctcatgctcagcactgaatgcgcctgcagacagcactgatgaagaccaggaaaagctggaggagcccactagcacaagaatggctgacaaggtgccatccctatgtccattttcctccttttcatgttctggaccacaactgcatggatccactatggagttttctatatgtaaatgtgtttctctaaccaagtagtataattatgtttatatttaacctcctattaacttgagaataaatcagagttatgcttgactgccatcaggaattaacaactgagcaagaagacaggctaaaaagaagaattgggttaagcggttgattgcaataggaaatattattgtttatatagattcctcagcgttgaaggttgttgatgctctagatgattacctctgaaataacctattctggttagccaaagtgtattgtcaaatgttgaatcatgatgatctagccaatgtggttagcgttttgccatttccacgactacatgttttgttttgaagaaaaaacagtgacgctattgtaagcattttcttaaaaaagtatgtaccaatttatttagtgaaaatgatgggttgcatggccatccactagcatctaccattgggccatataagcgttatgtttttttgttagtttcaataagttgggagctttagtactttttggtggcaattggtgaacaattatgtggtctcccagataacatgataattgtttccctagtgccacataaaggtacaaacaataacaggtaaataccttacgacacattgcaaccaacatgtcaatgcatcagtattacagaaatcttgaggaagacatgttctttttttatttgtctaacagagaatttggaatgtcggggctattggccatgcatattatgcatgatgccttctgcatgaattaattcatatgtaagtcatgatgcatataaatataatcagcttgtttgtttcagtagtacaagaatagttctgcaaagattgaaatgtagtttgtgaagattagcttcgattggatgcatgtttttggaattttttttgtttgctaacagaccatgaaaaattcatacaatgaataattaaaaaacaaaatatgtccgcgtcgtaataatcgatgaatagttctctgtccaggaattcgctctataatgagtagtttccattgttttataataagtgtagtgattcttttatggtaagttatttgatatgcgattttactttatactctcatctgatgtgtattctgataaataataccattaattgtaatattttattcaattcatttgcagaatctctgtgcaatatgtctggagcccctcagcaccggcagcgttgatattgacaatggtgacaggccagcaatcttcacatcacaatgctcccactccttccacttcctatgcatcgcctccaacattcggcacggcaatgttacatgtcccatctgccgtgcacagtggtctcagctgccgcgtgacttgaaggtgccaccattgctgcagaacaaccagtctgacccaatcctccgcatccttgatgacaacatcgcgacatctcgtttcaacagaaggtcatccatccgtgctgcccggtacaacgacgatgatccggttgagccttacaccttgaccgagcatgtggatccatgccttcgcttcgctctgatcccatccccagtggcggctcaccatcatgctctcggacattacccttgtggccgtgtgatgccactgcagcagcattgccagtacagcagctcctccatgctctcaccgccacagattgcttcaccaagtgggcagaggcgcgcttacctctccgtcagtctcgcgccacagccagccatggacctagttctggttgccagccctaatgggccacatctcaggctcctgaagcaggcaatggcgctggctgtcttctccatgcgcgcaattgaccggttagccattgtcacaaatgccaccactgcaacccgcgccttccccttgcgccgaatgtcatcccatggaaagcgaatggcattgcaggtcattgaacacctctgctgtgttggtggtactgatcctgtaggggcattgcagaagggcctgaagatactagaggaccgggcgcaccagaacccaagcagttgcattcttcacctgtcagaccatccaatccgaagctgtttcggggtcgacatgaaccgtttcaacatcccggttcaccagttccatgtcggcctcggtttcggggtgcagaatggctttgtgatgcacgagtttgaggagctcttagcgcggttgcttggcggtgtcataagcgacacccagctcaggattggcgagcacggtggagtggtgaggctaggtgagctgaggggtggcgaagagaggaggatcccgcttgacctggtgtcggactgcggcttcatacttgttggctatagctatctggaaggtggaagggaggatcagttcaggacaggcgaagtcgctgtcggtttcgaagagaaaggcgataaccggtactgcggggtcagggatgccggtggtctgagtatcggcggtgagaggaggagcagctgctgcgccgagagatgggactaccttgatccgttcatggcgcggcgatgggcgaagcatttcaatgtgtatagggcctgagttaaaaagagggggagcttggggctttgaagtgatcagctcagcaagtctggtttaccagtttgacagcatatgattcttgttggctctttattttttttttcctctcttaacattcctgcaagcatctcatgatcatcagaggaaatgtttgcttttttggcttttgttgtggatcagggatccatttgtaagatgtctggttttgcatcagatgtgtgcaatgtgcacaaggctttctgttctcaatctgtatgtgtgaatcggactgtgaacaaaactcagcacaaagaatgaaatatggctgcattggagtgagttattttaaaaagaaagtgacatgctgtttttcaaagaaatttaacaaatatgatgcgttatactagcaatttgcaggtttactggtctctgatatttcattgtaattattgagctgtcatttcttaaatttgattcatatttttttaagaggtttggtttcatattttcatgctcccttgtactcttacaaaacattgatgggttaatcaatcatcttaatcgagttgcccgggcgatggacgatcgactcctttggattccggattagaaggcagttatcataatttgaggaatcaattactcaaaattacatagagaattgtggcatggaaaaaggttaaaaaaaagaggtgccacgttatattattttggatttaaaagaacgtatggtcataaaactttgcgcccatagcacctgaggctcagtgccacatgatgcaaacatgcagttgttttttccctacgtagacaacaaaacatataggatttctgaaatttactctaacaaaaatatgggtctcgactctcgagtcacaaagtacaatacaattcagttcaagcggccaggacattaataaaattgaagttacaatcaggacccaaactgctgtcagaaatgcagatcagaactcggaaatcaatctacaatgaatagttggtgacggtaatctgctaaccatcagttatgtgctttcaaagccaaatattcggaaaacacctgcaaaaaaacaataaccggtaagagggttaattgaagctatttttataattaataccacttccattttggtttaactttctctcttgttgtgtactgagcagttgcagaattatatactataaatgaaacgcaagtctgaaacaagtgtatctgaagaaaatgaattcactatcttgtagcaagtcaaatgccaagctagacatttctttcatttggccgaactaaaatgagtgagcagcagcaattgtaccttcatcagcctggtacttgttcttgtcgtctcctgcgtaagccaggaggttgtacttggggttccattcaacactattcatagctgccttgcatggaatctgatgaatcgatcgtccagtttgaacattggcctgatcgaaggatagaaatgtaaaagaattattatttttggtaacagctagcttaggatcatattagaattacagtatgttgaactactcacaatgtcaatgaagggatcttcgctagcatatgcaagaaactctccagtatgattgaagctaactgttcttacaggccacctggaaaaagaacaaaaagaaaagatgaagaaagtacatgtttctaagcatcttgcaactgaaggtatactctaattaatctttgtttctttgaatgactatttccaatatgaggtgtggagaaaatagcaaaattagctaaacataactttttgtccaaatattcatggcaatattttagatacattggagagaaaaaaaaaggtatggtttaaaagcagcgaaacatactcgagtttggtaaaggttttaatgcaaaggagctctttgacatcccaaagactgacaagtgaatctgcacttccaacagcaaaatacctggcatcaacacattctgtaagtatccttgtcaaaatcattttaagctccatttagggctcaaagaaacaaaatattcaccagataattgagaacaaatgtacaatactttggcatagctacactaatgcatgaaacatgtttgtataccactatatccatgcgaacaagaacatgatacttttccacaataaattttgttgaggttcatgtagcagctcaaatctccaaacattaacatgaagacttgcaatggtgtatagcaaataatccattcttttacatggagtagaaggcaacaagtggcaaactattttgcaccctttcttttacatgctagtaaaggtgcctgttagttgcaacgggagatgggggaaggacgtgctatt

SEQ ID NO: 15685 - DNA, 1376 bp, Oryza sativa
agaaacactgaattcagtgtcccatttatatttaggcatgggtcatcatagaatcacttatggctaggtgctatcacaggtgagattcacttaaaggtagcttggacagaaagttcttttttttacatataccagtatcactatcaactgtcaaaagaccgagatagaatacaacattagtaatacccaaaatatagtatgtcaaataacttcactcatgcctatgctttatattaccttgaaataaaaaaaatcgttaactacataaaacaactagcatcagtataaggcattaagagaattagagttcaaagcgaagtcaaacagcatatagagaacctaatgattatagcataaagttcaaaagataatgtagttacaatgaaatgtcattggctgagatgtgagttgatgttgaacaaatgagcgaagacagaaaaaatcatcacctatcaaggggatccattccaatgcaataacaacccgctgtatgagcattcaatttgccaaccacatgaagggtgtcatcaagggaaggatcaccaaatacctcaacatttcctacataaacagcaaacaatgtaattacactgataccaactggtgtgatattgaaacttaaaacaacatatgggttttgtatcttaccaagtccagtagtgatgaagaataaatctccagttttgttccatgcaatctcatttatctgaggaacaacaaatcaataatttacttcagaaaagttaactgatctgaggagctatatgattcatttttatcagtagcaggtgtacgggcatttagctagttgaaatagaaaatttacaaaactgcaacataagtaatgcagcaaatgaaattaaagtacatcgaatagttaggtaattcacactcagtagtcagtactaattcaaataccagcaggcaattttcctgttccagacaaagatgcacatgctgccgacttatgcccactctactttttctcaaaaggtatatgactatatgtgcatgttcattcagagcagcgaaagattccaaaaggaagaagaaaattgctagaagaatgtttcaacaattcaaaccttcaagtggaaagtacctcataattaaacttaaatttgtgaagggcttttagcttccgaacatccactattgtcaactcatcctcctgcaaatcatagtgacagctgttactacacttgtacaattttataaaactagaactcacaaagtaaacacattggtgtacgcgggaccttgcgaactaacttgtaaactttataaaaattggtttactacaattattataaaatttacacaccactccccagtccccatgctcaataacactttactaactttgcatagcaaaa

SEQ ID NO: 15686 - DNA, 15898 bp, Oryza sativa
atgtacaatcctatgaaaaaaatcgaagtacaactaaaaaaattctgaaactaactttcaggtagagtcactacacaaaagaataagacatcttgtctggtaacaacaagttcattgtaaatggaacatagggattgaacaaagtgacaaaaagggattcatcaatttcagagagaagctgagaatgctgaacacaactgtggatatcttagttctttaaccttcaaagatgaagggaaccacttactccgtgcatcccagaggcgaattgacttgtcagcagctgctgtagcaactgtatcaggatgcttcggatcccagcagagctgatctacacaatctgtgtggcctttcaattcaatgtctttaaccttggactgtgcaatataaaaaccctaatcagcacagtactgacttggtacttccagggaaatagaaaccatctggggttttttcccctcctacgttccaaccaaaaatgtcttagtgttctcaaaacaatataatttagcttagaatttattttcctcaaaaccgcaggagggctgcgcttcctttcattaagaagaagaaataagtacaactgagggatccaaaagaacccctagctaagaaatcattcacaatttcacattaaatagctcaaacatatgtctcagagacacaggctatggtatgcttaagtgtgattactgtctgagtttctataattttaaattatacagcgggagatatttccaattaatcatcatgcttatctttcaaatttatagaaatgttcataaaaaaagggtgacagttattcatagtgaatgacaataaatgcgtttatctaataattccataataacaatgaaggttattttgtttgcaatcaggaaaggagagaatgtttacatggccatggggatcgatactccatacacgtgcagtatgatcaatagagcctgaagcaagcttcatgcctaggcagttccatgctacagagtgcacctaacagtaaaacaaaagatcagaattatacaaaatttaaggctgattatgtatgtaagatagataaaaaagaaggcaaaaagcgacagaaccagttaaatgctgcacctccatgtgtggaaggattatttagaaaaacaagaaacagaattcaagaaagaaacagagaaatatcgttgtactatgattctttctgcaagtaagatttttttttccctttgaattcttcccctcagaggagtagcaactttacaaagtcagacaagaagtcccttttcgtgaaaccaaattccttcaaaaattaggagtaattatgaccaggaatcatatttgacaatgcgctcattcaccagctcccagaaggaaagcaaccaaccaaagcttcattcaatctcaacatggcttagccctagagcaaaagaatcagcatatatacggcatgaacgcgaggaatcaatcactatatcctgctctagaattagaaacaaaaccgtacgtgtgaaccaaagatggatgcattttcgtcctaatttttgcttgtaacatccggattttagggcttccccctcgcaggacttttgagggtttaggacctcatgagaaaaaaacttatccccgcgtaggattggtgaggggggaatcgaaaaggttaccttcttcttgtggccgaaatactccctcgacaccaggttcttcaggttcatccccggcgtcgagcttccgccaccgccgccccgccgtctgtcgtcttctttcccctccattgtccccgcggactggggcacgggtctggttttgctattccccactcaccgcgtcacgaggcgcaaggcggcggcggcggtggcggtggcggcggcggcgggcgcgagacggaggagggagagccggggacggcgtcggcggggaagaggagagggttttcgcagaaacgtccttctacttttttgtttattcatgccacaagttcatgcgttatccttaccatggagccatggacacatcctttggtttttgtttaattgaatccatgccattgtaaatataccgataaatgttattacaattcgtcttttttaattgtgacattgaaattttataaaattagaaccatgccactatagtaatattttccatccatcttcgtcttcttagattcatctttcccctctttttttttctcatctctctccaccacctctttggaggggacagccgctgcggctgttggcaactttttgtgacaagtcgacaattacgatcgcagcacctaaacgccttgcggtgatatggagtcgccaaccacctcgatctagccaaacggccaaatcaagatgggttttgtagaaaaacagctaaaccggctagcggagccgatttagagatcaaaaatcagcctctaagccgatttagatcgatatgaggataactaacctgtctcataggcaatacggaaggttttcaggacaaatctacaaagaggtgtcgcactctcgcagcggcggcggacggtttacggcgcaaaccgacaaagatggattaaaactagggtaaaatagaaaacatggtaaaagaacgattcaagtaaattgtattcgggggttttacaatgaaccggccttgtcccttaaataggggttggtcttaccctctacaggcccttctccatatccaactcgggatagaaaccaaaggaaacacgaaacctaccttcccaggcaaggaaacccgagacccgacgaaaacaaactcggactcggaccctgacggtttgaccgcccacatacctgcggtcagaccggccctactagacggtcagaccgcccacacacctgtggtctaaccggccctgtgaaggaaacccgtcactttccaaactttggcaattttcctctatttcgtccataggtgccaaatttgggtgtaaacacatgcccccctgccttttttgtaaacatacgtgaacctaaaagcatagaacatgttatgtcagggtgataatccaattaccgcccataggacttcctaagcatcttgccaaatgctcgggaaatatttcttcaagtatttcccattaattgctctctgaaaacaccgtcttgaagtgtcttcatctccttcaaagtctttaaacgcttgtcgatgacgtctttaaaattgtttcccatcaaggtcttgtaatcttcaaccgacaagtcgtcttgcttgaaataccgaagagagccaagatttaccccaactggcaaaacgacaatttcaacaatgttttattactcaactcggcttatccattagcctgagcgtagtaaagagaagaactcatcaacttaatagcataagattcggcaaaacttctcactccgtacaagtaatattctcgagcggcacggcttcggcccacttagtgaagtaatccattgcaactagcacgaaccaacgcccttttgatgacgaaggataaatttgaccaatgaaatccaaagctcaacctcagaacggccatactttaatgataggattcaacacagcggtaggcgctaattgaacattgccgatccgttaacaagcttcactccctctataacatttgaaacaatcatcaattattttcggccaatgaaaccacactctcctaagcaaccaatttatcttacgggccgattgatgaatttcacaaatcccttcatgtactactctcctagcaactttaaactgatcattatctaagtaatactccatctatttttcggcgatataatatttgagcgcttgccgccgaatcttctgatcaaccttaagtgtaggatcttcaaatatctaatcgaaggaattctccaagctatttctaactcatgggcacaaatgtccgaattcacaattaattcggccttttaatcaattgtaacgtgccccccagctctcggcccgctatcggtcagaccggccacgcaatgccggtcagaccaccctgtctgtccggtcagaccggccatgtagagccggtcagaccggccgtgcaatgccggttagaccatcctaggtctatgactttgccaatttcgtccaaacttttgaaatcaagcatcggcctttagtatataatttttcttcacataatagccaaatgcttggtgtatcaaattattggaccaaaattccttctctctagatatatgaaaaattataacattcaactaatatgtctagatgaatactaattcaattggcttttgaaacaataatcatcatggcatcacaacacttagccaattgaagtatgatcaataatgaatcaccaaagtcatatgtgccacatgcatagattccaataaactaaaaatgtaagtaatcggcttgagcatgtatgcaaaatattaataatgccaatgttcctaaatacaataactctagaacaaatcatgacactgaccattgacattagccgaattactaataggcaaaactttcatggtgcaataaatatgaaatctatatcttatatggtgatccataaaaagacatatgatttggctttaaataaatatcaaagagtcatgagccaagtcatacttcaaacaaattatatgccaacctaccaattctactacctagaactggcattcgcaacatgtatgtataatatcaatttgataagcaaaaacacacatgtgctagatagcaagcaatgttctaacatggcataggcgtataatataacattgaacacaataaacccataccttgccttagcatctaacaaacggcggctcaaagatgtgatgttgtatccatcgccgttcatcttctcttggttccctcataaacataataatgtcttgccccctaagcaaaatcggctttctcgactgcacgatttcgaaggcaagacgaacaccgcaccaacatccacagcatcatgtgaaggagacttatctctaatgaccgatgattcttctctcatgaaattggatttatcactactatgggaaatcaccggtctcttaacttttacttctttaggtctccacactcgcttaggtgtcgttcgaggatctaaattgttatatgttttgttctccacatcttcggcctccttttccttttgacctatggcctggagacgctgtagcctcctcttttgagagcgagataggccagaaggtatccacttcggctgtggttgttttccaggagctaagcaatgattcttcatatttttggtcgaagtggaagatcctatgttgttctcaattttcccactcttctccaatgctccccggtcagaccggccacaagccgtcagtcagaccggccagtaaggtcggtcagaccggccgtagactggcggttagaccggccagctgtctcggttagaccaccaatgttgatagtcacggcgtcggcttcgatctcctttgcttgcgtggtttccaccgtatctccagtaagtacatgaacatcttgagactcctctttgacagcaatgacccccggagctttggcttctttcctcacccacaccttcttcacctttttcacctttgatccaccgaaccgattcttttgtgggaaatagtcttgtcttgaattagatgaatgatttggcactgtcctaggtgattccttccatccttgacaatacggcataggtggttgatgcatccatggcatataatacaaaaaaggataaccatatagtgacattggatatggataccatggcatcacaaccggaggtttatatggagttggtatggttgatggctccgattgctttgatgtttgaccaaatctcttcctatgagatgatcttggtcttttcgaatcactagtttagttatcaaatcgttgaccagctaatcctttcttgtatttagccataagcatctcaaaagtgagcttcggctttttagtcttttgggaactagatgactcatcttttgtaaccttacgatcttcagcctttgcattattgatcctattcttgggccgaggatccccaatagcaacacttttccctttctttttgtcaacaccaataggactagtagggagagaactattaacaattccggtcttaggcataggtgtaaccgaaatagtttcacaagtgaccgatgaagtatcattcggtctttactccatcaagcttgcatctctgaaataatcatgaaactcatactccatttgtgaccatgtagaaattgaactaggagcaagcaaactataccatgtagatgcaaagtttgacaaagaaaggggaaacaacttcaacttaagcaaatcatcactaccggccttaccacattgatcaataaagcgaccgatatgctccattgtagtcatagcattctcatctgtgaatttcgtgaagttgggcacctcaaatccttgcaggtatgggaccgaatctacgtgtttaggatacagtctttgatatgtatgcatagctactttggattctatttcaccactatcccgcaagacattgtcatcatcttttccaacatccacatgaccgatttgtgactcggtcttaggtgataatgctatttcactttcgcttgtgatataacctgaaccgtcacttagttcggctatattttcaatgatgctattttctaagctagcaacacaatccgaaccattacttggttcggctattccatcgttgtctaaactagtaacacaatccgagccaacacttggtttggctataatggttgttgcattatcatccaagctagtaagacaattcggaccaacatttgattcggctatacttgtcacgacatcattgcacaaattattaacacaacccgaaccatcgcttggttcggctatacatgatattacactttcatctaaactagcttgtaagctattgtcatccactcggctttcctgagccaaagcttcatgcaacacatgatcaacatcaagaaatatttggccattcaatctctttttaatagaatcaagcaatccatcatatgcaatgttggccaaatctttgtcaattattttcaaactaaaacatcggcttttaatatctctgaacctttcaatataatcagcgatagattcattgtatttttacctaaccgatgttaaatcagacaacctaagctcagtgttaccagtgcaaaaatgatcatgaaatttttgttctaattgagcccaagtataaatagaatttgccggtaaagaagtaaaccatgtaaaagcagtaccggacaaagataaagaaaacaagcgcaatttaaaagtatcactattagcctcaccacattgcgctaaaaattgacctacatgctcccatatggtccaactatcctcagcactaaatttggtaaattcgggaactctataaccacgaggatatggcacattatcataataattaggatacgacttttggtaaatcttagcatgattcctaatttcaatcccgaatttctccctaataatctcactaattatttcctccatattatcaggcctatattgatttggtggtggatttggtggcctaataggttgtgtttgtggcgcaatatgattatattggtcttgcctagtatcgggaggatatcccctattagtatcattgtagacattagggatatgtggagtagcatgggtaacagtattaacaggtgatgaataataattaaaatcaatactgctagtcgtggtatgaaaacctggagaaattcccagggaaccggtctgaccggctatagatagcctggtctgaccggccaatcacccggtctgaccgacccatggcccggtctgatcggtggtcaatggtgcggtcagaccggctacaggaggcccgatctggccaaaatagggcacggtttgactggctatagtagatacggtctgaccggcataaggtgcggttagaccggtgtcacgaccggtcataccattagctaggttttccatatagccgattcctatttaatcggctgtataatcacccattgacccccatagcattataagcatattgtataggagcaaaactaaaagtagcatatgcatctacacaatgattattaaccttttgaatagcaaagtatgggttgggtgaatcggaggttacctttggtgaagctacaacttgaggtagcgggacgtttcctttcacgacgccttgatcggttctaatgtattgtgtagtaatattattgaacccgttccctctcgttatagttgatgaagaaattccttgattaaatccggccatatagctcatagccaaaaatcgttgacagaatatattaatatacagtcttagttttccttgtaatgctactgtacttagcaaaagattggagaaattgaaccttcacagaaataaccgatacagtaggaatcggctttgttgttgttgtttttttttttgttgtttttatgtgaacagaagtagatcggcttagatagcctgatctttttttagcacgtgcacagtaccagctttgatcaatcaaatctttctgttgccgtgtgaagcaaaaaggaaacaatgttgctaatccggccgctgctccctgtgtgaacacagtttaacgtctagccgtgaccgaacagaacaattaagcttgaagacaaaaccaatgtcggcgacaataataattacagtgtaagttaattccggctgtttagccgaaactaattcgatgattcgacgaaagagtaattattagattaaacgaaattcggccctagtatggccgattagatcgttccccagcggagtcgccaaaaattgtgttgataactttttgtgacaagtcgacaattacgatcgcagcacctaaacgccttgcggtgatatggagtcgccaaccacctcgatctagccaaatggccaaatcaagataggttttgtagaaaaacagctaaaccggttagcggagccgatttagagatcaaaaatcagcctctaagccgatttagatcgatatgaggataactaacctgtctcataggcaaaacggaaggttttcaggacaaatctacaaagaggtgtcgcactctcgcagcggcggcggacggtttacggcgcaaaccgacaaagatggattaaaactagggtaaaataaaaaacatagtaaaagaacgattcaagtgaattgtatttgggggttttacaatgaaccggccttgtcccttaaatagaggttggtcttgccctctacaggcccttctccacgtccaactcgggatagaaaccaaaggaaacacaaaacctaccttcccgggcaaagaaacccgagacccgatgaaaacaaactcggactcagaccttgacggtctgaccgcccacatacttgcggtcagaccggccctactagccggtcagaccgcccacacacctgtggtctgaccggccctgtgaaggaaacccgtcagttttcaaactttgataattttcctctatttcgtccataggtgctaaatttgggtgtaaacagcggccatctcctcctccccccacagccacagggagctgctgcgagaagcaacaatcatcatctatcaccagcaacaagttggcagatacgtagatcagggcacattaatcgtcaccagatcaggtaaacaaaaacaacagagaggaggggtgagggatcatgtcggctacaagagaagggaagaaccaaatatttttctccttttcctctttcaccaacgacgggatatgttctagccttagctcgtcgttgtcgtagacacaaccaacgtcgccgacgccgacgccgataggcggcaggttgaggtcaaactgaaacgtgagctgacacgacagtgaggcggtggcgtccgtgcagtcctcatcaaccatcgacgccgacaacccgcaatcattgtggcagtcaccatcaaggatctacgatggcgaaagccgtggaaggagcaccggtcgcggcctggtgccgaatgactcaatggtggagctaaggctggtggtggctggcctagctagcgatggcagcggagtagggtgggtaggtgaggtggtggtggtggtgctgatggtggtggagctggggctgggcgtgagggagggagagagtgaagttggtcttggccttgggacccggagcgcccgcgctgccacatcgtaggcccgcgcagcgtcgtaggcctatgtgtcttcctcggcggagtcataggtttccagccacacccgcgccttcttcaccgggtcacagatcaccgccatgtaccgcccccatggccgcttctgcaccccgcgaaaccgcgtgcacctcccgccggtggtggagagagatgaggaaagaaaaaaaaaagatgatggagaaagaagatgaatctgatgagtgggtcccatttgcagatgaggaagaagctggaggtggatggaaaatatgatgatagtggcacggttctaattttgtaaaattttaatgacacagctacgaatagataaattatagtggtatttatttaaatttgtatatttacaatggcatggatcatattaaccctttgttttttcaaagcaagaaccaaacatgagaaatatctgaaaatggttggaccaagaattgtcatagtccaccttaattagtacaggtggggactttaagtattaggcaaaaataaaagccacaaactatatacaactccatgatgtagatacatgtacaaaacactacaagcactggacactagtacctaaaaaacatgttaatgcattttttgaaatattttaactaagttaaagttgtttggaggtgtagccttaatatgtttcttggtgacatgctgatacctggcatgcgtcattacgatgtctttgcaaagtcatcaaatcatcttgaccatgacctcatgttctaccaaaccactatcagggaccttccaaaactgaactgcaagtccacaataagagctagctacgcctcccacaactttaaccatttactgaaaaaaagagatggcatagtagaaacagaagctaggctatgttggaacctgtgggttcctaacccacctctcttgcacgaaaaatgaggtagttcattagtacatgattaattaaatactagtgatttttttaaaaaaatagattaatatttttttaaaaaaatctttcatatataacattgttaaaaagcacaccgtttagcggttcaggaaaccgtggaaaacgaaaaagtagaagttgggaaatgggatgttcgaacacggcctaatccaagtttgagttgctcatggtaagggcaatagtagtgcgccatagttttttttttttgctggtcctcacataccacgtagactaagaaccatatttgctacatgctctacagtgcaggtcacttgtggtgggtctcagcactatctctccttcacttttcatcccctctccttcacttttcatcactttgcatgtttgccttttccagttttccctagcatagaggaagcaaggtggtagcgtcggattgtctctggggacaaagccaagcagagcggtggcggcatggccgaagcagcgacggtggctccacctctcctcctcctccgaccggtggcccaagcgggggacggcgcggcaggagctcgctggcgcgagggggggatggtgcagcgggagctcagcggggttaatctggcggcacggtcgaagctgtgatagcgccggtggggctccacctctcctcttcctcctccgaccggcagcccaagcaggggagggcgcggcaggagctcgccggcgcgtgagggggggacggcgcggtcctctccgtcgagctgccgttgctgtggtactcagtggcacggaacggcgacgacaacgaggttaggtcatcagatccaccacctcttcttcctcctccgccgccgccccgacaagctcgccagatctagcctcgggttcgctggatctagcgagcgacaccactttgtgggcaatgcacctgctcggggtggtagcctcatcggcaaccggcgccgcctcgaatgagatgtgggggcgcacattaggacacagcatctctcaatgcgccacgccacccgtgcctgcaacttctgacgaagaatgagtgacttgttttgaccccgtagtcttgacttgacaacgccacgcacgtagctggggaggaatctcctacgtggacggttggggcagaacgacacatcagtacactgtgaacgcccttacagctcaaccaccccccccaaataggaaactactgcttccccctcttatagttttttctaattaagaaaatttttttctcgattcccgttagtacgctttttaaactgttaaacggtgtattttgtgtgaaaactttctatatagaagttgctttaaaaatatcaaacaaactcatttttcaaatttataataattaaaaataaattaatcacactttaatggttttctcgttttgcatgtcctaacttaatattcatcttcattagattcaaacaggacttgtcctctttgcaacagctcggatttagatttttctttagggctgggtatttctgtttttatatatctatggatttagatctaccatctaccatcacattgataatatttgaataaattattttgtacccattttatgtgtaatttaaaattttatattactataatctaacctataaaattcaaatttaccgtggatccaagatctagagttgtatcaaataggaccttaaagaaataaaatgtaggaattttaggtatgggaaataaatcctatgaaagtccttttgaaacaaatgggttgatccctacccaaatccttaaaaatttctatgtaattatatactctagaggaatgttgaagaaaaataaatgtggttttacctcttgttttcttcttattgtggctagagttcatgcatttttatggagagaatcccttatacaccgctctaaattggccagttcctttatatgctactcaaaattggcttcttacttttatgccactggttcaagtttttcatccttttatgtcactcccagcacggtagcatttgttgacggtaagttagatgttagtttttttcgtaaatgaccaatatgccctctcaactaaataatatgtaaacttcaaaaattcataactaatttattttaaatcctttttgagtgaacaaaattttgtcagaactagtgaaaaatttgctttgtattaaaaatattgttggaaagctgcatgttttatgcttatattgaaaattcatttgtgatggtgatgactaaaattgtacttgataataaaaaaatcaattttcatatgttgtatctagtagctatcttggtactaaaatgctatacatatatcaaccaatttctctatcaaatgaaaaatacctatcattggttgtataccaattctcaagggcaaatgcatctttttactatgaagttaacggtcaactagcggtggagtgacaacaatggtataaaagagaggacaaacttgaaacggtggcatagaagggaggagccaatttgaagtggcatataagtgattctctcgtttttatgtgtcaatcaaattacaattatgaaaaattattttgctatgaaattccatggaaatgcaacggtcatgacattttatcctccattcttttctatctatatgtttcaataatattatgtttcaaaggaacccccctaatcattgcctttatgatgtgagaaactatagggtgttatgagaaatcttttgttctaatttgaagttttgaacgggcaccagagtttgcaacattcaaatatttatgaagtagagtttattttgtcacataactaaatttttaattaagtgtagataggccaacgacatctaaatcaacatgatgcctattgtttttttctaatccttcgataaaactatctttatttatataaatatgctataggactatataaagtaggctcttagctaaatttaactcttattgcgtaaccatcaccattgacatgtccgggatcgatgatagggttattggcatactaagagtaggatcaatgttaccatccattgtataacgctccgcttttcgtgagacgttaaaaactagtttgagaaaaatcctatatgcgaaaattccgttcactgtgtgagagtctaagtcgtgccgtggatctcaattcaaatccgtccttgttccctgtcaccgccatcaaaaatcatccacctcaagatttcaacttccgaaatcaaacatcggaattcaatcccgtccttgaactccttgccaatatttctcccgattccgagaatgtcaaatccgtccttgaaatcctccctgtccatcgattgatctatccacttatctaacctatctatccatctatccatctacttatctgtctacctatcgatctacctacccagctgtctatctatctattgatctatctaactacctttgaatccttgccaaatattcgccctgactccaaaaataaccaaattcccattttgaattcattctccaaatccaaatctctctaaatcaatctttcagaaaaagtctattttgcctccctctggtttgtggaccgttttcctcctcggcccatcccctctcggctgctccttctcctcctcccctcgctcgtgcgttgcacacagccgagccgagagagagcgccgcgctcgctctcttcacttagctcgtcctctctctctccgtttctctctcccgtcgaagctcccccaccggcgccggttcccgccgccgccttttcgaatttcgctgtgcccttgcatagcgcgcgcgctcgctcgtgcatggccgaccgcccggtcgccgccgcgtcagccctggccgcctgcgccgcgcagcagcccatgccgccctgccactcgctccacctgtgcgcgcatgcgtccaagacatggaggcagagcctcggctcccctctctcacgcgctctccctcctccctctgctcgcccaaatcggtggctcctttcccctccccttttgctttttccctctcagcccggccgcccgtgaccacctcctgccgctccttgaccgcaagcgccgcgccagccgagctcccttgaccacctaagtcggtttcctcccccaaaaccgacttcccgtgcctataaaaccgcagccgagctcctcctctcaacccctctcgcttcactctccacgctgccgcgccattgtcgcccctgccttgcagttgccctcgccgtccgtcgccgaagcaccagggagaccggtgcgtgcgaaggacgcgagaagaggactccgagcgccgtcatcttccccttccccggcccaaggccggagagctcgctcccgcaccgtcggtcacccatcacagcgcccatctcgactcggtagtgcctctctccgttctactttctcgctcgccctctccctcttttggctcgcacggtagcttggtagccctcccgaacgcgcgtagacaaagccccaattcccgccgccgcccggaatggcctcgccgctattgccgcccgttccggggagccgccgctcatcgccggcctccctcggggcccctccgtcccatccggcaccggaaatgaattccttgcaccccggagatactctcgccaccttgaatcgacctctcatcgccccgccacgatttccccttttgctcgccgccggccgccgccgtcgctatccgccgcccttgacctctcccggcgaaatccgagccgttggctcgcctcctctcgcgtctatcttcgctccggtggtctcccctccttccgccgtgcctcgcgccgctccgccgacgcgcgccgccgcccgccgtccatccggccggccttcgtcttcctcctctggccattcgacgcagccgccacgttggcaccacg

SEQ ID NO: 15687 - DNA, 10944 bp, Oryza sativa
gtcgccgccaagtggcccccgtcctaggacccccacgcggtggatccggtccaccagaccgcctccctctccccacccaagccctaatgggccaatctcctttgggccgtgcctcacgctcggcctaaaaagtctatatttcctccctccaccaaatcaattctcatacacaaaagtccatctttcccccttgttggccccacatatcaatgagtaattaaagaatattcttgggaatactcttttccataaattcaatagatcatttatttattccaaaaattccataaaccatttctcctattccagaaattccaattaagcttccgaaattcatatcttctcaaccgttcattcgattgactccgttccacttcccataattccgtaaaattgagatctatttaatggcactattatttagtctaaatagggtctttttcttggtcttttgtctaggtttttgattgtttgcgtatagttacggttaccggattttcgtcgatcgtggatttctcgaagattcgtgaagatcagtgaagaccttcagcaaggcaagtcaccctttgatcaatgctcctataattgaaaaataattattattttgtttgcaacttgcattattagaatcacacacttaacttgcttggcctcggtttgcatgctaaaccgacggacctaccaagtagtcgcactacttcctgtaggctgacataccttgatcccttgtcgctccaccattgtggtactttggtatccgtgctctctgagcgcgtataccaattatcccacatacaccgttgtttgtcaaaaatttgggaaatgggtttgagaagccttgaaaacccgacatgtggtgtcggtgtgtttgaaaataaaatgaattgtgaaaactcgtgatgcgggggttgtgcctatgtggcactgtcctgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccagggcggggtcggacaaactgggttcctggtaaggcaaggacgagaagcttgctcacttaccgatcaaggtggttggagttgatttgtgaatgcctaaaatgtcctatatttatgtgaggatttgatccttctatgtggcatgaggtaaccctgggtcggcttgggaaaggctttgtcgcgaacttctgacaccggctagtgtctggggtaagttcgtgtcttgtgggtaaagtgtacccctctgcagaggttaactaactgttcgaacagccatgcctacggtcatgggcagatgtgaggtggttcccgttgcgtagatttgattacctgtgctttgtgaaaagtttttgtggtgtgggaatcgttaccagaattagcctatgtggcagatggatgacctgagtggttggaaacgaatctgtgtgattcgggatgtctgcgggcatcatagactaggcttcctgagtagaagcggattgttgtgctgctgggcagctggactctgggagtccgagaaaatgaaaaaggctctgggagccgattaatcaagtgaaatggctttgggagccgataagtaatgatctgacccgggaggtcggtacattaccatttgaattgttgataagtatctcttaagtcaaatcgagacgcaagtctcttttcgatccaaactcaaaaagaaataaatcacttagtgacttcaaaaatgatttcaaacaaaggatttgcaaaacaaccttgcctctcttccaagcttgcattaaacacctaaattcccatgacttgctgagtacgaaagtactcacccttgctctatataaatatatatatagttcctctgtcttgaagtgaagatgaagtgaagtgaagattagggtatcgtcctggtccccagccgtcgcctgtggtgttgggtgttagaccattggttccgctgctgctgctgttgttggtgtttcctcgtccgcgtcgtcggttgcattctcaggctgttctgagttgcaacctaagttaaggtaaataagtcctctatttattttaaggattgcaatgattcatatttgtcaccgtgggtaccagcgctgtgtcctgggactggtactgagatcgcggtttcgtaggaagcggtttgcgccgttttccctatgacatgctcctgtcaggtgccgttgtacggcggtaccagattggggtgtgacacattgatggctgaaaaatttgtcatatcatctagtgggctatggtatgtagttgtagctttttgctccttgggcaggccaaaatttgcatgcacagacagcttgttgtcctctctgttggaaatttgttcataattcggtatattttaatccaaaatattaagacaataaacatgacatttataatttgagtagatctagtgacagtgctagatgtgtacaacatgagcgtacttaatataaaataagcaccaacatagataaggcaacgcccaataacattgcgactgacagtagtagaaaattaagaacgaacggtaatagtaaattattataccccgagaatggccctccgctggagtttgaggtagtattgcctccgttggtgttgatgggtgcctccttctccttgtctccagtgttattgttgtcgctgatattcgacatattggcgaagacgatgcagaggaagacgaacaaaagcagtcacgcatagcgctccctaaaaacttgatcgcccacctacccgtgcaggttctcaagcagacggagttccggaggcacctgcttgttccgatcacccgtgcgtgcgggatgaacagaaccggggaaatggagagacaacgcaggaacataaggagagtatcgcctaggaacagcagcaggaggaagactcgatctttgagagcctctgccttgcattatatatagagagagatctccattaccacacaaataaatctcatttgttgtgaagattaccacaaaataaatctcatttgttgcgaagattaccacacaatgaatctctcatttgttgtggaggttacaacaaataaatctctcatttgttgtggatgttacaacacaatgaatctctcatttgttgtggaggttacaacaaataaatctctcatttgctttggaggttacaacacaatgaatttgatttgttaatagtgactttattctcgtctgttacaaaatgaaagagcaacaagcaggctcggctcggccggccgtctcgcctcgccacgcccacagccgaggccaacttggcacgcgcgcgtgtgtggaagtccaaccatcacctcaaccggtcaatagggaatctccaatatcaccctatttaagttgaggttcttccacctaaattttcaaggcagtattattgtctctaacattacttgtgggctcttgagattttaattgaattaaattgggcctaccccatttattccaagactctcaccattcatcttgaacatctagaaccctaatcgttgtgcgcaagcaagagtctagcacaattgcaacaacttcatctagtcttggaggttgggaaacaaatcctctattgtagagctaatactgcacaggtgctgtagcgatcaaatcaagccatccgattagattaagcggctctgattctgtccttaaacaccgaaaatatttttgataatttggaaactaacaaactgattttaaggaggaaaagtcaagataaccttgatggagggaaaatcacgaatcctccagagtacttggcgccaaaataatacaggttctccttttgctttcttcctccttgggacttggtgccaaaaggagatacagaggtttcactttgccttgttctgtccagaaactttgatgatcaaataaagtaagccatcagtctccaacgaacaggtatgtatgccatgtcttgtaccctttttgtgatcatgtcctcacaaaaaaaaccaaaagcattgttgtgggattcttatgattggagtggatacactctacactcgtgtagtgctaaacagagtatacatacaaatctgaggccttatggcgaacgactcaaactccaaccatcataattcaaataggtaagatcaatttcattcaggggtcaacatagttttatcatctacatttttcttttctctgactatgttgttgatctcattactgaataggatcttaataatgaccacatagcaatccatatttaacactgtatttctttgttgtaaaaaaaaagagttgatccctgtttctttttacagcacaaatatgattcctagttggattcctcaatttggcgtgaaatttaaatctacaaaagaggcatgggaattttggacttattatggaggtcatactggttttgatgttaggataaattatgaaaataagagtaaagttgatggagtaattacttctgcaagatatgtttgttccaatgagggataccgggcaatagacaaaagagatcacaacaccaagcgtcctcgtgctgaaacaagaacaggttgcaaagctcggatcggaatcacagtagatagagaagtgggcgattattcagtatatgatttagttcttgaacataaccatgaactttaattgccttcaacatgccatttgatgccatcacaaagaaagatatcgtcattgcaagcatttgaaattgaaacaatggatgattcgggcattggaccaaaagctgcacatgagcttgctagtcggcaagttggtggttcagtaaaccttggttatacacgtcgtggtctcaagaaccatttacaaaccaagcgtcaaagggagttgatgtatggcgaagccggaagtatgttgaagtactttcaggacaaagttgcagagaacacttcatttcattatgcccttcagttggattgtgaagaacaaataacaaatattttttgggctgatgctaagatgataatcgactatgctcagtttggagatgttgttacttttgacacaacatttgggacaaacaaagaatacaggtcctttggtgtctttgttggattcaaccattttagagagagtcatttttggagccgctcttttgtatgatgaaacatagggtgatggcatggagcataacatatttgatactacctggaattttgggttcaatgcaaatttggatgggagatagctagatgcctaggtatcaaattgagattaacaaatcaggccattgaacatttacttttgagaacatccattctttttttttttttgcaatgccacagaaaatttatgctatgcattcttctgtcagtttctgtcagtgtttagtactgaactatttgcacacatgaagttacctttgtacatgtttccattagagcattgtgtttaatcttcctgaaaccttttcatcatagcactattttgtagaaggtgtaaatgaacgatgcaacatttttagtgttacactttggaataagtgtaggcttcacagtgaggcgatgctctgcttatgatatttgtagaagatgtgaaatggcaggcatatcgtttgatgaacaacacatgacatatgtataaacagagtccgaagctttcatggccttagccatgtaactgtcaagtaagtggtgggcagattgagcagaatcagagccatccaatgtaatctgatagcttgatttgatcgctacagcacctgtgcagtattaactgtacagtagacgatccgtttcctggaggttgcgtacaaccgggattagtatagtcgcccgctcaagatatctctccttaagctctttgtttcaatatggtacttgctctaagaggcgtaataattttaaggatacctaaatagttgcaatatctatacttagtgaaattagtaactttcaatatataataataatatagatataatcatttttatgcattaattcatggcacattaagttctaacacctaaaaaacaaggaggaatatatactcctatgtaataaaataatatagttatcatagtcgagtgtatccatagcatagcgaaaatccaccgtattgcggttttggtgctagtgtcaacagtgtactcaggactattatattcttgtaactttaagtgatctatagacatgtcagcatgatggtgataataagataatcgatacatgcaacacgtttaaagattacatatggctatgtcacttatcttatttggttgattttgtaaaataagctacaaagaacataaaatttatatggatgttatatcttggaaaggctctatctaagaatgggttttccgagaaagcatgtgacaatagttatagttaattatcattcataacacgagttggtaatggtaaaggatgtcgactaaagttatatacttaaattttaaacttttggttagttaccgacgagtctatttcacaactatggaatccaacaaacatgtttgattatgttcaatcattgcaaatcatgtcatctgtcacacattagctaataacaaaaacaaattgcacctaactcacagcacaaaaattcgctagccgtgcaagatcatttctacttttccttacttttatttctcgttcagggcgaccggccgaaacgtgaaatttgcatatcaatcatttgtcattgtctatatatagatccaattctgatgacattgtgtggtccactcaagcacgtttccatctcccttgatgcaattcactaaacacaaaattcttttcctacttgtgctggtaacaaacaaagtttactagtaacaaatagccaaaccaacggtgaggagagcacaccatctctcactgcatagacacctgtcatccatacatccatctagctaattaacagcttaatcacttgataaacaactcactctgtttcaacatctagtgcttcacgtgatatcaatgtgacattacacctgtctattctcagccctccaacctaataaaccccgaaatacccctacatgattgatccttgatccataatcactcgcttaatattctaataaacagctggtctagattctaaaattacaacatctcaagatctagattgtttaaaagggtttttagcaaccgaagattctaagagaagttgcagctgcgaaaagcacctctaaacacacccaaagttttccaagaaaattcttaagggcattatggtcattcgacacacacatagtaccatctctgtggaagcccagaaagtgctctataaattcagacaaaaatcgtcctctgcacctgcacacatcatcactgggacaaccaaagaaaaagaaaaaaaaagagaaaaaaagagggaacttttcacggccgctgaagcctctgacactccactgtagtgtgtcagtactccggccacctctctcggccgttgctctcccatggcgatgatggcgatgggcgcggcgtcctgggccccgatcccggcgccggcgagggcggcggccgcattctatcccggccgcgatcttgcggcggcgaggcggcggcgtggggcggcggcgaggaggccgttcgtgttcacgccgcgtgccgtgtcggactcccggagctcgcagacgtgcctcgatccggacgccagcacggtacgccgcgatctcgccgccggtgcccaaaaaaattctactcttccagcgctcgcttttttctttgcgttcacgagggagaaaagttcggatccttttgggttgggaaaatcgaagggtcgttcttgggattcgatgtgttgcggttattttactcgacacatttggatgagcgaaatgtgtttgatatgtttcttgtggggattcctgcgagtgcgaagtgtttgtttttttagagtgttttggtgtcgatttctcggtgattctatcagctgttgcgttcagtactctctgtgattcaagaaacggtggaaagatgatggtgacagtatctctagtttagttgttggatgaaatattgacatatctttaacggtggaaaggtgattgttagtgagaaccccataataattaattagtggaggatctatcgtggtccatggcttgaatttaataattggctccagatctgttgtagtacttttgagtttataatttattagattctgtggtagaactagaagtacagaacttggaactcaagagcatttcatctgttatctatatatagtctgatgatgatttgtattattatttttacatccaatttttaatcctgcagagtgttcttgggatcatccttggaggtggtgctgggacaaggctgtatccgctgacaaagaagagggcgaagccggcggtgccgttgggtgctaattacaggctcatagatatcccggtcagcaactgtctgaacagcaatgtgtcgaagatctatgtcctgacacagttcaactccgcgtcgctcaatcgtcacctctcgagggcctatggaaacaacattggtggttacaagaacgaggggtttgttgaagttcttgctgcgcagcagagcccagagaatcctaactggtttcaggtatcttggttaatctgtattaacttgccaaattttttatagtagtactgtattagtttgaattgactcggtaagtggtaatttttgtactatgcaggtactggatgtttctgcttctgtgtattattgaatggtctcgtttagctgcaaagatgcatgaatgccagttaaagtttatactttatagggtacaaagaaaagaaggggatacataattaatatgaacatacaccctgttttacggaacaaaagaaatattagggttaatgtactcctgttgattcactcttccatattttctcacatttatagttaagtgaaactgttcactagtttagatgttccaatgatttctttggaattgcaaactagagttaacattgatagatgagctcttaggttaccaactttcatgttatatggtttctgtatgacaataccttaaggacgctgcctaatttattttgtttctttctgtctcagggtactgcagatgctgtgcgacaatacttatggctatttgaggaacacaatgttatggagtttctcattttggctggagatcacctgtaccgtatggactaccaaaagttcattcaggcccacagagaaacaaatgctgatataaccgttgctgcgctgcccatggatgaagaacgtgctacagcatttggccttatgaagattgatgatgaagggaggatcattgaatttgcagaaaagccaaaaggagagaagttgaaatcaatgatggtaattgatgagtcatccgttgagaccatatgcaacctgatctgttgaagcatacatttcagtgattgtctgcatgttttgatcttgcaggttgacactaccatacttggccttgatactgagagggcaaaggaattgccttacattgctagtatgggaatctatgtttttagcaaagatgtgatgcttaagcttctccgtcaaaatttccctgctgcaaatgactttggaagcgaggttattcctggagcaacagaaattggaatgagggtacgctatgctcttgaaacttgtagcatgtagggaatttttatccttctctcagttcatgctgtaggttttgtgaagtttggtatgtaaactgcagttacatcatttattgtgaaatgttacttctttacttaatttttactttgcatgtttgcttatgctgctaatgtatttgataggtgcaagcttacttatatgatggttactgggaagatattggtactatagaggcattctacaatgccaacttggggataaccaagaaacctgtgccagattttaggtaaggtttacattttgcatggtgaaaacaagttacttttaaaagggtgcatttctgctgaattttcttcctatttttgagcaaacattattgtgtgcagcttctatgaccgttctgccgcaatttatacgcaacctcgatacttgcctccatcaaaagttcttgatgctgatgtgacagacagtgttattggtgaaggttgtgttattagagtaagtatccttttcagatgaattatcatagcgcttccttctatgatctgtggatagtattagatcataacatattaggaccttgagttattacttgttagtcgaacatttctttttcattgcttcaaaacagagaccctaaatttgttgacatgcctttccccctttattttggctagcattgcacaatcaaccattctgtggttggactccggtcctgtatatctgaaggcgcagtgatagaggactctctgctaatgggtgcagactattatgaggtaaaataaaacaaaactatactatattatggtgtattggtgttgtgggaacttaattgtgctttttgttcagacggagacggacaagaaagccctttctgagactggtggcattcccattggtattggaaagaatgcacacatcagaaaagcaataattgacaagaatgctcgtattggagaaaatgttaaggtatttcatatatatttatacttttggttgtcaatctgatgaagtgtgccttctgtattaactgatcaactattcattacttgaaagaaaagagagggacaagcatatttgtttgaatacaaacttggtactttctcatgctttttgttaaaggtggccttttgcaaatgtgcatcttgcatcactggtttgaaagccctttatcattaaaaaatactactatgtcatcatactttttccccctaaattatctttcttttcaaatgctatatgtcttttcttgccatgggtttttgccttgttgagtatggatctttaattatttacttactaagcacaaactgaaaaaatccaggcaacccatatggatcgatttacata

SEQ ID NO: 15688 - DNA, 10848 bp, Oryza sativa
atatttataatactaaattagtttcatcaaatcaataattgaatgtattttcataataaatttgtcttgggttaaaaatgttactacttttttctataaacttggtcaaacttaaaaccgtttgacttttaccaaagtcaaaacgtcttatagcctaaaacagagggagtagttgttaccgatataagaatacctaaatacggttatctacgagtattttctttttagatttttttatgaaatggaaaagcaaagcacaacagttcttttttcctttttgaagaaaaaaacacaacagttcatacacatacactgtgccatataggtgtatacctgttatacaggtgaaaatgttttcacaagcaaacactgaatttttttttgtggttgtcacctagtatcatgcaaaagtgatttgaggcacgtctggtttgccttacaaaaaatgtatttatgccagttttgttaaagtagtggtattattatatggttaatatggtttgatgtctacctagctaattgatctagagtatgttaagtgttgatctttctggagtagtcagtaaattaaatttggtactactaagccagcagtactctgggaaattaaccacacacacaaaagaaacccattaattcaaaaaaaaatctgggaaattttagtatccccttcattgatcagctgactatcgatgatatctaccaactttactgtatttcagttattgcaaacttttctgttacaactagatgagcagtattctagaatcaaagaaagaaaaggagcagcatgttcagattccagtactaggtagctcagcatgcgcctgcatatacaaacattcgttgagagatttaatttctcacgcacacacataagatgcatcagtactaattaatgatttgcttgaatattacatcaatcactaatggatcaacaaagtagtgtactatagtgactagtagtactcgatcaactttagtttgtaatggtgctggatggagtacaggaaagaaagttaatcgatgctctacccttcgagagtgtttatacggggctaaaacttgttaagtacatgttacatcggatatttggacgtaatttagagtaataagcatagattaataaaaaactaattttataaataaaagctaatctgcgagacgaatttttcaaacctaattaatccataattatcaaaagtttattgtagtatcatattattaaatcatggcgtatttaggctcaaaaaattcgtcgcgcgaattagtctaatgttatggaatgtgttttataattagtctatatttaatacttcaaattagtgtccaaacatccgatgtgacaggtatttggaataagtccctgtttcccaaacagccctttagataacttcatgagtttatttttgaggcaactcaggatcgggcgcccgatgaggagagagaaaaatcgggtgctgatgtcagcataacgcatacgtgcaaaaccacattaaactattttttttcttaaattatttatccaaatcatgatatgattgcaccattaaattcgttgcaattaaatctttaaaacaagatcacacatggatatattccgacgaaattttttttagcttattattgaattatttttatatgctgcgcgctgttccaccaagtatatcggaattgttagatcgaaaatctttcggtcatttaaattgggcgttgtttcaccttatataaaaacaatgtttcaacaaatagcgaaagaatgtttcagttcactgcaacatttgatctatacatagtgaaacattataagtatactaggtgaaacattttttgtggaacaaaacatgaaacaaattccattaatagagggttttcaaaatatgtgggtaatttgttgcaaaagaatatttcaattcactgcaacattagatctatacatagtgaaacattgtgagtacactaggtgaaatattttttttggaacaaaaaatgaaacaaatttccttaaaagaggatttccaaaatatgtggatgatttgttgcaatggagtatgtgctagggtgcgtggtgggggcaacgcgtaagctggaggagacgcgaccgagatgcccgatttttcctgctggcgtcgagcgcccgacgccaaggattcccggtttatatttccttttttggggcattttaaatttctaggcaaacaaaaatatgttccagacttgaagggaagtagctagaataagagttatatcggatttttctagaacaaaacaatttatggttgtgttcggaagagtatttctgctataggacccaacaaactttctatcaggactgctgctgcactgcagatgtgcagccataataaccgaatattgtaatccctccatttcatattataagttgtttgactttttttttctaatcaaactttattaagtttgaccaaatttatcgaaaaaaataacatttaaatatgaaattagtttcattaaatctaacattgagtatagtttgataatatgtttgttttgtgttgagaataatactatatttttctacaaatttagttatactaaaataagtttgattagaaaaaagtcaaacaacttgaaatagaaaacggagagagtataagataatgccacctagttgctaaacaatgtcataacccaataacccatgaatatgaacggtgccctagggtcgttggtgctgtaaatatttaacgttgcatctcttcctcatgtcaaaaatatttgatgttggaagaactgggtttagtttgcgacaagcataaatcttatgccatgttttttttaaggaatagaatgatagatgaattctctagctcctaaatgatacggctttttcaagtttttagagaatttttttaaatttatttttcctaatatttaatttattcattaataccttcaaataattatcagaaatcattcggccatcgaaccattcagcacgaaacctcaacaataacacttttgcgagcgagttctacggagtagcaagcatatatcatgcatgacattttttgcgaattcacatgaaaatcgaactacttcatgtgggatttttgagtattttgtaaaattcatcatattcatggcaaatccatgtggggcccaccatggaggtgaagagtatttttttcccttctaaaaaaaagaaggcaaaacaaagctgccaaaggggggacatagtagttggcacttggtaggcaaccaggagacgttacagtgtttgggatcgccacccccacagggccacaggagtacaggaggcatcatcatgcgttcacgccgcatgagatgctgccgttccatcgccggtttccgcatgcacacgcatgggtggtgacatggcgtgatgttccccgcgcgtggagctctacattgacagcccacctgcatatggagggcaacaagcggccacgccctcctctcggcggggcctctctcagcaacagcagtctgccacagatttttaccgatccttgcacaccacgtagactaaggtcccgttcttctcttcaataagagttagataaaaattaagattttcatggtacgcttttcagactgttaaacggtgcgttttgtgtgaaaattttctatatgaaagttgctctaaaatatcatattaatctattttcaagattgtaataattaaaactcaatcaatcatacgctaataccacctcgttttgcgttaaaaacttaatcttaatcttcatcttcatcttcaggagaaaagaacaccacctaagaactgtatttgctacatgctccacaatgcatatcacttgtggtgggtcccaccactatcactccttcacttttcctcccctttctcaacgtcttttccttggtggagaggaagcaaggcggcaacgccaagcatctccctagcgacggagctgagcagaatggcagcgacgcggcccaagcgacaacagcgccagctaggctccacctctcctcctcctccgaccggtggaccgagcagcgacaacaccatcggggatccacctctcctcctctgaccagcggcggggcctggcgcggtagcgggggacggcgaggtcggtggctcggtagcaggggacagcgggagctcggtggcaggaggcggcgccgtcccccctatcccccacaaccagtgccactctccttttccccattatcgacgccgctcaccccgctgcacgcacctctctcctctctctctctctccccaacggatctgacggggcgacgggcagcaggtcggcgatggtgagaaagagctcaacggcgacaacaaggctcactctccggcatggatctaaccatctccgtcatggatccaaccaccctgagctccctctccagcacagcaacagctctctctggcgtcgacgttgtcccatcgagctcagggtggtggcctcgccaacaacgacccccaccatctcgcacggggtgtggggtgggggcgtcgcaccatgccacgaagtgcaaggcgacgacttccacagcgtggccgcatcgttctcccccgcgatgcatgatagcttttcatcaaaagaatgcacgcccagctttggctacatggacctcgtttggctacgtgaatctcctacgtgttatgggttgggctgaatgccacatgtgtgtgctgttaatggcctaattggattgggatcttcgacttattacatgtcactaaaatgtgagatataaagttgaaaaaggcaaatcatagacaaatatataatttaaattgatgggcgaaattcagcttacaatgcagtttttaagatcgaaaatatggacagttgcttatagaaattaattaaaattaaaattatatattacaaagccacttcctctgttccataatataaggtattttgggtggatgtgacgcattatagtgaaatgaatctggtcccttatattatgggatggatagagtaacaaatagcttgggaaaagttacctaaccaatgtagattaagaaataatcttacgaagaaatcgtagtagtttcgaaagggtggcatggatattccaattgatgctccatgcaaatatttatataaaagtagaaaaaattgataaatagattaatatatggtatatcactctgccaacgtacacgtctaaatttgacttctgcaaaacaaatatgatagtgagcacacgtatactaattagagcttaatttattatttttgttacaacttgtgaatattgaatttgaatgcatatttgtaaagtaatatatcacacattaatctatcttatattttttttaatttttttcataactatttggaagacaatgcaatatttggaagacaatgcaagaacagtgaacatccctcgacacattaatctatcttatttttttaattttttttcataattatttggaagacaatggaacatccctcgaggattagaatccatttccgtcgttgagttatgcaagtgtataactggctcaaatcatgatatgcaaaattaaatggctgtatgtatttatagttggtgtaaagatagaaagctactccttatatttccttgcattatcatcgtatgaaattcctaggtttcaaacggcctaacattatcagcacaatttgtacaagaaagcttctcgttgatgtgtcgtctactcgttctccttgtttttttttaagggttttgtacagtatatgaaggacgaaaaatgtcctccataattttatatttctgcaagaatcttatatccataacttctggcttgctgctaggtttcctctcatacccaagaaataaataaataaaaatcctctcataaaaaaaaggaccaggcaacaatcgcctgaatcacccgtacgaatttgccttgctttcagcaaacaaagcagaattaaataaatctcaaagcactgaagccacacatagggccatcattgggttgagaccaagagtacttaaaacaatagtacataaaaaaaaggaaagtgagaaagattggctgctgcaatgctgttccatggaactctgaactctgatactacagatgaacacttttaacaagctaaagtttgcagtaacagcaaatatataggctatgcactttagcagacagaccatacatggcagagagataaagctggtgtgcactgaaagtagtgaaagaatttacagcacacaaaggttaataaagctcccacccctgcatcatgggaaaccccttaataaaatctgaaggataggcatcccagggagtactccaaattccatagcagtaagcttgtttcagtacagtagacagtagaatggcatatgcatttccctcttcttgcacttcaatcttacctgcggaggacatcttttgggatgctctgttcacagtctagttcataataactgcccacaaaattgttgtattcaatgagatatactacctagtcccaaaataagtttgcttttgtacatgaatctagacagtgtacaaagtaaacttattttgagacgaaggtagtatacactactagtattcctcatgaatggaggcgtacaccacactgtcaaaaaacatacaggcgaacagcggaagcatgcaaaaggaatttcagagagacgacacatcgatgagacgaatgcatgatgtatgaatgcaaaaagggaagtggtattcatgggtctatgcattgattaacacaaaaacagagagaaaagatgaacggtgcaatcttatacagacaagacaacggaggtggttgccacctaggagtaagctttcaaaattaaactgcaatgctaattcatagcagaacctatgttaacaaaacatccggtataggtatgggtgcccaccagcagtttcagactctcaggctcttcagtaataaggagaaaatatcaccatatgatccttgcaggctgcaaatttccttaacctgtcatgacaggtaatataactgttgtaagtggtgattgcagcaaataaaggtggttcttgtttctactactgacatggaatgctgaaattgaagagcgggttcagactatggcatttgaaaatatcatcagcataagcacaaatgatgtattgaaaattttttagtttaaatcaagcatactaaatatatctcactaaagttgtcctgcttttgccacaattactacataaacatgagaaagtaaataaaatagttccaactcataattgcccaagtcccactagtttacgaatatatatatactcagacgaattaaatgtatcacatacagagagggattgcatcctgcttcttcaacaaatatcttttccccttaaaatttatatgttaataacagggttttcacttttgatttcgcttaaaatctcagccatttcggtagcactgaaattccagaaaattcaggattttcggcactttttggactgatttttttttttgaaaaaattaacataatttgactgaatttgaataaacttttaccaaattaaaaaaaaagagagaaaaactggaaaatttcggctgagagaatgactggccagggggttcgaaaataatgaaattgtttctgaaattttgaaccgaaatttcattcactggttaattgacagccagggttccaaacataattctatctagcaggtgacagaaatacaacacttgtgtaaagacaggcattaagagtaaaaatgataatgcaatgtccttgatgtttgattatcatgtaaaagtttggaaaacaatgaccaaacgaacaatacaaggcaagagtttctcctaaacaatatacaaaccatttagcaattacattgatggcataaacgatttggttcaaataggacaatgattcatattcttgtgtaaatggtacagaaattaaaagagatctttaggcaaacattacctcgcatctacttctggccaccaggtttagattgttgctgtatctgctgaagtagggttgctgccaattgcaatgttgcttgaaggcgcttttgagggtctccgtgatggtcttcctgagcagacggttgctggctagtctgtggtccagagggaagtgcaggttgcgcttgtagagcacttgatgtgtgctgcctaaggggtagagggccttcaggaagaggagggacgaacgatctcaaaggcatggaagaatgagctggatttcccgaaggatgcatagggggtaaaggcaaagtgttgtgagaaggcataggagcattcggtgtatgcataatggatggatttggtggcactgaaccttgaactggtggcgcatgaacctgtaactgtgatgcagatggcggagcaggtggcaatgagttttggacagggatagaacctgagctgtgtggcatcattgaagaatgtccatgtggattccgtatgaatcctgattctttgtttaagctgtccacaggctcttttcctggttggttttgttgtgcaagaagagtggccaattgtgcaagttgctctggtggaagcgataatgggagagatggaggttgttgaggtctaactacctgctgtgatgcaggttgcatgggagggtaggacatgtttgatgcctcatctgcaactggtgcataccctgatgtactcacttttggtactccttgaggagcaaatgagtatgcctctggtgtcctatcagttgatgtatgtgggatcgcactctcagccaaataattcaaatttccagaacctggacttggattgtaaatgttatctgaccatcttgagggcaatacatctgggtgttgctgctgcttgtcatgtgctatctccctgtgggagtcaggtggatgcttttgatgagctaattcagattctagatatgaaggagcatttccaaacttgtaaggcggaaccaaatgtgcacttgctggattatagcttccaggcgacaacccgagataatctgaaccctgaggaagtggcctgatatctggtgggttgattcttctcaatgcatctagatcctcatgagcacgaacatcatggttcaaatgactcacaaatgtttctggtttgcgagttggcgaggaaacttctggatctgactgctcaaacttcagaatgactccagatatgctgactttacctggaaccctcagtacttgttcagagaagtctgagggtggaacaagaaataagctgctcctttctccaagtttacaaactgctgcacgctgcttatcaccaaggtaattcatgaattcattataggctgccatgtcagcatcattttgtggaacaaaaaacaccacccagctgatgacagcttggtaatagtgcttagagagcatctccaggcttgtcctagcagtgcaatccaaaaattcgggcctgaaagtatgaaatcaacagcggtttaaaactaaatgttgaacttagagatgctcaaatctagaacaatagaacagagcataaacaccaaaggcatctcatcagatacaaccaaaagaatgcagatagaaattgatcaactagattatgtagtttggaccgtgaaggcaaacgtctgtatttattaagattatgagtagaggcaaatggtgcagagatataattaaatcaagaacaacgtgaacaaaacatagctctacaaaagccttcatcaggtgcaaacaaaagcatgcagtataaattagatgtaaaaggcaaaacgatatctatgatatatttgctatgtattatatatcttgaaccatgaaggaaattttgtgatttttattaagacgataagcagagctaatgttgtagatgtcaataatgatactcagaatgaacaagaaaatacagtgaagaacccagacttacagcatgaagttaagaaccttcccaacagggaagcatcgcgctcggcaaattggtgtgcctccctttgctattgtaccatcccatttccattcttccttgagaaggggttcatggtattcaggagttgatctttccacttctacatgcctagaaaagctgtcctgtgcatgccctggtatatgcctatctacaagtggagttggattccttaaaggatcaacatgatttctaccatgcataggagcaagttgatagcctctggggtgtatgtcatcatctggcacaccatagaagggcctccttgggtaggcagagccaaccttccctcgatcaaattcagagaaagggtattcaggaagttcagagtcatgtgcttcaccagtcctcaacttctttgaaaatgggtatggatcttccctagcataccgagaatcctctaatggtaaggctccctgagatcgctcgaatggaatgttgtgccatggtgcatcaccagcagggctacgcctatgctgttcatatgggtcctcagacatccttctttctggaccgagcccttgtatcctaaaaggttcaaaattagatctaggatcaggctctactccaggtccatatcgcaaataattatccctgctgaaacccacatcatcatgatctctagaaagtctcttagggccataatgtggagatggcatgtacatatctcttggaggactatcaaaaggcctagccctaggaaaatcttcaaaatcttgctccctgaatataggtctaacactagagtttaaatggggggaatatggggcatctaaggaaccttttccaaattctgctgaaacactgtcactccgagaaaagcaaatgctaactcgagggttattgaaaatatttccctgcagtgtttccttcgccctgcatgccgctgcaatagtagtgtactggacaaatgcataagtacgccctgggaatgtagttatcttgacaacctcaccaaaaggtgaaa

SEQ ID NO: 15689 - DNA, 2168 bp, Oryza sativa
  unsure (1)..(2168): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggaaattcataacactgttaacatagctgccatctccaatccatacgatttccagcaatccctggtcttttaagaagttgctaccaattgattcctcccaagatgcatccaaacttaacaccagtaaacccaagctaccatctccaaatcatataacttcaagcaatctccaatcttttcaagaagttagctacatagtgattccttgcaatacatcaatattgatcaaattgcaatcgatgatcaaccaacttcataagacaccagttcatgagcagagccgtatttaacatgtccacagatcaatggtaggatagttgcatgacttcagaatgaacttccacaatgtgaacaaattggaattgttgcagcaagacttggaagttggaatattaatcgaaattaacagtgaggtcagtagattgctttgtgtaacttaccatctttagattgctccgatgcctcttttccagattgtttccccagtctatatttctggtcgaggaagatcaaacttaaatagctgtatttcaaactttgcaagacatgcaaaagtattatgaattacctgaagatgactcttcaagtggaaaagagtgagccccttcacacccattgtcctcaagatagttttaggtgttgcttctgcaagataatcatgcattgagtactcaatttaaaaatatataatgaaatcaaatcttaaactgttttactggattcccctggatttttcacattttagaccttttgggaaacttattttacaaatagaccccaaaaaaaacttactccaggaatagaccctttttgcggtgccaacatcattgacgctgtagtccaacatgatggcgccaatgacattggcaccgtccccctagcatccccacagaagctaactcactaatgtaaagggggacggcggtaatatctttggcatcattatgttggaccacggcgccaatgacattggtgtcgcgaaaagggtctattcctggaataagttttttaggggtctatttgtaaaataagtttttagaaaggtctaaaatgtaaaaaaaatccatcttgattcccttagcaattgactaatgataaaccagcaatttagagtgccaacatttactttttttagataatggaataattatcccaggcactgcaccagcaatttagagtgccaacatttactttttttagataatggaataattgtcccagggactgcactagaaggtgcacaaagccacaggcacaaccttttttagactacctacatgattcaattaagatttagaattttgatctagtgtgagtttcgctgtgctactgattatacctcctacaagaaaataaggaacagtacaatacacgcttttctttgtatagacagttgtccaggtgcatagctaaaactaaggccttttatggacggaggtagtaatcacagaagcacttgtaatgttggtctgagatttaaatggttcatcaaaataattagaacctaaaggtaaaagtgaatccttgaatttttataaagaaaatagagtaaattacagaaaactacaggccaaaatttgtgataaatttggtgttaaatctatagtttggtgatattgtggcttaaatatgtaaatttgcatagttctgtgaaatttgaaacaagtcccaagaaaattgacagtagtaaattgaa

SEQ ID NO: 15690 - DNA, 5405 bp, Oryza sativa
agcatcaagctaaactaaatcagtatagaactattatagctctataccataagttaagcattttggcatgtaagcaccagattctaagaaatacaccaaaaatgcctagactgcgcccaagaaaaatcaaacagtatcatctttgaacaactatgttgtttttaagataaatgaatgcctttattccggcctctgcataagtcatgcatcaaccattagtgattagtcattacaaagttttaggcatagactagcacagacaatgcatagcacccatctcacaaaattcaaacatgaacgaaaaacttatgcacaaaccctatcagtcaactatgtaatatagtcaggttaaaaatatgatgtgtgcagggattactgttcactagtgcaaacagctccatggttacgtgttgaaccaagattcatacatcagatgctagagtaatcaatcctttataacttctgcttctgaataccctttgccaccaaaaacatgattatatgataaaacattcaatgcatactctaggttgattatatacggtggcaagcgcctaacgcctaatcaccaatcaggtggctctaggtggaacgattggctatacaggtgaggcgggagttgcacacctatgcaagctaggcagatgtctttctgaagtactaagcatagcaggtgaaccgtgttggtggcaacaatcaagccgctaccttagggcttattcggttcataggaattccaaatcaaaggaataggtaaagttaagaggtctcacctcatgctaagaatcctacagaattagcttgaaagactacaatccttaggaatttggtaggatccattcctatgaaacgaatgatgcatataggaaaaattcctaaggattcaattcctacaataatcctatgaaaatcctttaaaccgaatgagccattttctccaaatactgatctgctctatgcctgtgccaatgtgagatactgcacctcatcatgtgggaaattgcgaaatcgctgtatttatcccactgcgttcacttacaaaccactgaaataaacccaaaatgagcagaaacttctccctcatccttgtcccaattctaacacccgaaaccaccaccaatttcgtattaacaaaacactcttgattgctaccggtgcagaattcgttaaagtacaggacaagcaagcagctcaaatcagtagccgacctcgatttttcacctccaatcagtaaactccccaaacttgtaatttgtaaacaactaatgggtacaagtttcccctccaaatcacaccaaaaccagcctagagcgggctaaatccgcttccctaagcgctggccaagcgggcatttctctccttgccaaaatcgaagacttattataaccaaacgaaaagatccaaagcatttcctgaatctccgaacaaacaaaacaatgccccccaaatcccgcgccgaaatctccgctcccaatccgagctttggcgcgaaccaccaccaccaccaccaagaacgaaggagcaacccacccacccaccaaccaaccgcgcaagcgcaacgccaatgcgccgcctctccaatgggggagctaagctaccggagatcggagagaatgggggggagagaagcaagggggaaatctcactctcggggccgccgagctgggcgacggcgtcgacgaagcgctcgtggaggtcggccgtccaccggaggcggggcttgggatcggcggtcagcaccaggctgggccctccccccgccgcacgccccgcctcgccgccgtccggccggtggtggatcagcccaggcgggaacatctcctcctctttcttcttcctcctcgccggcaacaaggaagagaagaagagaggaaagacgagacctttgctgctcctcccaaaagcggaggatccaatgaaaagtcccaacgctttctctctctttcttgcttcttgcttctcctctgctgctgcctgctgcctctcccctgctgctgctgctttccagtggcagaggcagcgattctcctctctcctcttgcttctcttcttgacctcttctcttctctctcctctattgcttctttctctctcttcaacttctgtgtttatagattggagggttgtagtataatctggagatggatgggaacagcagtggccataatgatgcgtgttactactagtgcagactgcagagcaacgtcattttcttactgttgttagattattacgccctaacttactactgtcatcagagctaggagtaggtgataattatttgtgattagcacactacagccaccctccctccctccccatcgacgtatagtagcgagtacaatagcaggctacaagtcgagtcgactgtaagcacatgtgaaagagacgtgaaagagagaagataagagagagaaggaaagcaggatttatagccagctgcagcacagaatccaatgcattgtgtgtgtatgagatgtaggatcatacattaatggtgtattatataactattgataaactattagattggatatatacgaattagagctattagttggctatactattaaacttgctctaattgagttcaactcttaggctctgttcgtttactggagttcccaactcccccatctcattttccgcgcgcacgcttttcaaactgctaaacggtgtgttttttgcaaaaagtttatatacgaaagttgcttaaaaaaattatattgatccatttttgaaaaaaaaattagcaaataattaattaatcacgtgctaatagactgcttcgttttccgtaccggagggatgggttcccaactcaaccaaaagaacagagccttattaattaactcgtttagtatggaattaaagtacaacgtctcaattatgctctcctagctcggcttaaatcatgaaaacattagaatctggtcgtttgcttgctgttttagagcacgctctaaaaattaacgcgtcattttcaaccagtttaatagtctatccatgttataaatatatgatatattgtaacctgattttcatcttaaatctataacctgattttttttctctctcctcttctccattcttaacctaagcataaatttgatttggtaatttttagagtctgctttcatcatttattatactcgcttttaaaacttaatttttaaagttaattttgagattttttttatcaacttatttttagtcttcttggcttttaaatcgatagcagcacacatagatgttttatccatgataatttataggtgtttagtttatttttccactgacttgttagcactatatcaaactatcatagcattaagagcaagtttagtagtatagcccactacttactataagccaatgttaaagctaacatgtataatagcttatgctttcatcataagatactccctccatctacttttgatagtcatatttccaaatctaaaaattttatttttgataagcatatttcacttcaacaacttatcattttaatgactttctcagatttaatgcatgactctccattcttccacacatgattggctacatgggcattgagaaacgtaaatataaatgaatcgcttgtttacgaggaatgactagtagcatgtttatatggatgataagtagaattacttatccttggtctgtgtgccaagatgaaatatgactatcaaaagtagatggagggagtaggatttatttttttcatcatctctctttatctctttatgaatttaatgcttatttcttggagcttgtgtggagctagctcttgcatgagagccaacactccctattttttttatctctctttttcacataagcatttagcttgcttatagctcacttagctcactgtaatccttgctctaacacaaacacaagtcaattaattgtagaaaatatataataattgggtttcttgcactttggtgctgaggtaggtattgggagctgggcaaatgattggtgcatggaaaattcagcctggcctctcttatctgtctaccatctcccaatctctatctctgtgtgtgtgtgtgtgtgtgtgtggcgtttggtgatgctagcaaattgacaaatgggattagtttaattggggtttttttgtgccctttttgcttagaaaaaaagctagtgggtggaggatcatgtgagagctgaacagacagctgagtggcccttctccatttgtttaattttctttcgcgtgttatttaatttgtaaaaacccttgcttacatcggctttgcacatgctcaatgtccatatccagacgtcatgtgtgtttcaacgcgtacaaatgcaggaaatgtggtgcttcaaatggtctctttcaccttgctaagagtgtatatacaatagacctaaattagtaataaagctatcagcctgattacatcggaatttgtttgtcgtgtcgactaaaagctgtgttgcgctggggttttcaacttatctctctcattttcgcacgcacgcttttcaaactgctaaacggtaaataatgtgtgacaaacaacgtgtaagcttccgattgtgttctcttaatttgtgttgggtacttgggtgttggggtcaaaccatgagaaaagaatcaagtatatgattgttgggaggatgtatgtagtccgggtgagactggtatgaaaatggaaaatgtacaaaatgcaaattatgtatattttgttagggaccactattttgtgaagattgcttgtacggtgatgcctctagctatatatgatagaggtggtatgtagacaattgaggatgggagctaagctccaaattaagttcgatgggctgactctacggctatattcttctcgatgagttgggaactcatctcccaggcacacagaacagaacgactcattagcacatgattaattaaatattaactattttttttaaaaaaatagattaatatgatttttaaagcaacttttttataggaaacttaaaaaaaactgtttagctgtttgaaaaacgtgcacgcggaaaaaagagataggtgagttggaaaagaagggaagaacacaaactacgtatatatagagctaaagttgagttagaaatatttagaagagaatatatgccaaagatgctgatgtcatatttttttacaggagattgactcgaccagggaaatatatacaaaagacaaaataataagcttattaaaatttgatgtgttttgcatatattatccttccctatcaatacaaacgatgcaaagcttttgcccttttaaaaaagatataattaatgattgatgcatagatttttctatgaacttaacaaaccaaaaaaaccattttgtatgtcaacagtgtgacatgcagtctcctagcattgtcacgttatcaaaatcatag

SEQ ID NO: 15691 - DNA, 3223 bp, Oryza sativa
aaaccaattgctgatttttattttcaaacttaaacttttggtcacgccacgtggtaagacaaattgctgttattgttttggggttgtgtggccaaaaagatgatttagaaataagtaatgatctattttgtaaattaaatcattaaaaagtttaaaaataataaaaattcgtaccctacaagatcctaatttttacctaggtgtttataccatcggccacctataaaaaccgtcggccttgtatatttctaagcgtatatcatcggccactactccctctctgtttcaaagtagttacttatgatcatctatgcgtatagcgtagaagatatgtttttcaaatgtaaaaattgctttgttttaggatccctttgaatcgtagggttgaaaaaatagagaaaaagggagaaacacatgattctgataggaattgaagtgtaaaacagaggattgtaaaacacataaaaaaactcaggaatgatcatttgattagaccgcaagaaaaaacgcaggaattagatgcgggagatagactcaaaggaaattttccaagaggttggagctcttgctaagtttcctctaaaatccacatgcaatgtgtcattacataggatttgaaaaacttcaatcctttgaatctgtgtcattacataggatttgaaaaacttcaatcctttgaatcaaagggctaatagaaaaatttcctataggatttaaatcatatgaaattcctacgtaagtcctttatttactttagagcagagataatatttctctcttgatacagaggataaaatattcttacgaacgaccggtatttagcaaatatcctatatttagcaaaataggatggacgctaattctaatagcgtccaaaaaaaggacgttgctttccatagcgaccaggtctggacgtcgttcacctcagcgtccagctatgttgtgcagcctaactatcccaaagccatatccattctatatacgagaaatagaagcgaggaatccctgcagggagaactggtgcggcatcgaggattcgaggctagggcctagggcagttactggcttactgccgccgatccaacaggaggagactgggaagtgggaagccgctgctgtccccgccttgtcgggagcctgatatggcgatatccgccaaggacacaagaaccatatctatcagttcttttagaaacgacaagtaattttaggattagtagtggaaatctaagttataatttttgcctggggttgtagttaatggtgctgttgtagctcaaagatgtgttttagtttagaagcatatgtatgtgtattcatgagagtttcagactttctatgactcttttctgtttgattggttctatgtgtactagtactgaattacttacacgcccatagtcatatgatctattgtttggtactgttgtgatattcttctgtagtgtgaagtttggaagcatgcacgtattctgaaatccgaaatactcaattatatgaatggacttatttttcttctgcttcatgtgaatacccacaaaaatagttacatctgtatttcatctgagttgcgaggcagtgcgtgagcttcttcaataacgattaacgcacaagaactcattgtgcctgttcccagcctgggcctgccatcggcggcacaggtgaacggcggaaacgaaagcttcatggacggaagcttcatgccttcattacagcgagatgccgagggcggcaggcgacaaacggaaaatttcaagggctgccgcttagtccaatcctgcctgggaggcgagcgtcgcctaccaaatactccagttgtttgtgttaacgacgagatatatgggtatacgtagttttttctttctgtattttatgggatataggttggtaggcggcgccagacagtggacgctgagatgaacaacgtccagaggtggacgtcgaggtgaacagcgtccactcctggacgctattagagttagtgtccatcctattttactaaataagagctcttagggagtgtttgaggagaaggggattgaggagattgggaagatatgcaaaacgaggtgagccattagctcatgattaattgagtattaactattttaaattccaaaaatggattaatatgattttttaaagcaactttcctattaaaattttttgcaaaaaacgcaccgtttagtagtttgaaaagcgtgcgcgcggaaaacgagacacaatctctcctatctccacctaacgaacagagccttatttaccacatatttaatttgtaaattattaattactataaataaaaaaattggggtctacaggctacagctccaatgagcatcgaagtggtttaattaatgatcgatgcaataaaaaaaatgattatccgataatatatatcactgtatcgggacgaattatcactccaggattcatgggcttaattcatcgtaggattcttgtttgattaattaattagataaagtttggagtttcttcaagacaaaacaaaatgagatcgagtaatgataccgtaccaacaactagtggaacttagaacggactaaaagtttgcatttaaaaattttgggtgatgctgatgagtggctcagtcgtaggaggatagaaaatagagcctgtgttactaaacactgccatactacaggtaagtgctattggctgtctacactctttggggtgggtaatgtttgtaatttataatccctcattttttatatatatgtttttcgaactattaaggtttgtacatgaaagttatttaaaaatatatatttgtcatttatgtaagtttttatagctgatacttctaattaattatgcgctaataagccatactgttttaatcgcgcacgagagaaagttccattgcacattgaagaaattaaagacaaacttgttcgaaattgggctattattcttcatttctggatttagtgcagtcgcttggggagctggggttgtgagaggaacgagaagacgaggaatggaggcaagactgcaagatacgcgaggattacgtgcatactcttgtgttgactgctgccctagtctctaatgggtctcaaacaaaacatacacatatacatggtttggggggcctccgtcgcccctctcgccatggcctaggaacggccctggtctagacttaaccctagctcaaaaaagcaaatgatcaacactcagactataacaagccgattat

SEQ ID NO: 15692 - DNA, 8348 bp, Oryza sativa
tctgcgcaaggagaagccacaatcggcttatagaattacaaaccaatttaaagaaagccgaaaagaaaagcggctactcggtggacatagtggaatgcatgcgcatgtgtactgctatggaaatattcatccgttggttgatattgaaggagaggttggtaccaaattaaacgagatagcgatcaaaggaaaaaattgcatgcggaaatctcggcaggaaggaaatggtcacgcaacaatttcaagatttcagaaacaaaaccaccgtatagaaggctgatcttctatttttcatgtgcacatcatgtctggctgtcagtagagatatcaatctaatctcaatgataggcacatagatgagctcctctagaaacactgtagaacaacacccagcacataatcctcaccaagcaattgacgatctgataccaaccgatgacaccctctctcgggcccgatcttctggtgagaggataactctcgcttttatcgaatgtgatatttgcgacgtggctaccaaccagaacaggttcaggatgtcgtgcaatcactacaccacaaacgatgtcataccaaccgtgacgcgtggttgataatccctgcaatgcaaacgagagaacattgcaagaacaagataatatacgatctaaatattgcgaataggtaattaagcacaacgaagtagttgcaattgaagtggtagatataatctacccggcaaatcaacacaccaactattggggtctctgaatctatagtcgccaactaatcgaacaaggattagagacaaggtaaatagcacttggaaaaattcaactaaataaaacccaattgttttttaggtgtacaaagctatttatagatgaaaataaagctagagataggtgttggttcatggaggtggatagagacacttctgagatgggactagtatattacaaggcccaaggcacaagttcggtttcagcaataacacaatattattttgacaattcccattgatttaggatgaattttgatatgatatcagatgggtttgaaaggtgaggagataggctttccaacaagtactagatcatccaaatcggagttggcatgaaggcgctaggtccgttcgaagtcaatgttgtctctgcctttggaggccgaacaggactttgacttgttattggaacttgtgaaattatgtgtgtatccgatgaagtgatgtcctcatcagcaaacaaggctaaaactcgacaatggattcattgtaggaacactcatttgataactaagcatagcttcaaagaagaagctgcaaatttgtcaaacaagcatcgaatcatcgcggaacaaaaaagaatatccaatccgaacaaaatccagaaatagctaaacccaatccctaatctgaatcattttgatacaccatacaaacagaacccaagccacatcacgcccaaatccaacccacgacatcgtctccgttagcgattaggcactcggcgatgttgtgcaagccacggagcgcggcatgcagttgttgtagtcatgagcattcatgagcacggaatcctcctccaatagcttcatcatggcgtcggcgtcattctggtgcatatgccacatgatcagcgacgtctgcaccactagcctcttgtcgtcgaaccgccactgctccctgctgcttctcgatgactccgtcctgctcatctctgtcacgcccagaaattcatgaaccagaatttctaagctgaatgtgcaataaatccctgtccaggaccagccagggtacacaaacgacaattgttgacatacagacccatgtcttacaaaaaatagaaaagattacaaatgcagcggaaaagataaaacaaactaaacttggacgcttgacttctgcagcagggcaactccactccacaggcatcccttgacggtagcgacgaaaccaaccctaacaagacagctccaacttggaagatcttcagctctggtgtgggggaaaagagagcaagactgagtactacccactgtactcaacaagtcataccggaagagaaggtatgatgcaggatataaccaaaggaggctaagggttcttttgcaataaagcaggcatttaaaaacaaaagttgaaagcagtaaaaaaattgtagtagattaagcaatattaaccaatcactgtccaacgctacaccacgttgcaacaggcccaaccaaccacctgaactacaccagttcattaagctaaactagggtgagactaatcacggtgaatctagttgatcgcccataaccgcgggcacgactattcgaatagttttactctggccagaggtgtacaactgtacctagaagacaagattccacacatgtcgccatgccccgaagtatcaccatgatactgcaaagggggaaatcatgacaagaccctccgcataaccctcccctaaccattcacaccacgctaaggtttcacccccacccccaacgggcaatgggcggtcccctcttgcgccgcggtaaatctggcagctggacaaccggacaccccggccgacccaactccatcacgcccaccctcgccaccggtgcctaggaaagggtcaagctatacttcagatcaagcagttacccactcccgcttgtggtaagcacagtaagtctcccagggtttcccgtgaaccagttcttaattgccatgggtgcgaccagcaaaaccatgcacccacagcccaccatttagtgtattttaattaactaacaccattgcggtggcaccaatccaaaactatgctattagtcaaagtctatgtaataatgtgatccccatttgtgtactagttgaactaggcatggctaagcatttcctaaaccaacatctaatctttctgatacccaagttatcaatggcataaggtaaacaatatatgcgggatatttgtaaattaggtataatatgatcaattgtaatgcatgacttgccttgctctcgcactgatgagaccacagcaacgtcttcgagaaaccgcggatcgacgaaatggccgaaatctacgcgacaaacagagcacataagcaaaacacactataagactactgaaacaggaaacaaaaccatttttaatggattctagggatttttatgaatttactgagacttgaatggacttaaacggagctcggatgaattacttatgaattttagaagataaactgtgtttttactaataaagaaaagcctaaataacttttattgcgcaatattacctagggctgacgtcagcgagagggggcggctcggcaggcgggccccgcatgtcagcggcacaaggggagagggagggggcgccggcacatgggccccataggcagtggctaaaagtgggcggggtggtccaccggttggttggccccactggggcagcagcacaaggcgggggagggggtgccggctgctggctcggcacggctcaagccggccggcatgacgaggcggcgatggcgcacgaccgacgacgacggcaagcggcggcgcgagaggcggcgcggacggcgcgaaaggtggcggcgtcggccgaaggcgacggcgcacacgcggagggtggctgcgctcatgggagggaggaaaggaagaaggagaggggatcccttaccgaggcgatgacggcgatcggcgcgggaagagacgagcggcggcgacggtttggagaacggtggacggggtcgggcacaacctgtgaaaggcgatgactaggttaggagaagggaaggatgaccacggtgactagaacggccggccggagttgggcggaaatggagagctcaccggcgtgcgagggaggcggcgcttcggcgagtttggctgcaagcgagcggtggccgaggtagcacttgcggcagcggagctaacggcggcggcggcttggcgcggcggaggccctagcggcgacggcgcgtggccggagatgggcagcggcggcggagctcgggtgtggcgtggggagagcggcggagtgcacgggcaagcgcggcaatagcggaaaaaggtcgagggggctcgagggagtgattcataggtgcggaagggggcggacgtggccggggaggtggccgatttggccggcgatgtggggtggagagaaagagagagtggggtgggattcaaaatgaatcccgcccatttttgggcgcgtgcgagggcgggaggagcggggaaggggcggcgacgtgggcgcagggcgcggagtgggcgcggggaggcgggaaaggcggtggcatgggcggttgccgccggggcgcggtcggctggaggaaggggacgaccccgacaggtggggcccacctgtcggcatcccggagggagggggaaggggaaatgggccggcccaacaaggggaggctgagcgcggggtgaggcgaggtggactgggccgatggcccaagaagagggaagatgaggaaaataaaagggaaaaaggaaaaataaattccctgggatttaaaattgcactttagtgatttttaattggtaaaaattatttacaaggctctgaaaattccactaaaaatcctgttaatatattgcaacatggggaactcaagaaaaattccaccacgccatttccgattattaattgcattgattaattagggattcaactctaggttaattaaacaatttcttcgagcaatttatttaaccaattttttttagcaagaaaagggggaaacttcagggcgtgacaatccccccctccctcccttcatgcgtgctcaaatatgagaccacatctgcggccagcccatctcctccccatctgcaaaggaagaagaagaccaaggaggaagaaagtatgttcttagatggaggttgacaaaatattcaactacaatgacatggcttcaattttacaaaattatagtgacacacataagaccaaggaggaagaaagcatgaccttagacggaggttgacaaaatattcaacggcaatgacatagtttcaattttacaaaattacaatgacatgtaacaggtatcacagatataaaagacatttttcctaattgaccaaatttgcaatgacatagatccaattaaccatttcctttttggccccctcccttttggtctcaacaatcaacatcaaggcacagccaaaactcaggtatcttgatatcattgataattgttgctatatgaagcaaagctttactagtgtatcatcacactacagttttcaaacagcccataatttcattttatcctttgccgggggcactaaattgccatatattaataaatgacatttattcctagccacctatcattttcagcatgcaaatacatacttacccaaattcatcaaacacaatgcatgtagcattcacttgtgacagctccttaatttccaaagaatcatcttctaatatcgcctgtttatttttcatgtcatttctccagacaagatataatgtggtgaaatgaatcctgtgaagtagtcatgatgtaaggaatcatgtgccttattatgtttagatatgaaaagacatgtgtttcccctcaaaaaaaatccaaaaatgaaccattatttgtgactaaagaaaaaagaaaaactgatcagttaatatggcaacaatttttgttaatatctatgattccaaagttagatgcactggcaatgacagcataagggattaaaagcaccttatctcccctcaccactgccttgtccaatgtccaaccttgcccttctttccttctctactacacgtgcatacacccttgctagcctccctacatttcccatttccatcaccatgaataggttgcagcacatcgattgaatatcacaattttaatgtgaatatatatatatgcagagtgaagcagaggaacttggatgatgcgtgctgaagttatcatggaacaggtttttgcttcaccatactcatgcaactttcttcaaaatcaattatgtttaggatttgcaaccatattcctttagatctatgatttgattaatgatttgtttgtggtattacaatcatttagagtggattcaacccgttctcttatatctattgtgtgtaaggattttacaatcacatttcttcagatccatgattttagtagactacgtgtgatataattatcatttagggtgtatacaacctatttttttagatctatcatatgtttatatcttttacaagcagattcctttaaacacttgattcaactagtaagattgtactgtactaaatgtgttgctatcatttattagggaccaaaacagattggtagtgtgtgcaatggctttatttaaaaaaaatatctcttttgtgtgtagatgattgttatatctcctcacaatacaaaatattgatcttaaagccaaacttgatttggcaagaacaaataacccttaaaacacataacacatttaattttctattaaactaagaacttactatatatcgcaagatatatgggcctcatatgaaaaggagtattatggatagtgttagaagaggtgccaaaatttagttaaaatgattaaaagagtgcagccaataaatatggactaagcaagaaagaaagctcctctaaacattttttccgaaaatgttcttttagttgcaaaacaaattgtagcatgacaataccaagcgtctaattgcgctgaatgcattcatcttatttaactatgtgtttttttatatggggttgtttgtgaatttaaccctcctagtggagttttcaccgtaggctaatggaacttgaaaatattccacctaaaatgcacccaggctgtaaaaaaaaaaatcatatcttctatataattgatgctgactagctactaaactcaatatatgagtgtaacacatcatcattcagtagcaattaatgcctaaagtattttaaatgttatacaagtatagtacatcatctatattttattatattttagaactcaacatgtaagcatggcagatcatctcacatcatttgatatacatatccatcatttctataagagctctttttccatccttgaggaagtaccatgaggtaccatgaagtactaggtaccatgaggtaccaatctaatctagccattgattaagcaggggcatgattggaaaaataagtcaatagacaagattatcgttcattggtccttccaatcggcaccacccaaatcgccaatagcgatatagagcgccgcaatccctttccgtctgtcatgagttctcgcccaaattgctaaaagcaaggtgacgccaccgctgggagtgcccgagcccaacgccgaccccttttctcagttccgctgccgccgccggcggatagatattagtaaggaattggtgaatacgcatgttgtgtttaggcaatatggtgcctgctattaataattgaagtcgtgtatctttgggtggtgattatgcgaattgattttattagtaattgaagttaaattccagtggagccgtagctgccgcctgatggtatgatgcaattagctaatttcaaaccaaacttgatactgtccattgaacagagggagatagtataacagcacaaactgctactacatatagttttgacgagattacatcaaagggaggcagtacatattaccaaacaaaataatgatgttcatcctgtcatccatcacacaaattaagaacatagaccttgagactaaaatcatcagctttacctatgtttcctcctaaaaccatcagcttcttatagctaattccatccgcagcagcaacgaaaacatgcaaaaatatgaacctgaagcttcggcggtagcctcactctccattcagtagggccctcgatctccattattcggcagcaccctagccgtagcggctcgctcgacgacttatcacgatgcagcaagtgacgttgaccacgccaaattcacacctccccaatccccaccccgcgtgcggccgattcacttccacagattgacgagaggagcaagcatgaccggatggagggatctgaccgggagtgcttgatgaagatatgctttccccctcatctgagatggatctgaacttggaacgggctccatctcttatttgcaacgtgtgttgagaaggaagagacgcagacagatgcgggcggaagagacgcggaagaggagccccttctctcgctgctgcgcgtggtgatgcactaatgcggaagagaacgcgaaagtacaattctaccctcccacctacggtaccgcctcaatctgggtatgcggtaccacgcggtatgaataaattccagtcgtccgatgctaccaaatcgatggccatgatttggtaccgcatgccctcaaggat

SEQ ID NO: 15693 - DNA, 1136 bp, Oryza sativa
acataagaagtttttgttgaatgtgacacattctaatactacgaatctggataaactagtatgtgtttcatgtaatcaaaactctttatattcttgagatagatggtagtatagatatgatattgaagcttataagatttgatatgcattaattattgtccagtgataagccatgcttgcatccattttctcggcaaacgaaaaaaaacacggaatggaaaaatagtaaagggcagcaagaaaaaaaatggaaaaacaattgcagagagagagagagagagagcacccatccatctccccggaggcgaaaccctaacccacccaacccatcgccgccggcgaaaaccctaatccatccgccgccgaaccgaagtacacggtgccctctgctccctcccacgctcgatccactacccgctgctgttgacgggaatgcggtttccctgacgaaatcgcggttcggcttcttggttcttgcagatggggagacctcgaggccgcggcggaggaggaggaggagggagggggaggttcggcggcggcggggggtcccgcttctccgccgcccgcgatgacccgccgccgcggcgctcctcctccgggtggggggtggcaccgccgtcgcggcacctgtgggtgggcagcctctccccgggcgtcgccgcggccgacctctcggagctcttcctccggtgcggcgacgtcgagggcatctcccgtgaccccggccggagcttcgcgttcgtgacgttcgcgcgggaggaggacgccgtggcggcggtgcgggagctgcaggggatccacctccgcggggcgcccattaggatcgagttttccaagggggttagtgtcgatcgtcctcctcccgcccccttcgccacggtttgccacgcttttaccgaattgttcatcatattccctgtctcaaaatcaccagtatccaccaatgaattgtgcttatcttgtcatggttgcaaacacgaatcgccgaaaaataaagcaaaaactatgtttcacaacagaccaagtgtcgcgataagttaaaattggtttggagttttgctcttagtcaaaaatcagaccaaaacaggatcaacctagtatgcttgaacaatgaactataagttctccgttct

SEQ ID NO: 15694 - DNA, 560 bp, Oryza sativa
tggatcccccgtgattcttttgttctgtaatgcaggttgggccttgcagcatatggtgatctgatctccagtgcacatcaagcaatcaacttttaacgctgtggtttattccatgctgccagttcaccaagctctgcatcaacttgcaaggatatcataaaaaaaataaaaaataaaaacaggtgccacttaaaggcaccattttactgttactagtatgagcaaccgctctagagcttagaggtgttgtaagtccgaaaaccgtgtctgaaatgtgggtattttgatgtgtataatctttgtccttttgcatgatcagatttaaatatcctgtgtttatttctacctcttctgcttagatgccatttctttttaatgcttgaatgttccatgcattgctgatgaaagaggagctaatttgtgtcatggattttgtccttgatattcacatatatcaaaccaaaatgctacataagcaacctagatctaagggatcgcctgaatatgatggtgtgatttagaggtttaagtgtggcctgcagtctcagattttggtatct

SEQ ID NO: 15695 - DNA, 2436 bp, Oryza sativa
caatgctagaaagtcttataacctgaaacggagatagtattagtttaaaaacacaaaaaaatgatgtgcacaatttatttctcaaaaaaacttattataacatcataaacttattctattatcaaagttttacaagtgtgacagaacttttctaaaaaaaaagggttaaaatatcaggtacagagttcaatagtggtttgcaacataaaacaaaagagaaacacagtgtgcatcacatgagcaacagttaccaaaaatagccttattattattaacaggcaaatcaccgaatcacagccgccggccaccaaaccggccatttccgcttccctattccgccccccttcctccgctcccaaccgagtccccggcgccgccgccggctacatcctcgccctgcgtcgagggccacggcgccgcgcccaccgcccgtcgcagcgcccccgctgctcggccacggctcgcacgaccgcgcgggtgagagaacagccggcgctgccttggcctcggctcggcggcgcgacgcccccacccactccaggctccacgtatggttcaatcctatgcaacttcttttttttttgttgattcgggaattcatgcctatccttgggtgtcgattgcgcatgtagtttcgaatttggattttgtcagtttttctagaatcgaatttggccatctgtagaatggcgctatgacaatgggtgtctgatgcatgaaccatcctagcgtcgtagtatttggcaagaattgggttcggtgagaagatgtcatgtaaagttggggaaaggaatgccaacgttttgagtttggaggtggggtttctcgttgaggacatatgctcggtgccgtttctggtgacaaaatcctgcatctgatagggagagaacaagatgctccaacccccattcggtttggtttctgcacggtgaactgccgtttgctgttcagaaattttggaggttcctttcaattgaacatccatgtcccatgttaggtcattcctgcttacacgtgcagctaaataggcatagcattatgacctgctatagagttctatgcagatctcaataggtttcccatacccccatcaatattctgattccgtcggtgttgttgatcaatggttctccacattttagttcgtctctcatatgtgcggaccagtatatgtgacggagctattttcctatatatggtaatctgtaggacttataaacttgtgaaagtaagttcgtgtgttatgccttcctaaaattttgcagacattcactctacattgttgttcaaagcttcctctcttaccatgtatgtaaggactccttcaccggtgtataaccaaggataatagttgttgtatattgtttgctacaatcttatcgtagatgtgtataaaatagttttatctcttaaatgttaatgatttgtatgtgccatggtgcatcagtgtttgaatgtatcagaatcaaatgaacttagtacaatgtgaggggcacatttatagatgtgagactatgggactatatgctatgtaaacaaatcattggcagaatatgtattaaacattttagtcttatcaccctaagagtatccttctaactaactgtatatctgagatgtccgctattaaaagcataagtacttctgaaaagcctgcaatgcaaaatgaaaattcaattgctatttgcttttttaatcacatgaaattagaaactatttactgaactccttgcaatatgttctcatatggaacagtatttaacgccttctgtttgaactatgaaatgtttgtatgcttttgtaagcacacttttggtgtaactgtggaaattcgatgtatggtccaatccaactgtatcaaatttgctttattttatatggcatcgcgttaaaaaaattaacagattagagttgtatctatttttaattcattttgttaatttacaataggtgaggaatttttaatgcttgaaatgactgaaagttggatagaaggctcaaaaaacacttcagctccagaatcagtttcttgttcagtttctagatatgaatcatcaccgccaagaagactggggaaaaggtaattaaatgctaatgtaccattattttttatttattttaggttgtggggcatgatgtagagtgtgacttttattttctttactatccccagaaatatttatcatctattagctcaacgggagatctctcctcggacaaaacaccaagctaaaaatatttggtctggatctccagaatgtgctactggttcaattgagttagcattttgggttacagatgctagacatgatcttttttcttggtaaggcagatttcttttttaaccaagatgagtactttatatttaaagataaacttgaaccgttgattttactactactatctgattgagcatgcatcctaaaccttaccttt

SEQ ID NO: 15696 - DNA, 1431 bp, Oryza sativa
gttcctaagagacgtagaggccggacatcaccataataattacactggtggatcacatagctgggaactgccttttctccaggttggttgatggcacaaaaccgtacaggattgcgtgcaacacttcctaacaatgaggttataggagacttacctatcggtggcactgctgggactgataatgtgatgaatgaatcatcaaacatgtacagttttgaacgtgtagggccttcatcatcaattccaattactacggacagtttgagagggctaagtaaacatcgtcatatgctggcctctgtacctggtggagcagggacttcgcttcaaggtgctcaaaatggtgaagctcatgttaatgttgtctcattaggtgttgggtcagaatttgctacgtcactgtttgctggtgacggtactgaattaccctgtacagtgaaacttagaatatggcggcataacattgacaacccttgtgctgtgttagcacctgaggcatgctgcttgacaatctctcatgctgttctttgcaggtacactttggcattcctcctctttcctctgctttattgtgtagtacaaattgccaatcttttcctgttgttatttgctaatgattttgatgtattaaactaaaaatcgttgctattttcttgtgctagtggtaggcagcaacaaccatgtgacagtaactaataaaacaattaatgcacaaatgtatatttatctgaattggtgcatttgagttgcgcttttatcatggttgataaattttgtgctgctgctgagatttgagactctgaacttattaattgctgcagtgaaatgggcacccatttttccccctgtgggcgttttttggtggcttgtgttgcatgcttactgcctcaaacagaagttggtgagcatgtaagccaatcgcctgtacagtatgattcaactggggctggaacatcaccaactcgccaccctctcccctctcgtcgagttatttatgagcttcgtgtttattctcttgaggaggaaacgtatgttttctcgatgctattttttttattatttgatttttatctgccagtgtctgtaaattgactagtgaagtcatttattgcttttgtgatttccttgtaggtttgggacagttcttgtgtcccgggcaataagggcagcccattgcttaacttccattcaggttattttctttccaattttttttgtaggtgtgaccattaatacttttgaggtagttgtgtacttgcttgtgtgaggcggcaaatatgagtttccgcagtcacttccattctgagagcattaacactttgtatcgaacttaagtgtgttcagtgaagacgtgttctctaacccttttggtggacaattctgtagttctgatcatttaattccggactgatgtgatatgaaatttgttct

SEQ ID NO: 15697 - DNA, 5943 bp, Oryza sativa
ggatggcaagaccacaatccctgtgtacactgtcttggaggtagatatgatttacaacttaacattaaacatttaacaggaaggctgatacagatgctctcatgatacttgtttctgtgttttgtattggatgtaatatacttcttgttttttactctactacacataagtttgacaaagcttaattgtgaccactagcttctattgtaattctttttgtaggacttaataaaattataatatcgtgaaaatatatttttcatatgaacgaagtattaccattgtgttataaatctaatctgaacattgctaaagatattattagttgacgttaaaatagtttataatggaaccaaactgtggggttacgatttatgtgcagtaatgactaatgacctcatactttcaggatataaggctatgggctaatactatttctttattgcacttccataggtgtatagagtttcagacatggagcttgtaagagttatccctagtgctgaagatgaagtcaatgtcgcatgttttcatccttcccctggtgcaggtcttgtttatgggactaaggtgagtgacaagttaggtcaatatcaaagatggaatgaatattggtatatctgatgcttatgttgaatcacaggaaggaaagctcaggataattcaacacaatgttgcagactactaggggaaatattcttgaggtactacttacccgttatttacttttaggtctttaatgtgctcaaactggtacctagtctgccaagcataagcagaatttttttttttttggtattgtcctgaatacaagtttgagataccgtgcatttggtcttgatcgaaccgtttaacatcgtttattttttgaagcacactgccaatcgtattaatagaaaatggactggctttcagatttttagagaggatcaacccttttggcttgagcttccttgtgtccaaattccaatctacctttgctgggggtctcgctcattctagataattctaaggctacagatggtgttttatattaatcatttttctgtataatgtgaggttctggtattcaacttttccattactggtaatgaattcatactgagctaggatccactagggttcaatgcttaagaaaatgttgtgccgaggattctaatctattgtttgattggtatagccagttaggccagtttgattggttctacttctgagtgaacccaatgctaattcttttcgcaggaacttatctccacagattcatatgcccaatgaatcatatcccatcccagctaaatcatggtggtcaattttgaaggaccaacatgcagatgttcgccttcctgagtaatccacaacatgattgcactgagactccggaaaacattttgtgacgatcatgaagacttcgctctgcacctaggtaacagtgacgcgggtaagaactaagaagcaagctgtgagagaacagtcaaggaaaccgctcccggtggcagcatatgtgactaagttagtggttgactaatttcattgctagaggtagagcaggaggatgctggtgtattgatgctgccttagccagaaaatggggtagcagatgaaatctagcaattggcatacatgtcaatgtgtcatgttgctctgcatgacgttgtcctaatggactgtaacaatgggatgttgctgcaatcagaagcacatacgctcttattaacatgatttgctgttatgcaaatcttttttctgccggtatatggactggggttggtgtatgttgggcaaatgaatcccaaaaccacattagtaaatgcgagaaaatgggtatcatgatgtcatcgcatatcacttcaagattaattagaaaggctcgtttgacaaataggatagggaaataatatcccatccattaaagggtaatattgtattctaaccattcattctttatacctcatttaatcttagtcattcatccttttttttctttcccaatcccacatctcataaccatttgccaaacaggccttgaggattttgttgtcttattcctcacttgtgaatgactatgattagcgagtgatgaatttgaggctcctttggatataagaaatttaagaaaaaaaaaatactccctctgttccttgatatagggtgcaactggtatagggtgcaactggttttttaagtgtaccagaatataaggcatccatacacatgcaagcaagcagcattaaaacaaaaagtatgaaatctggtcgacttccgtgcgcatgcatgcaaaggctttcaatgcgtggagttagctcttcgtttcttgcgttcgcggggtcgttcacccaccaaatagcaggttgtttgcggggaaggatgcgaagagctgcatgcatgagcaaaggccgatgcacacggagaagcgaagcgtcgcaggcgtcaccctgagaaaatcagttaagcctccttggtattgccgtccagagcatttgcgccctatattaaggaatggagggagtacaggattatagtgttctagccccttaaatcatatggatagaaaaacgtaaaaagaaaaaaaaagtaagaatgataatttgaatggagtgcaacgagaaagaagagaggtagacacaaatgacccattttcccaataggttgatggttatgttataatttttctaaaagttcttatgttttgagtcaatcaaaagaaaattataggacttttgatagctattctttttaatccaaaaggctgcatagtaaaaaaaattataggattaaactccaaaattccaccccctttatttttgtcaaaatggccattttaaaaacttatttcgaaactaaccatacaaaagaattcatccaaaaataggatgggggcttagcgccaaagcagttggcgctgaggttagccgtctaccagtgtggtggccgagccgatcccccgtcaacgtggaacaactaacctcagccttggtgctaagacaactaacctcagcgctacatgcgttgatattgaggtagtggccataacctcgcttagggaacaaccttagcgctagcgtaaatggtgccgagctatacgaccttagtgccattacgctagcgctgaaccctcaccgcttggatatcgctatgtacggacctcagcgccattccatcttgcattgacctatgccggctcagtgcttgcaggctgcctaacacaggagaagtgttgggcgacccaggcacgagtgcttagtgctgaagatcagcgtgggaaggaaaggcgctgataagggttcaacgtgagggtaattggcgctgacatccttgccatgtcggcggggggaacggctcggccgccgcgccgatagggtgtcagcgccaaggcggttggctccgagacggcttatattagcgctaagaacattggcgctgagtccgtgatttatttttggatgaagttttttttacacggtctttcgaaataattttttgaaaatggctaatttgtcaagaaaaaccgtggccatagccatctgcgtgcttcgttctttgcgaagctcttcatggatgctttgagattagtgccagatcgtgggaggtaggtgtgtgcctgtgcgctgcgtcttttgaccaacccagtcgttgacccaagacgaagcgaagcaggcgaccattttgtttttttccttttaatttattatttccaaccaagaaacggaggcgtggcagttggttgggcaacgaatgcgaacctacttctcctagtatactgcttttactttagccatcgccaccaccgccattcctggaacccccttccctcttcctccctcggatctctcctcgctcgcgcgttcgcgccgccgccttcccccttcccccgttgattgattggttcgtgtttttcttcttttttttttccttctgaggggtttcttgatgtttcctgccgtgtgatttgatttgatttgactttccccttcttcttgttttctttttcttgcagggaggaggatcaatggagtgcgtccgctccggctccggggttcttgatcccaggtgctctccgcggttcctggggaagaagggtggttcgctcacgtgagtgcttcttgatcccaagcgctctctgccttttccccctgtttctttccttctttgtgagtggtggtgatctgtgatctctcggtggggggtttggtgcggactggatcttgctggggtttttatttattcaggcgtgttgttgagatcactgctttttttttgggtgacgattaaattttcagtgaaagcaaattagtatatctaccagtctgtagtcagtatgatggagaatgattttttttagttcaaaaacattgcaatgaatccgtggactaatcagttatttggatctcctcaacgaacaattatgttagctcaattttgttctcaacaaatacagttttcccttgtgagttctgagcatctggtgcacacaaaacttagtatatttgtactggactaagattactgtctacagctccaaaatcaaaatgtattttttttttgagttgataccatttagagacagtaagacatagtactatgggtttgcctatcaaatggttgggtgggaggaacactgaatgttcaatttgtcttgaagaaagttaattgcatatgtgatttcccccctttttttattgggagtgttgatttgtaatctcaacggagggataggtgctgtagaggctggtgttttattcagacgtcgttgcaatgactagttctctttttgtgatgatttggtaggaaatattcagaaaacgaaaattaattctagaatttaattggtgtgccatgtaccatagcatatcaccttgatatctaccagtctgtagttaacatgatgcataatgtttttcttttagttgaaaaaaatattgtaacgaatccatggactaatgaactatttggatctcctgaacgagcagttccattccttacaaatctggcaaagacaaaactcaaaaaaactaaatgtgttattgagttagtgattttgtctgtcaaatggttgagaggaatgccaaaggtacaaatggtctggaagaagggacatatcttttattgactgtatacaacactgaaggatgtgaagctcaatctaggcactttactgttatatatatcaataaagttataaatcaaattttctgtcagttgagatttgacgcgaattcacaatacatttgatgttgttattgctaagttaaccaggctttctgatatgtgttgattccactgttattaagttgcccgactagtcacgattagttgtaaactagtcgtaaagtcggtcaagctagtcgactagagggctatgactcaaccaaatagcaagtcgcatgactagtcgtggttactcgtagattagttgtgattagtcatagcaaatcaccaattcactatgccaattggcttattgtgtttagtacttcagttttgtttcttgttgacttattgtcttgcttgctacttcatagtccacagtttatactataaacagtgcttaatgcagtataatagtagtaaagactatatattgtatatcctgtttttgcatgaccaagtcatggactagtcgaccaaatcgataagtaggtccaggggtacctcgactttacaacttgacaaccatggtttgttatatgtttctatgagaatatcattaggttttttaaccatcaaaccatacatcttgttattgattttgatagctgctaccattgacaggtcatgtggtaaagccacttctacaaatcttgccatttgtaccaaacacgagcaaaacttgcatgggaatgttaaaccctcacagttagcagcaagtggatcctcttattctgttcacagaagtccagtgcttaagcagagacagaatctttctgctaggtctacctctgcaga

SEQ ID NO: 15698 - DNA, 1377 bp, Oryza sativa
ggatcccccgattttaatgtctggattcagaatttgtctcctatctgttccttatttagtatataatgatttacttatatttgtactgttcaggatatcatccgtttgccaaggctgttcaggtttcttcaaagaccattggccaagcttatctccacttttagagctccaaagagtaaggaggggtacgcttcaatcggtggaggatcacctttgcggaaaattactgatgagcaggtaaaatcttgccatcctaatcacaaacatgtgtggtttgtcaaaacaaatttatcagcttagttaaatattagctttgcctactcataagttttgtgatatgaaaaaaaaaatgtattgttgagtttcctaactcagttaactgtgttacaggcaaatgctttgaaggtggcactgaaaaagaagaatttgaatgctaatatatatgttggaatgcgatactggtacccttttacagaagaagccattgatcaggtgaaacttcctgtctctagaagtcctttaaatccttcatttctttgttaagtctcaaaaacagtgccttgccatttttgttcaattcgttttccatggtaattactttattgtttttcttctaacttacttagatattgctactcaatgttattttaagtatcttcttttcatctgttgttgagtattcagcactcaacagcatatgctgcatcgtaaactttagatatttctgttgttccctgatttttgttgttagtttccaattgattataactgcttctaagttttggttgatcatagattaagaaggataagattacaaagcttgtcgttcttccactgtaccctcaatactccatatcgacaagtggatcaagcatccgtgttctccaaaacattgtcaagtaggctgctttctcatttgaattctcatctagtcatcttccatattactagatctttaaattctaatctttcagacgctgtagatcattaaattataatatttcagatgctgtagatcattaaatattaatatgatggcatcatgcagggaggattcatattttgctggattgccaatttccattatcgaatcatggtaccaacgtgacggttatgtgaaatcaatggctgacttaattgaaaaggaactgtcaattttttccaatcctgaagaggtttgaccattcccttttccttctatttttctccctacagtttcccacctttggattgcagactgtgaacacaatcatagtataccttttttggtagaaatttccttagggatacagtttgacatagttcttgtatttacctgtggacaaaattcgacattagatacatccttaatcttgtctacaactaattttcagtatc

SEQ ID NO: 15699 - DNA, 807 bp, Oryza sativa
gggtgttttctagaccagtggatcccccaaaaggttccggattggctgcggattcggagaggaagaggggctcggtcggccgactcgggctcggcctgaggccggccggaggttgaagaaacctccgacatgtgggccccacatgtcggcggctggaggaggaggggcggcggctgagctgggccggcttgggccgcgcgggagagagagagagagtattgggccgaattcggcccaacggcttagggaggggttttttgaacttttttaaataaaacaatttgtgaaatgttgtttcaattattaaaaatacttcccttgctcaaataattcccagaaaattctagaaaatagaggaacaagcaaagtatttaataaaattttatctagctcatttttatattgagatttagcaaattaaaattagatcttctctttgaagcttttaaaatcatttctaataattccttttaaacaacaatttataatttaaggattataaacaacaattataattagatcattattgatcaaataattactgaactgttctttgtatgattaaaattaataattgagctccgaaaaatccgagaaaattccagagagtataattaaccatggagaatttaataaaaattaaatccatccatgctttatatttaggaaatcctatttcccacatttaacttcacttgtaaatcaaagaacatttaatataaaattctattaataatgtattaaataaccataaatcctaggacaaaatcaggatgtgacaaatgtacccccttacaagaatctggc

SEQ ID NO: 15700 - DNA, 460 bp, Oryza sativa
cgctcaagctgtgggtgctcgacgattacgtcggcgccgccggcgccgttaaccccggcaaccagtgggcacctgtctgggaatgcaaatatagctgcatgttaccagtctctacgccgcagagcgtgtccgtgtggaataacgacgcgggcggcggcggtgacgccggcggcgccacgttcacccggcgtcgcatcacgctgtacggcgtgaatagacggcgccgagggggagggcgctccacgtgttcgcgtgcggcgcgcgcaccggcgggttattgcaggtggcgttcagggagaacccggtggcgcacgcctttttcaagatgcatccgtcgccaaccgtgcgcacgtttgggtttctctgatctcgagaggcggctgcgatgatcgtcgacggtgcacgagtggaattggtgtgtaatttattgcacatggaaaattgctggactcatttatat

SEQ ID NO: 15701 - DNA, 6158 bp, Oryza sativa
tttacgagtatggagggagtatactataaagttttcatacgaaatgtacagtttaaccgtttggatagcgtggtgacgaaagagaggagaaatttgtatctttatataccaacagcaaggacagtcattgggacagtttgaggcccatggcacattgctttttcctaatttcggaaccaaatcaatcaggaacatgtgggaaacgtacaaagatgggacgctggaatccaaaagaaaacgtaaccgaggcaaatcccgtccttccttcccgtggccttctagaaggcagcccagccctgcactgcacagctgcacatgccgtttgcctaaccctcgtatccttctagaaggagatcaggaggaggaatcaaatcagctggcacctgtcagtatcataaagcctgctgttttcctctgcaattatgcatgcatatccatctaataaaggggttgtacaattaatagacacagtgttccggctggtcggctgatgccttccgagagcaagtacaatagcagactataaactagctataaacagatatctaagacacaatatgcatatgatagatgagaacatacattaatagtataatatatgtttataggtaactattctataaattagctattaagttgactatagatgatttagagctagtagttggctatactattaaacttacttcgaagaatatttatcatatcgaaatgaagagtaattgtttgcaatttaattaataaattataagttatccatttgtcttttctaaaatataaagtagttatattttaaaacagattgagtacataataatgagtggattgtaaattcacgcagcacgagggaagaggggacgaacagttctctaaatttgaagagtactagtaaagataatgatcaaataaacactataatttcacaaagttcatagtaagagtttgttcatttactctcctctgaaatgtggcaaacattttacctatggactatatggcaaacattattctgctgtacgtgttctaattttttaacccaactgatcagacgagaataatacatagcttttccaccgaacaatggttgaccaatatattgatattaacgacctgctcgaaatataatttgacagcgataagcacacgtgatggtaactccagtgtttatgggtgtcactatgtcagagcttactaaatgcaagattagatggagccgataacaaatggtgcatgtagaagggatacttcgaagtatatagagcattggagcacacttttcacatcccttcttctaaagctgcatctcattaccaaaaagaaaaactgtatctcattttgaatttcaaaataaatttaggcaggctttccttcatatatatatgtagcttccgttgtcaaggtttactttcagatggtgtgttcgactgttattttcgcaatagttgcggttgcagcagttcaaaattactgtagcttacagtgattttgaactgtcacagccgcagcggttgcgatagtcttagctacccaacatggccataatttgctaggaagacaactcaaaaaacctaccaaaaattatttttctgaaaaaaaatcacatttcatttttttgtcttttattaagtcacaatttgtttttttttcatgaacgcgtaaaaagattgcatatcaatatattagaagaaaagagttttagttacataacgcaatcagctagaccggcttatgccagaggaagggagaaaagtcaaaataaaaaaactgaagcttagaaaactacggtggctaaacacaaactccaaacaacggtaaggggccaagctatgttacactcctaacagtccccaaaagcagcaacacattttgttttttgatcactgaacaaccaaattgctactccagcttgaactgcttgcttggcagctgcggccgcttttaattattcatcaggagcaagcacagcttttattatcagttaatattcggcaaaacgtgcatgcatgtgcacgtagtacacagaaatactactaatattccctattaactaccactacttggctaagccaagtaggcttctccacgtgtgtatatatatatgactatgtgcacacgtacacgcccaaacttaaccaaaatccacaagcattttcttttacccaccaaacaaacaaatcgatctcttgtgtctcatggccaccgtgcgggcacacccgccggcgccaccgtctccggtgcaggcgccggcgccggcggcgccccctccggtgagcgtcgccgcgcggccgcaggcgccgtactactactactgccacggctggaaggagggcgtggcggagtcgcgctgcccgacgacggatgcggcggcggcggctgcggcggcgaacggtggcgtgatcgagctctcgtcgtcggacagcagcggcggcggcggcggcgccggccgatgggacgatgacgacgacgggtgcagcagctgcgtcgacggcgacgatggcgcggcggccggcggcggcggggcgggccggcgccgcgacgaggaggagaaagggaggagccagcagttcggcagctggtggagccgccatgacagcagcagcagcagcagcttcctctggccgccgccgccgaatgacaacggcgacgacgaggacccggcggcggcggcggcgaggcggcaggaggaggaccgcaagttctgggaggcgtgcctggcctcgggccttccatgaagcctgaaagggtagctatagcaatcgagtatcggatgcgacatacaaatccgtataattctagattgatatattatgatatcggaaaatccgtatagtcgtagattgatatattttgatgtagattgatatattttgatgtcggatgggacgtacaaatccgtatagtcctaagttgatatattctagctggagggagtacaaaactgaccagtaacgtatgtgtgcaatattgcttgttttttgttcagtataaattggttttgtgtttctggattaaacaaacagttttaatcagtaacaaaccctgtggttttggcaacgttgcaagctacaattatgtgagtttggtgcgtgaggtgatggaaagagaacaagggtggttaccttaccttacttagtactagtagttgcttaggaactaacctcttgttgttgatacatagtgcgtgagtgcaatcaacgtgtaggacagattgttcctctccccttttttctttctttcacttttttgcacaaaaagaacattaagaaatttcgttgatatgtaatgcgtgttagcgttgtgttttcccctttacttccttttatttctctatgtaaatagagagttaaattaacgcacatacacacgagtgtacctcccctaacgtaaatcgacgcctaaaatcagattttacaaataaatccacgacaaatttgcatcgcatgcatgtaagtcatgtagctcaatcactaccatgtactagtgttgtcctttgaagacttgaacaagaatggtttgaactttgaacaataatggttggtgggaagcgccaacgtgcttaattttgctgcttccatgactccacccaccagaggcgatggttcttcgatgtttctcattgtctgcgactgcatctggacatctcatctggttcgtctgaacaagaacaactgggtaatcacagtaacaaggggtaagtgaggatacgacgtcgacagaggcgtcggaattaagattcaaagcctaccgttaattttgattaaaaaaaatagtaaccttggattatgtcattatgccttgcaaatgatgcaagggaagtatctcaagtcaggcatggttcaagaagaataaacgaggttaagaaagttaacttggagaagttgaaatgagcaagcggatttgacccaggatttgcattttcgatttcagccaaaaattcggttggaccaaaattttgtgattttcggcactctttggatagttttttttaattttaataaattttgactagatttgaataaactttgaccaaattcaacaaacatttgagaaaatccgaaaatttcggttgatatattgattagccggtgggggtctaaaattaccgaaattacaatcattgatttgaccatagaaaatgtgcatgtaggatcaggttatgtcagcacaaattctcccagcaacggagatgcatgaaacgcacaacctcgcaatgtaaggtcatatgctttgtaacctgcaagtccctgcacattttctcacagttacagggtatcaatggccttacctacaaccaagccactcaggagctgtgcaaatactgcaaaatgtgtatcaagttaaacacctggtaataaagaaacacataaagatgcgatggtaccatccaaatggcaaactgtgtagtatcaagtgaccacctggttataaagaaacgcataaaagatagaccagtaccatctaaatggcatcatgtcttaccatggaaagtgaagcatcctggggacagagttgcttgtaccctccaaaagagaatgggttcctctcatagcatggatgatggagccccaatcaaagaactcttgcaagtaggggagaacaccgtttgtatttgggcaccgcagagtagatagtaatctactccctccgttagccgtttaacatttttcctagtcaatcttctttaactttgatcaaatctatagaaaaatatagtactattttcaacacaaaataaacatattatgaatgttagatttaatgaaattaatttaatattttaggtgttgctaattttttctataaatttgatcaaacttagtaacaaaaaaattaaaccataatatgaaatggatggagtacttagtattttaagcatatctgctggctgtcgcagagacgctcaaatcactggaccagtttgagatgtcggtcgcctgaatgggacaaccgcacatcgctgtcggttggagatactgttctccaattcagaattcagggtcgagcaacttgaatgacatgaactggcaactagaaaaaaggcagcgttcgtttggaggacatcgagggagaaagcatctcgttttccgtacgcacgcttcccaaactactaaacggtgtattttttgtaaaaattttctataggaaagttgctttaaaaaatcatattaatccatttttaaaatttaaaataattaatactcaattaatcatgagctaatggctaaactcgttttgcgtatcttctcaatctcctcaatccccttcttctcaaacacatagtccagcaaaggtctcaagaagaagtcagacagataacagtcgcaccaacaaataagcaatttgagcactgaagaataatatatcttaaagaatcagaccagcaactagatatcatatgctgatatatatgataaaataagttattgttgattcatcttttaggaaaatagtttcttgcaatttctagaattggtaggaagagctaacttactggattttatttatgagagaagatcagcagaatcacatttattctttttgtcatcattcgttcagtgtcattgtttattccatttttgctatgcttttcccttgatggttcaccattcaactggaccttaagataagttctctgcacttttcttgattacaccttccttgttctagccctgaaattacctcccactacctacaactagatgttgatagtttctttaatgactttattataaccgatagaaaagttttttgggtttcaactgattgtcacgccacatttggaatcaaataaagaaggttacttgaatgcttgcttactttattctgtccaaaggcaaatctatagtacagccaatgttttgtatctgaaatgtaaaggtaacctatatacatgtgttggtctcttgattctgtcaagccatcaatctactacctccattttaggataaatgacagcgttgaatatcctgttcaaactttgaccaatagcaatttctatgttgtcattgttggtaggttaaggccctgtttagttccaaatttttttttcaaacttctaactttccatcacataaaacctttcatacacacaacttttctatcacatcgtatcaatttcaaccaaacttccaaacttcagcgtgaactaaatacagcct

SEQ ID NO: 15702 - DNA, 5463 bp, Oryza sativa
acacggaagaagaaaccagacctcactctcatggagaaagaattgatgtccttgtcaagtgtatccaacaggaagatagcctgaatcaccatgttgtcaacgcggttcacattgaacttcaccttcgccctgctgtagctatgacccaggccaagctgcgccttctccaagtccgatttctaaagtaaatcacacaaaaccagaataagcaaacgggtgtacatacattttttctttacgagattttgaacttaagcacacatacaagatttttctttgtaacttatgcccaacgcatgcatttttctttgaacaaacaaacgcccacatatgcattctagtcgctatgctatcaagcaaacgaagcaaataaatcgttatatgctactagtaagagggtttgtggtgataaagcggaatcgtttatcaccttgagctcgctgatgaagcggtcgaagtggaggcggacgccgcggagaagctcctggacgaactcgttgctctggcacgggatgccggtgacctcggagatgtgggagccgaccttgggctcgacgacgccgaggctgtacttggccttcttcccctccttgggcttgggcaggttcagctccaggaagctcctcagctcgtcggtcatgatccctgcacgcggaatggcgtcagaaaaaaaaaacaaaaaaaaggagaagaagcacgaatcccgcctgagctggcggcggcggcggcgcaagaacgcgagaggaccttcggagatggcgttgcactggttgagggcgtccacggcggaggagaagggggtgaaggcggcgagcttgacggccttgccgaagcggtcgaggtcgacgacggaggcgcggacggcgtccacgctctgcccgatctcgtcgatgccgtaggcgtggaagaggccgtagccggacgccgactcgaagagcaggtacagcgccatctcgccggcggcgtcggcggcggcggcgggttgaggtttgggggcggcggcggaaggggggttagggttttaggggagcgaggggaggcggacaacggcgcgggggtggatgatttatggctcacgctgggttctccgcagccgttggatcgcgatcaaccattaggtgattattgccccttttttttctcatttctcttcctctttttcctttttgtttgatgagggtccttctttttccttattattgcatttttttttacaatgatttgaattattgatgagaaagtggttggttggatagtaacaaatagagtaattttcactttggtcaccttttattactactggtgttttgttttggaccacattttaactaatgtttttactttgatccgggtaattttgcatttatgttattttggaccacccttaacttctttttctatttacatcaaacttgtcgtatttcaaataaattgtctatataaagcggtgtgggtttactgatgaatttgagccggcgtacttgaaatcattcatatgcttgagataagagttagagtagtccaaagtataacaaaggtaagattacctggttgaaagtgaaaacaccggttaaagggtggtccaaagcgaaacaccagtaataaaaaggtggtccaaagtaaaatttactctaaaaattgagtaaatttcatcttccatcactttatattaccctagttacacgatgaaataagaatttataaatttttcacttaataataccatctaatcttaccaaaacatagtagcttcgaatagggtactgagttgagttattgcttgagtttctaccatggctatttggtccatccatagaagaagaaagaggtgaacacaagggaatatatgtgtagtgcgacattaggagtcagcccactacttgttcttgtgcagatatggcaaggagctcaacattgcttgccctattgcctagcccaaggttcatcactagcacctctggtatgccaacactcgagctaaaacccctccaatgttgctaatcccatacgttgatgctcctatctccaaatagggcgcccgatataatgaaccactatctctactccgtcctccaaatcaggacacaaaccatcgcccattgggactggggacgctcgctgctgccctactcctgctcccttgtagatcaggttgccaccatcaccactctcctctctcggttagatccaagttacacattgattgggctgcacaacaccgatagtcatgcttggtgatggcaatgtgtgcacgcgagagagagcacacacgcaatggtgtaggtgcatgggtgatgccatgatgtgttaccagatttggaaaatatgaggatgtggtcttgagtgaaacacatagtaaatagtaaagttacacggtccaaagtataaaatatgggtaagctatcagaaacaagggtaaaaatatacgagccaaactacaatttacttattttttttctttataaaacagctttacaaacacatattttgatgatctaattatgtgaaaaacgatcactttttttttgacagctttgatgccaaagttgcattatacatcgtggctttgtgtttctaatgatgcattttctattagaatttaaataattgatatgctaataaataattagtcccttttactttattttttattttttatgtcatttgtaaatttaaataattttttatttgttaactaactcgaaaaaagaatgtcgccgacaaatggcagacgtcgccgcgggtgatgggacgacggcccattacacagcccggcccggctggcacggcccacacggccacacctcaatcctcaataggcgcacgtgcgacgcacgcatctccctgtacaaaaccctagccttccccatcctcgcctcctcctctctccccccgcaccaccgcctcccctcctctcctctcctctctcccgccgaccaggagaaagaaggaaaaagaagaagaaaaatcctctgcgatggcgaagaagaaggagagggcggtgaacgtgtcggggaagccgcgccactcgctcgacgtcaaccgcgccaatgacaagaagggcgcgggcggcggcgccgggggcggcggcggcggccgctcggccgccacggtgcggcggctcaagatgtacaagatgaggcccctcagggaccgaggcgggaagatcctgaagcacgacctccagtccaaggagctccccaacacccgcatcgagcccgatcgccgctggttcggtgaggatcccagcgcccccctcttcgctttccccttttcttctctagttgggagttaaatgatactagctgaggagaaaagtgaagcgaattcgattcggctagtaactcggcacctagcagttagcatggctcgtatgcaccgtcgaattggtgtctgtttggtactaatttttgttgattcagctagtaactcggcacctagcaattagcatggatcgtatagaccgtcgaattggtgtctgtttggtactaatttctgctggaatagtagctaatgattgtacaagtgaaatttgtgtggtatgacttatggaagtgcgcgactcaatgtgctattcaattatggtagggacaatttgctggttgaaaccttttcgaaacgtcggtaaggtatgcttgattggtggttatggcttgatatacgatcaaaatgcgtagatgccttgaatgaacatttccctgttgcaatatttctacttccagtttgttccacatttgattccggtgacgtaacagcaagtctgcaagtgtgcttatttctgtactgctctgctcttgctacttacaggaaatacacgagtcgttaatcagaaagagcttgaattctttcgggaggaactccagagtcggctttccaataactataatgtgatactgaaagagcggaagcttccactgtcactactgcaggatcatcaaaaggtacaacttcttttggtcattaggctgtcgaaaatgttgggtcttcaatctattttggacattgaagaattaagtacttttgttaaaatacatggtgccttccattttaactgtggcgaagtgctctatagtctactgtctatatcagtgtaccgtatgttgcacttatgtatgtatgtttgcccctgttgatgatacagcaagctagggcgcatcttcttgacactgaaccttttgagcatgcatttggaccaaagggcaagaggaaacgcccaaaactaatggctcttgattacgaatctctattgaagaaagctgatgattctcaaggtacagtttgtatatatgtacccagtactttaatcgcttaatatttttagttatatgtaattactgatatttatgaagaccccaatttcctttaagtttgaaatcctattttgcaacttgggcaaatttatctcatgtacatgttgcactcatattccaaaaagatcttcaaattttaatttgcaggcctcctggccattttgctacttagaatcattaatgattgttgtagactattcttggccttgggtatttcttattttcagaagtcaattacatgagcttgtatgctgttatttatcaagaataccactatcaatgtcctgtactcttagtaaaatgttgagttttataggtgcatttgaggataagcatgctacagcgaagttgctgaaagaggaagaggaagatggcttacgagacctagtccggcacacaatgttcgagaagggacagagcaaaagaatttggggtgaactctataaagttattgactcttcagatgttgtcgtgcaggtaagtgttgtgacattttgtccttgcaaaaaatactctcactctgtcaaaccatccagacatctttggtgctttttttttttaaaaaaaaagaagtgggcattgatttatttgttgatcctattgttttgcacaggtgttggatgccagggatccaatgggtactagatgctaccatctggagaaacatctgaaggagaatgccaagcacaaacacttggtattcttactaaataaggtattgataagttccacaacaatacacagtgcaaaagacggactattttcatccttgtatggtggcacattgatgaatgatggtatacattttttagtgtgatctagtacctgcttgggccacaaaaggatggttgcgcactttatcaaaggactaccccaccctagcattccatgcaagcatcaacagttcatttggcaaagtaagctagcagaatcctgaagaagttcattgtttcaccataaatgaccccttacgcatttgaatcttttccagggatcacttctttcagtgttacggcagtttgcacgcctgaagagtgacaaacaagctatatctgttggttttgttggataccccaatgttgggaagtcatcagttatcaacacgttacgctccaagagtgtaattctcttttctttaaccggcttcacagat

SEQ ID NO: 15703 - DNA, 1107 bp, Oryza sativa
acacccaaggcaatccaaggatagtgtggattatattttatagttgtttattgcccttcagatatttttctgtggtcacacgctggagcactgccacttttgaagcatatatttatatttatatggatgtctatcctagttgattaccaggcattttaaagatgctacgtttgtgtacttatctagatgggtaatttcattcatcatgtatttgcatttgttgtcaggtgcgtgtgacaaatttggcggatgcttctgagcacattggtgaagttctgagacgtgtaaaaaaggagcatcttaaaagagcttacaaaattgaagactggtatgcttcttttaacatttagtttatggtttcattttaacaattgttctatatagatatgaacataacgcttattatttccacacaatgcgttccctattggataagtatgttagtatttgggtaacttttcttttctcataaatctgaacattaagacttggcattttttatgacactattctgttagtttactcatagcatatttgctctcttttgataaagtatatccatgaagaggatgcgcttgcttgtagttagccttgtgatgctgttgtgcatggaaacaattaaaccattggagacagcacatatcttatgttggatatgttatctttctgcagggttgatgataatgattttcttgtccaactgagcaagaccactggaaagctactcagggtatggctttagcatatatgttgacatgttgtcagtcatgtttctatcaaatatattattcttgtggtgaggctttatgagattggggaattggagaattgtaattgtatactgatttacagtgttttacaaattttaacaatataatgtgtcaataagatgggttaattggatccatgccattctaaatatatgaacagcttaaattaaccatctatagaagattctgagcaaaaaaaaactatctttagaagattaaccaacaatttctgatggtgcttacacttgtggttcacagggtggggagcctgatcttacaacaacggccaagatgatgcttcatgactggcagaggggcaagattcccttttttgtgc

SEQ ID NO: 15704 - DNA, 340 bp, Oryza sativa
ggaaacagaactatgcaactaacctgaataacaatcaatgcgtgatgcaatggagcacttgttcgccagatatctagccattctgcctttgttcttggttgaagcacggccaatgaaggatgagtggaatataaggccatactttggcgtattccccctagttttcaatgccctgggagaaagtaaagaagcataagaagttgacgtatactctatgatcagtactttgaaacaactttccatacagttacttggaatttgagagctaccaagaaatcagtcagttttaacaacctgaaaagtgccttttcagcaccaagtatctggagagtggaggcag

SEQ ID NO: 15705 - DNA, 6587 bp, Oryza sativa
  unsure (1)..(6587): unsure at all n locations
aaatttctaattaaactggcaatacgactaagaattgtttatgaaaaaataatatcatttatgtaggtttcagacggttttcatccaagaaaaatgttttgatgctctgaaaggggaaaaaaggaatgtgtttctttaagacacagtacaagcatagacaattataaaacacgcaccctcactcttataaacatacacacaaacaccctacctgtatgagtgcctccagaagactagaccgctatcaacgggtgtgtcgcttaccgctgaaagaaaaattagccgtaaatgcgagcacccgtgtcagtcgtaagtctaagacttgaattcggatgagatggttccaccacaaggaacctaaccagctaaactatgtccacttcatggaaatgtgtttttttaagaattaaaaggaacttttaatagttcaaagcgcttggcatgtacaagttcacgatttggaagatcataagtgccacatttcaaattgtgaagtttaatttgcaaatttcagaaccatcctcgttaccttgtcttggtgggttaatcatgacatacatggcgcaaggaaatcttttacaagaactatttgaaacttcatagttatatactgtcggataaatacacacaatgtttaatattgtcgtgacatttcaatccttttgaagtggccaatgaaatggatgcgggaacacacactaaatttttagaagtatctaagttcttgaagtttttctcattctggtttagatcgcaactttcttaaagttaaaataagttaagctagggctgaaaggctcgatcatcgctcaaaaatagcaatttttgctaggcaacctctattgtagttgcatgggacttattctatgctttattttctcacacattttcaaagctgtgtatacccggcttggatctcctggagtgggctcaactgactaggtggattttagtaatcttagacattggttctatattatggtaagcatcatgtttgctacaaccgtttcatccacttagctcttcgtaaaaatcatcttctttagcggggtcaataataacccaatcatcaagccgggcggtgccaactcaacatagaacattaattgggtgacaccatgccaaagagaaaccatggtggtcaggcctaggcctagagcatgaaggagattagtagtgcaggaccgcatacagaagtctccatggacatctcgattgatcacgattaggtaggctagctgctagtcatcactgaaaactattggaagtcccattctttttagcaacaaaatatatatatcatctcaacttgtctcttgcatcaaatccattggctcgcacagtactatggcgctatggcaattggcaacactagatccatggggttgccttttggtttggcaaccaatgcttgggcctcagagtgtcttgcttggacggtttggagacttttgaggcgctctagggcaggacgattcaaggtgcagagattggtgatataaggacggagatgaatgatacgagaaaggagatgaatgatgtgaaattgtggaacaatcaagtttgtgtgaaaagaagtgacaattaagatccgctgaaatccatctcgtggagttaaggccaactctagatgatccggacctatgtatactactaaaaaatcgaacacgaataagtagggtctcaacatgagcccttaccttttgtgctagcatagttgccaaaattaagaatccagacgatgcatatcattcagtcaatgtttaatgcatatcccatattaaacaagtttcatggttctcaatgtgtgcgttattcataggaattaaaagaggaacttcaaaattggaacatagcatggcacaatcaatttaaaaaatgaggtcgttggacaaagtcatgcaccgatagaggctgtggctcatgcaatcttactagcaaaggtgagacgaataacatgaacacggtagcgtcgataaagagaatgctagagtgttagcaagcccaatcctgtcaatttagtggcctggagcgaagctagaaaaatgggccctctaatacaactatagtaatgtgcattttgggcaacatgatttcactctaaatttagaaataagcaagtgatttatgaaaattatgtcatactagattcaattcaacgttataataaaaatgagtgctggtaaattaccaagatgagaactagagaaaatgactattcactgtcctagttgcacagctgcaccgcaaggatccctaaatcctaaatcaaaatttcagaaattagaagaggagcaattgggagtaacattttgcatcccaaaatttaaacacataaacttagcatacatcaaaggggagagcaattgggtacctcctagtctcctagaattgaacagagagatcggatttttgcatccggctgccagttgcagttttgccgccgagcacgacgccgtagacatgtagccgcgcgcagtcgtcgacgtagcattgcgtagctgagacgcggctggaagggcggcgaatagccgaacaggcgactgcgagcgaaggcgaagcaatcggacggaatcacggaaggaagccaaatcgacacaatttttttttctgtacgtgtgcctcttcatctactgagctagtgggcttcctaattcctataggctattatgttagcatatatggggttgggcccccatcacttcgcgggccctgtgtggaggcccagctcgaccccctagggctgggcctgagtgttagctcagaagtcccacgaaatagaatgtgacatgagcgaatggtggtggcttggtggaagtcgacgaggagataataatgatgggaggttttggcgaatggcaggcgggtaattttctcttaatttaatgggcacttccatatttcattcgcttaattcttttggggaaggcaaataccacaccacatgccttgtgtaaaaggatggacagactcttgttgatattactggggaaaccgtgtaacaaatactcatttggtagaattcatcttgaaatttgttaaaatcacccaattgaagagacaaaatagtgggccgttcattagtttagatgaaaaatctggactcttgagtaaaattcgcatagttgcatgaccggatttaatgtgagaacgaaaaatcccgcgtccccccaacgaacccaagcgctagagagagggaaaaaaaacctctcgccgtcgcatgcactcccggttcgctttccctgctcccctctcttctcctctcgcgtcgtgctcgtgcctgcccccttcccagttccctccctttggcttggtttctctcaccaaatgccaaagccaccatgccttctctactactactactactactacccctccccaccacaacatcccgcaggcccccctgcccaccgcctctttttccctcctctccgncccccccttttctccccccctccgctccccaaaacctaaccataatctccacgcctccctacccgccgccgcccgccgttgcgggggctcgactccaccctccgccgcggtccctcccgggggacctcgcgtgcgcccgcggccgccggctcctcctggttctccctcttcctgcttgcgtctctgcgcgcgtgggggcgggggcacggtagggtttcgggatggacccgcggcgccctccgtcgcgcgggggcgccgccgccaacggcggcgggctctcctactccaccctcttcaacctcgaggtactgcctgctctctctctctctccctctctgtatgtgcgtgcttcggtggatggtggttttgacgcgcgcggtagtgccggtgttggagtggggggcgcgttgtgattggggtgggtattggtagtgctcattgtcgctgggttttggagaattctctccgggcgctgtatcatcacttggttgtttttttaagcctcagttcgatcgaggttttagttgtgtctcgcgggattgggagctcgttagttgtgggctaatgcaggttactttgcatcggtgttgcgatcgtctgtagaagccgatgccccgtgctactgttctgttggttaggactcaaataagtgtgtgccacataagtgttatgctgtttagcagtatctagttgtttcctgagactggttcagtagtttgctagatcttcatgtagacttgggctactttagtggcttccaccgatcaaagtttcgtgtgtttcagatagtgacagagtgatacgagtatcgtgatcatctgttgtgccattcatgtcgctaatcaaatgttgatgccggtaacttggtcgttatattcatgcaacatttccaatatcgcatgcgcgacgatgatgaccttgttttgttgcgattgcatgccatttcttttttctgaatttagttaatgctatgtttcgttcatagatgagtattgtcagttgctggcatcatctgtgtatgttcctgtgttgtctgttgtgattgtggtctgcatggcgtgcaacatgctgctgcactgttatcattgttctggcagttttgttgttttttttatcgctgttcttttattatttttcttgataagtatggtcatgcataataaagttttttttcttgacatgtgtgatccttgcttcgggtttaaatttattttatttgataaggttatgaattgggggcctgcaagggtacattggtttactacgtaatcgcatcttttatcttgtcatcctttgtttttgatactactatagtgttattgttgcttgtctatccgtttggtctatatggatgcaggtctctttatttgtctttggtagggttgaaaattatatatagattttgtcattgtgaagcatatgtcttcccactcatgttaataatatggtttactttagttgaatttacctccattctgatgtcaagtttttacatgaactgctgatgcagcctttgctgaactttaaggtccccttgccggaagatcttgatcgctataggcgtagtagcccaaatgggagtatgagtagccaaggtaaaggctatttaaaaaaatccacctcctagcattgacactccatcaaattgtggtcttgccatttctttacatatatctacttctgtgtttgttctgcttaccctacttttccttttaggtcaagggtccttgtcagaccagtataatggaattaatgatgcttcccatgggctacatcggaagcgcaaaaggaatctggatggtgctagcgatgatgatgaggtagatgcctacagtaaccaaataactgaggagcactaccgtacaatgctgagtgaacacgttcagaagtacagaaggtcaaagtttaaggaggatgtttttagttctgatcctcctcaggtgatagttcctcagaaacacaaaaatggtagtgcaagagttacaaagtacagaagtgatacaaggaatgttgcaatgttgggtggggtagaagccacagctgagtataatgggacaaaatctactaatgcatatggtggtttcaataaggttgtagcttcactggattcttcctatttagatatgggagataatgtaagctacaaaatcccagaagggtatgataagttggcactatcccttaatctacctgttttttctgacatacgtgtcgaggaaactttcttgaatggcacactagatttacgcactctagcggcaatgctcagtacggaccaaaaatttgagacaaccaatcgtggtggattagctgaacctcagccacaatatgaatcactccaggaaagggtaaaggtgcagaaattttctcttcaagtaactgaggatcccttcgcaattccagaaggagcagctgggaggatacggagatttattatttcggaatccggcagtttgcatgttcattacgttaaagtcttggaaaaaggagatacatatgaggttggttggacctgttcaaatattgatagcatgcttttgttttctatatacttagcagttaacctataaatgcagattatcgagcgtagtttgccaaagaagcaaataataagaaaggatccttctgaaattgcaagagaagagtcagaaaagactattaaactttggcatgctattgctgttaaaggcattcctaggcaccacaggaatttcatggctttgctgaagaaacggcaagtagatgctaagcgtttttctgagaattgccaacgggaggtattgcacttctctatcttgttggctattttgtagtttggttcactctagtttttgatcttgctgagttaatagcaatgctgcagctttattgagttttgtgtttaaaatgtccaggtaaagttcaaagtaagcaggtcactgaaattgatgaggagtgccgccatacgtacacggaggctggctagggatatgttgatattttggaagcgagttgacaaggagcaggttttttttaatctcttaagcttattgttttttagttccactgaaaccaaattcggaattattgccttttattttttttctaaacaacagtatatggggctgaatactatttaaatacttaaacttatgagttgtatatggctatgt

SEQ ID NO: 15706 - DNA, 16931 bp, Oryza sativa
  unsure (1)..(16931): unsure at all n locations
agacataatcttatgtcccatcgaactcctaggttaggttttttttttacggaaggagtacctaaacatatatctatattaggatatgtcacattgatactgatacgttttttatgggatggatggagtactaaaccatttgctaggggcataatacagggatacaggaggaccacgtgaagtttccaagtgattaatgcactgtggatagacaaggatctgtctgaagaaaccagcacggatggatcaggacaggaagagggccatcaccttccccatgaattcatatcaaatcaaaggcttcacatcataaccaccaagtccagttgagataagctcaagaaactatcaagaggagaatatagttatcttaatctaggtagcaaaagcatatggagtagcagtaatcaagagaacatcaactgcatcagctgagagtttttgagctgcaggtcaagtttccagctgcaaaaatctgatgaacacttgacataacagtattgtcacagagcctaccttattcttttggataactatccaatgctgcctgcatcattgactggttcttcacatgaggcagtgaccctattgttagtggagtcaacaagataacaagggtaatatatagtttaccatgacttaaaaaggaaatcctacttaattaacgagagattcagggcacagcacaagtggtctggcaaatcatttagacgccagtggtcaatactatacaagaaccaataacatgccatagcacaacagcgcaactgttcttgggaaactttgtataaaaatcaattcatgcctatacattgagaaatcagtatgaagatggcattttttttttcaaatagacaggtttaagagaaaacaggattgtaagcagttcaattcaaccttataaaacgcacaggcaaatagtaatcaggcagaatatgccaacatggatgacacaaggacacaacctagcattaactagtacttatttaactgaaatttcaggcaacttgcttctatattatatcatcatgcttgctaccattgatcccttgagatttacagctaaaaaaacgtcttaatgacagttgacagaagtatattctgctgtagaacattaagtaatacaacattaagaaaataaccttctctagctatctaaacaagtatcatactatcgttaaccttttatgtaaacagaatagtaaaagaagtatctgatatgaagctgtggaaggatatacttgcaaggaaaagcattccgtggtgatcataacaagccatacattacagattggacgataagatgccatgcataacacccattttatgagcattttcgattaaacagtcttgaggactccaaccagattaccaggctaatctaacgagagctagagcttgatgatcggaaaggccataggaacgagaacggattccttcttctttgacgtccattggttctcccattgctacttgaactctgactttggttggttgatcttgtgcgcgagcagctagcaccagtagagctctgtggtggcaactcatatcggcaaacagggcaggaattgtgctgttccagccaaggaactatgcaatcagagtggtataaatgcttgcatggcatctcccttgcttctgatcccagctcaaacttgtccttgcagacagggcaatgtgagtctccactgagatgcctctgtgtaatcttcacagtaggcatagcatcaatcgatgattgagtggcaggtggcggccctcgtcgatcattctgagttaattgctcaatcagatcatccagtccaggtccaacaaagtagtctgcaatgtttgctctgcgcatgccaacaccacggcgtccattgatgaatacatcaaaaccattgtcttctgagagatgaccaggaagctggccacggaagagcaaccatggccctgagccaaactccatctccaggtcagaaaatatgtttggccttcctctcacatcaacttcccggttcgttcccgccatgccatgcctcatcacagcagagattgcctccatgataccgaatcttggatcacgatggaaatcaggatccatcccaacaaagtggcgcatgagagcatcaacatcatccatttcagacacaaaaccggaatcacaatagggacactccatatcctggccgcggggcctcacccgctgtctacattggtagcaccagtatgattgcctacctcctgacatttcttccaatcaacgtactgcttccccaaaatccaaaggtgtggtatacctcctccgcactgcaaaaaatggcacaatttctaacatatcagggcaacagctccactagtaatgttacataagcatatcattccaatgcaacttacaaaatccaacaagactgaatacatgaagtttcacaatggtaccaaggcatatagacaagtcaaaaaggcacacagatgggcacctaccatccagtaccagtccaaatcactgaactgtcaaggattacttagaattattcatcaattatcacaaatccgcctaatcgaagtaataattcgctcatgaatgataaagcgattgtttccgaagatataaatttttcgcatgacatttgttaatgaataatcctcctaattaagacatactgcaacatgggaaatttatacatgatccaaactgatgatctttgcctgatctttgcttttttcagataggaattcttgaactcgcaacttctttcagacacatcaggtttccctcttatagagccagggatagtttgtctcacagactaatactagatacttatgttcggttcataggctgcctcacactgatttattcccaaaaaaaaaaaagaaatcaaactggatcaattacactagatgctgcaaccaggctaaaatccaagaacaggctaaattcccactcgcccgtagatcaatcagttcatggtaagactaaaaactctacaacagccaccttttccacacgattcactccattcaaaatgaaaaaaaaaaagaaaaagaaagaaaagaaaactgattgcagataactcccaagattacgcggcccgagcaaacaaattgaatagaaaaaaaacacgcacacgaatagcggtttccgctggttcgattacgataccagataggagaggaggaggcggcggcggtttgtggtggcgaggagcggtgggaggaccggaagaggggaaggcgagatgaactccaccacgaacacacgaacagaaaaggcgaaaaaataatattggaagaagaggaggggatggatccagagagaccatattttatacccactcgagtcgccgagagccccactctcctccccttctcagtgctgcggtggcgcccacgctgtcctcccgggcccacatggcagtggcgtcaggggggaggtgggccccacaggcctcgattcctgagccgcgtcgtccccctcgctttccgccgcgagaaagatgcctcctcgccccgtagcccacggcctgcccggggccagcgcagtgactggcatgtggggccagagtgcgcttcgggcccacgtgtcagtgtgggctttggacatggtgggggtgggattttgcgtcggggacgatgtggagcgggggaattttaaaatattcggagccacggaatacgaggctagatcggccgtcggtgggaggaatggacggcccggatgggatgtcccgtcacgtggttgcctcgtcaagctgtcgagggcggccatttcggtcctcaccgagaaatcggtccgggcaatcgcgcaaatgggaaaaaccgaacttatctaaaaaaccatgttccggttaaccgaaccgcagtttgatcttcggtctaaaccaagctgaccgcgcagtggcactgtggcagatctcgcattggggtgaatctcctctgcggtattaacctctgacttgggtcaatgacacgtgggcctaatgagcatgggtctatatgtcagtcactcaaagtcaaaggatagtactgcaaatgatatgtttcccttgcattggaccaactgcggtcttattcggccatccgggtaaccaataaataagagctaagaaccgagaatttgattggtcttctcacagctaagaccgaacaggagaccagtgactaatttatctgttttttttaatcgtgatacggttttttcattgtcggtcttcggtcttgatttttttttgtccacccttagtagggagtagggtgtccaagtcctatttggtggcttttaaaaagtatcgcttctcaaacaattcaattcagtttgtcacaatgagtccaaattaaagcaaagacaagtgtcaatttcatcggggtctttaaatatctttgtttttatagttatttttaatatctaaaattgtaaaatatgttttttataacaattatatatcagttttaaatttaagtcattctcttgtaaaaatggaaataaggccggcaaccaaaatgtaattttaaattcaaaattaagatatatagcttttaggataaaggtatgccaaaagccggctctaaatatcaacgttctcaattttttttagataatcaacgttctcaattcttgcaacatttttgttataattgaaattgtcgacgggggttaccagtagaccggatatagagggtattggggtacgctggtacgaggatctacgtaatacgacatcgagtaggcagaaaacaaagattatactggttcaggccccttgataggtaatagccataatccagttgatatgggattatatgatggaaaccacagattacaaagggaatagtggaactcgacgataccgacgagatcgtagtcgagttgattcgactagatcacccggcgacttggctcctgtaggctccggcttcgtaggctgtggtggatgtgttggcggtaagattcgatgcccaaggtcctccccggggggtcccttttgtaccacaggtcaactggtctccaagtaagactcggagacatcggacccgatacgatacaatgacgacccagttctatccgagtaggactccttccatctgtgaactccataatgaatttccttaacgtatgccgaaaacgtccgtatacgcgcaagtataccatatcaatatgtgacgtatatcgaagggtaaagggtataccttacccgtaaccctgacagtagcccccgacttctgcttatatgaactcgtgaaaccgatcgcgacttctgatgtcgaagttgtcgtcgttctcggtgtgaggactgagagacaaggagtgatcgacaacgccaggtgaagctcaacggtcatgagtgaatttaaattgaagtccgaaaaactgccgcgcgtaacggacccagaaatttccgacggccatctctctcctttccttggaattcgcaccgtcggaagtgcgtctatttaagggagttttggggatccaatttgaagtccgcctgttgtgaaaaaactctccagcccccaagcgtccctcgtcttctccgctcccgcaaaaaaccctagctagctcatctcggtcctttctccggcgatccccggcggcaatggatctcgacaagtctacctccaccagcacgtcgctaaagaagttgcaggaggatggcgcccttcccggtcgcgggaccgcggagagagaagtaggaggtactgaaccccaacctgtcctaggtcgcatggttgtgatcgaggactttattctctgtggttttcttcctccgccttctgaatttcttctcttggtcttgaatttctacagtctttccttgctccatttgaaccccaattccatcgccttcatgagtatcttttcgcatctttgtgaggcctacattggggtagagccgtttcttgacctcttccgcttttactatgagttgagttggatggaacccaaaaaggtgtctggatgtgtcggtttccgacttcgggatggcctgaagtcgcgatacatcctcttccagtgcccctcatctcgcagcaaatggcgggggaggtggttctatcttcagatagaagattcggatccggtttttattgttcctgaggagcaactagacaagatttcatcttggaccgccaaactcgccttgaccccatccctccaatctttcatcgatatcattgatgacctccgagtacggggattgtcggggtatgaagtcgctgccgacttcattggtaggcggatctagccgctccaggctcgagcccatccagcctttgattattctgggccggaggacgcgacccgggtttctcctcggggtatttttctttttagttaaattggctcccttatgtgcgtgttcttcccgacttatcggattctggtctcgatctacaggcttggacagcgcaaccgtggagcgccgtgtcggccaactgatgatcactggcccgacaacggcgagcaacgtccaagtccccctttgcgagaaaggggcagccgagcgcgacgttgccatcaatgtaagtgtactcagcggtccttttgcatttttcttccgggatcgcattatgacttcatgaagcgtaggctctccctctgactgatatcatcgggccgctcgtggaccatcaggtggcggcgtcgctgaagaagaaagtcgccaaggaggtgtctgacgctgttgctgctgctgccacaacgagtggcggcaacgttctgaaaaaggggaggaaattctcttctgtggtcggacatcgtcggaagacacccaccccctcggtaagttctcctgttctttcatcacgtagtcagaaaacttccacctcacatcatatccgttatactccaggcctcggacgcgtctcccccgcctccacgtcggcaacggctagtgacgcttggcgagaagcaagtggatgactttgaggttttgtcacttcgtcaaactgttgcagcctgtctcagttgcagcttttcgcagggcggcgtgggcgaaggcggcgcaagacgggtctggagggacctccagcgcgtctcctatcgtggcctcgacggatgtcgtggtcgtgcccaggagccgcgaggcaacacctagcggcccagctagcaatctcgccactggtcgaggtctgccggctgccatcctcacctgggaggagctccaggttgagatggggtgcctccttgaggctggtgctcgcggcattagccgcgagatcgcggaggcgagggcggcggcggcggcgtcggcgaatgagcgcgccgaccggctggcgcatgatttggcggaggttcgcgaggacctccagaagatgcgggagctggtggccggcaataagcgacaacggcagggactcgagcaccgcatgtcggagcgcgagaacaacttgtcggaaatccgtggctcgttgcgagtcacctatactggtctgcaccagctcgccggggagtgcggtatcaagtctaccatcccggcgaatcccgatgagttctcgccgacgacttctcttgcggagctggcgacggcgatggaggagatcccctccaagcacgcggctaggattggagaggagacgtccaacgggatctataccggggcgtgccatgtccttgcgtgtgtgagactggcgcaccctaaactcgatctgcggaaaatcttggatcagggggcggctagcgacgcgcgcaaggatgtgatggaagaagtcggcgatctgggggagtctgttctcccactttttgaagagtaggattttgactctcttgtactccttagtcatgctttgtaaaactttcattggttccaaccgcctttgtgtatgcagtcatcgccttagctttctttagcattttgatcttgagtactttgttgtcgtctgtagagatgttgatgtcgaggatgtccagcagcgcgggcagcctgagttgccagtgatcgttccggcacttgcgttcgagccacatgtgccggagggcgatgtagctcaaaattcgcctgtggaaacgagcatggcgacgactcccttaggttggttatctttgttttcatctcctttactcttccgtctggatcgacttgatttgttgtattctcgtgagagaagagcagtttgacttagtcgtttccatgctgagcagacctcgagagtgcgcttgctgaccaggatcgtcgcatccagtattggaggacgaagtttgaggtcgcggaactcgagaggactatgctggaagtgaagaaggaccaggccgtggagacactccggggccgcgaggtgtggttcaactcgtatctgaagagtttctgcacctccatgtcaagggtctgtagagagctccgggtaccccgtggggatcccgagaaatcggcgactggatacatcccgtggctgaatggggcctgcgcccagcttgagggcatcagccagcgtatcgacgaggccctgaagcaggagtgtcgtcgatcgagccaatatgccgggggcatgtattggcctgtatatgagatcatcgtccgcagctgcacctcgagttcctccatgaagggttttctcgttctcggagaactcctacggagatagatggcctggcgaagtcgatggcgccgctggcggaaaaggtcttccagtctatggactagcattggccttcctggtagtctccgtgtcctatgacaaatgtcctaggggaagagtgtaatataattttggatttttatagaattgtaagaagtacttgtgaaatagaaaagaaatctatccaactaagctttcttactctggatgtattgtgtatgagtgtcttctcacttcgcgacttcgattagtcgtttgagttatacactctccctagcccccagcattgtcatcggagaattcttctcggaagataaggctcttggacctttgacctgcctcggttgaacaagcactgatcctagcccccagccgtgaagttggaaagtttatttccgattacacggcttggttaatacgcatggcgagaactcttacacgaccagatcttacatggtcttttgtctctacaggatccgacaaggtcttatcggctctgggcggccccagctgaagttcccttaggttcctcggaggccttgttaagacagcgtaaagggacatgagggtaggtttcaacgctaggtgtcatctaggtaagggatcatcgggaaggaacactttgattttggtctggacctgaaaaataggctttattgaagctgtaagatgtcttacaagtatggatactattgacttatacatagaatttacgtaattgatgaatgttccaggaatttgccaactcgcgacaatcgccatctgcaattttgaatgcgcctggccgcagaacttgtgtgatcgtgtacggtccttcccatttgggtgagagcttgtttcgccctgcttggctttgaacacgtcggaggacgtagtcgccgatcgaaagcgtgcgtgctcggatgcgcttctcgtggtaacggtgaagggcctgttggtagctggctgctcgaacggtaactcgttcgcgatgttcctcaaacagattcacatcgtcatttcgctgctcctcctgatcctcatcggaatatttctgtactcgtgtactttgatgtcgtagctcggtggggagcatggcctctgagccgtacacaaggaagaagggtgtctccttgttggatgttgtcggtgtggtacgcacggcccatagtactgatggaagttcttcgtcctacttcttgtcatgtgacatgagcttgtcatagacgcgggtcttgattccttgtagtactatgccgtttgccctctcgacttgtccattgctctgagggtgagaaaccgaggcgaagcagatcttgactcccagcctgatgcagtaatcctagaaaacggcactgatgaactgggagccgttgttcgttatgatacggtggggcaatccgaatctgcagaatatccctttgatgaattgatggcgttgtcggccttgatttcccccgtgggtgtcgcttcaatccacttagtgaatttgtcgatcgccacgaataggaacctgtagccgtcctgtcctcgtgggaatggcccgagtatatctagcccccagcacgagaacggccaagtgagagggatagtcttgagtgcttgcgctggtagccttgtgtgtttactgtgaaattgacaggcttcacaccgctgaaccatgtcgcaggagtctttgagggcggttggccagaagaacccttgtcgaaaagcttttccgactaatgtccgaccgggcggcatgtgacccacagatcccttcatgtatgtcgaggaggagatgtctgccgtcgtcggacgagacgcattttaggagtaccccatttgatgccttcttgtatagatcattgccgatcatatagtagacctttgctttacaggatattttctcagcttctgcgtcgtcctcgggcaactctttgctgcctatgaatttgatgagtggggtgcgccagtcgtctgtggtctcgatatcggcaacgacgcgctctaccatgtagccccgagctgttgttgagggagaccgggctatcttcaccgcttgcgtctttcactgatggccttgcaggacgtctaaaaggtgcaggttcgagtggctctcgtctggacgcacgccgtgctatatcatctggttcaatggtgtccttgcggtatacatgtcggacctcgatcccatcgaaccttttttctagctttctgacttctgcgagatacttggataatgtcacgcccagaaattcccgaatagaattccaagcagaatgtgcattaaactccccgtccaggaccagccggggtacacaaacgacaatgttgacattcagatccacgtcttacaaacatcataaaagtcttacagaaatgcagcggaaaacaaaagaaactggagctaagccttgactaaactgcagcgggaacaccactccacaggcatcctcgacggcacggacgaagcctactcctcggggaaaccttcatctgacacatacccgtcctctggggttgggaaaagtagagcaagactgagtactacccactgtactcagcaagtcataccggaataggggtatgatgcagggaattaacaaagaagagctaaagtggttcatttgcataaatactggcatttataaacaggaatttaatgcgaaaacagttgtaataattaagcagtattaaacatccgctgtccaacgctaacccacgttgcgacaggcccaaccttccacctaaactatccaagttcaacaaattacactagggtgagactaatcacggtgaatctggttgaccgcccataaccgcgggcacggctattcgaatagttttactctgatcagaggtgtacaactgtacccacaggacacagccccacgacacgtttccgtgcgccgacatgccaccacgacataccggaaagaggccgtgacaggacccttcacataaccccctctaaccaagcacaccacacctcaggtttcacccccactgctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttaattaaccaacaccaaagccggtgccgctaatccaacattatcataaaaacctatagtctaggttttaaatgagatctccccattgtgtgctagttgaactaagcatggctaagcaaaccctagtcctaactctaatcatgttataacccaagctaacaaaggagcatggtatcaaaataacatggctgtaacaaaaggtaaccatcccatagtataattgcaaaacaaatgcgatatttgaaagaaaacattaggacatttgcaatataggatcaatatgatcaagtgacaagcatgacttgccttgctctgctgctggaggaacctcggcgactatctcgaagtacaccggagcgtcgaaagaaccggaatctagcgacatacaaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaaaaccttaaatcatttattgcgcaatattaaccagggctgacgtcagcacggaggggtgcggcgccgacatgcgggacccaccggtcagcgacccgggagagagagaaaggggcggcggctcgcgggcccactgtcagcggcacgggagatggaaggggcggcggctccacgtggcggccgaaccgacggccccgatctacccaagggtagatcggacggcggtgggagctcgcggccgggcgcgcgggcacggcgcaagccgaaccggcgaccatggcgccggcggcgcagcgctcacgcggcggcggtgcgcatgcggcagcggcgcaaggcgacggccgacggcgaccgaccggcggcggagagcggcggctagaggaggagcggcggctacgcagctaggcggcgacgcggcggctaaacggtgcgggagagagagaaaacgaggaggagggcctcaccgacaacggtcgacgacggcgggcgacggaggacgatggcgacggcgggacgagctccggaacctcctaacgaacaaaaggagagggattagagggagaggaaagagcgcgagagagcgagagcgccggccgaaggccgcggccatggcgtcactcaccggcgcacgacggggacgggtctccggcggcgaacctcaacggggaagaggcggccgaggtagatctcgaccccgcgaatctaacggcggcgacggcgcaagacggcggcgagcctagcggcggctagcggcggccgaagtagcaaaaacggcggcggcgggtggttgcaaggcgcggggacgattgggagctcgggaggggtcggcgaaatggggaaaaagcgagagggggtgccggcgatgcttaaataggggaagagagggccggacgtggccggaagaggcgggattcgccggccgacgtgggggagtggggaggaaagagaggcgggattcggttttcgaatcccggccatctcgggcgcgggcgcgagcgggagagagaggggaacgggcgcgggaaacgcggcgcacgcgcgggcgtggtcgacgtggcccggggaaggcggagacgtgggcgcggcggcggtttcgggcgcggcggcgcgccgggatcggcgggaggagggagacgggcccgacaggtgggccccacctgtcggcgaccccgagaggagggaggcgggcagccggctaccgggctgggcctcggcctgcggccggcccaacagagaggggggggaaggaaaagggaaatgggccgacggcccatttgacaagaaggaggaaaaagagaggaaaaaagaaaaagaaaaagaaaaaggattttccctggaattaacaatattgcttgctcaattttaattggttaaaattatttctagagctctgaaaattccactaaaaatcctgttaatgaattttgacatgtagaactcaagaaaaattccacatgtccaatccgattattatttgcattactttattagggttttctcctgatttcacctgcattttcttggggtcatttgtaaattcaatttttggcttgggaggaaaacttcggggtgtgacagataactcggggttagagcacttgtaatctttatgcacctggttcgtgactagttcggaatctcctttcatgattagtcgcctgactccgagtgcagctgcagctcttatcccggcgagtagtccttcgtactcggctgtgttattagtcgccctgaagttgaggtgaattgcatgcttgaattgatctcctaaaggtgatgtcaagatgaatcttgccccctgctccttggctattgagtgcgccgtcgaacgccattgtccacgtttcgttgtctatttggttgtctgacctgttatcaggcatagtccaatcggctacaaagtcggcaagtacctgggacttgatgactgttcgtggcacaaagtggacatcaaactggcttagctcgactacccatttcgtaatgcggccgacaacgtctttgtttctcactacttcaccgagagggaaggaggatacaactgtgaccctgtgggcttgaaagtagtggcgtagctttcttaatgtcatgattaccgcgtagagcagtttttggatctgttgatatcttgtctttgcgtcgtggagagcttcgctgacatagtagactggtcgttgcaccttctctctctcgacaacaatgacagtgctaatgaaatatggcgtggcggcaatatagagaaataattcttcaataggttagggggcaacaagtacaggtggatttgataggtagcgcttgagtgcaatgaatgcctcttcggctttctgtgtccatacaaatttgtcttgctttttcagcagagcgaagaaaggttgtcctcgctctcccatcctagcgacgaacctgcttagtgccgccatgcatccggttagcttctgtacttccttgagtcttgtaggcgacttcatgttctcgattgccttgatcttctcgggatttgcttctattcctctgccagagccgaggaagccgagcagcttgcctgatggtactctgaacgtgcacttctctggattgagcatgaggcgatatcgtcggaggctgtcaaacgtttcccgcaaatcatcaatcaatgagtcgcttgacttggtcttgacaacaatgtcgtcgacgtaggcctcgacattgtttccgagttggtcgctaagtgagccctggaccgtgcgctggaaagtgtttcctgcggttattagtccgaacggcatcttaacgtagcagaatactccgaacggcgtgatgaatgctgtcttctcctcgtcctctttcgccatactgatttggtggtagccggagtaagcgtcgagaaagctcaacaactcacaaccggctgttgagtccaccagttggtctattcgaggaagagggaagtgatccttgggacacgccttgttgaggtcggtgaaatcgacacacattctccatttctcgttggcgttccgcaccatgacagggttggctagccactctggatggagtacctctctgatgaagccaactttgagaagcttgtcgagctcttctcgtatggcttgttttcgatctagtgcaaatctccgcagtttttgctttactggcttggcgtcgggtcgcaccatgagtttgtgctcaatcacctccctgggtacccccggcatgtcggacggctgccaaacgaacacgtcagcattgtcgtggaggaaggtgatgagcgcgagttcctatttttggcctagtaatgccccgatcttgacggtcttgtcggggttggcactggagagtggaaagattttgattgcgccatccggtttcagtgtcttgtttgttttgctcactttcttgggtggctcagctgtggcgggtgggctgggtgtgtgcttgaccatgttgaggctccgcttgtcgcattgcactaccaacttagcattcccttgaatagtgattgttcccttcggtcccggcatcttgagcacttgatacgctagtgagatgcgaccatgaacttcgcgagtgcagttctcctaatgatggcattgtatgctgcatcgaattcagcgacatcaaagttgatctgttccgttcggaacttatttgcttggccgaaagtcacaggcaatgtaattttacccaatggtttggacgatgactggggtgtgattccatggaagggttgatcggtgggtgtcaactcgcttcgtgggatccccattgtatccaaggtgctggcgaagagaaggttgattgagttgctggccgcaatcagaacccgggcgaccttgatattccgaatagtgggttcgaccacgatcggatatcgccctgggatgacagcagtcttgaggtggtcctcttcagagaattctatcttctgctcagactacttcatcttgggcgcagctccctgccacgtcgaacagacttcacgttccaccttcttatattctcgcttgaggagtatgtcgtggaacctccaaagatgtgcgagacatggagatcagagtctgggtatgctgagtccgattctagagtagccgcttcagcgtccttctcgaccacatgcactcgcttgcctttttccaatgccatgtgtattgcgagcgacttttttgaagacgaggcaatcttatagagagtgtctatctgacttgtgtatagggcaccatgttttcttcgtgtcgctgtcttgtgggtctacgcgcttgggagagtccgcgtattctgttgtgagaacatccgcttgagcttaacttttcctactcttgcaattttacttcttgctcgactcaggtgcgtctttgactggtttcttctctcctccggtcttcggtttgtcgttcttgcgtctnnnnnnnnnnnnnnnnnnnnnnnntcgatcgacaattgctcccatcatatttcactattgctcctggtcagaatctttcaggccatcggacatctcgaagtgaacgaccgaaagctctacacccatcgctgggggcggtgggttgtcggcgatcgtacatccttcgtggatgtctatctgatgttgaggatgaggaag

SEQ ID NO: 15707 - DNA, 36028 bp, Oryza sativa
taaaaaagaccatttctagaataagttttttcagaggtatatttgtagaataaggttttcaaaaggaccattttatgaaaaatctagtgtgtcctactctctcagccttggaataaactaacctcgtattttaatttttcttttatcctagtagtatgtatcatatcctgtacttagtttatttacttttggatgaaggggatacgaatttgcacgagcaatatctcattacttaagctttgccgaataaaccaccaaaaagtaaaaataacaaattataaattataaataaacatgtttattactactagcatttggaagctaaggctgcaaaacagactacgatcaaaactccggaaatcaacactaaagtaaagttttaatttaaatcatataaccacatgttttattgcaactttttacaatctttgcatcatgcaactctgtgtgcacaagtagtatatttttcccaccaaagcttacaccaatgttaagctaatatcctacaacaacatacggggaatcatcaagttacagaataaaagctctatattttatctcaaagatcatgacaatgaagtaatatttataaacggggtgcgtatgcaattgagtataaatacaggggaataaacttttttctgtaaatagaaatagtagtaactttttttgagagaaaaagaaagagattactagtaactcattttattttattgaccattaactatttgtggttagaatgagaggcagtgacgccggtcatttactttctcgattctccgcgcgcgaccactgccttcacatgtaagggatgcatgcaaaaaaaaaaccccgttatttgatgcaggccactaacacatgtgaggtgaaagaaaaatagcagaaaagcccaataaaacatctcatgtttttcacctgaacattaaaagggaccttctactgtttttcctcaggtggatgatgatgatgatgcaaagatgatagtaccaacattttgcttggccaaactggcagagttgtaccttgaaaaaaaaaaagaaatcctcatttcttgtgctttaatctcactcacacttggaaagtgaggggcaggtacagtcaagtgtcctgcactccatgcctaattagcacaaagatggaagcaatcaatcatgaggagtactagtactacttgggttaagcttgagcaatgatgcttcccttggctatagtggcatcatccctgccctgacaatgacattgggacagagtgtcatgccaaaataattgataatttggtttcttcttttccacaagtgtggtctattagtattataattcgcctctcatgcaaaggtaaccagtactgtaggagtaaaatatagagtaagtaataacttttaaaacgaaattattataaatataaaaccctattatttatataatatgattttattcagtaaattgtccattctggttgtaccatctatgtgttctatatataggcttagctaggtcatttggatatctacttattttcttaatatttactccatattaaagccaacccttattatagtttgaaacgagtgattagtactagtcagctgtacttatacacacatttattagttaattaattgtgctacaatgaatgtgtggatggatagatggatgtgtgcatggagggagggagggagagtttttagattcccatctttttcagccactcaacaaggaaggaacagggagggaggaaccctaatcctacctgctctcaagctccatctccattccattcccttttttgtgtaggagcaatcataggtagtactagtatactggcattccccaaccattccttcctacaccaccaccacctatcaatcacccattcaccacctaaaaattcccaaagcacctgctccttctcctccttcctcctcacctacggcttttgtttcttggaatctttgcctctgccttcttttttgttcttgctccctccgactcctccttccagccaagaatccattgcagaattttcgtgctcaatttcggataaatgttgggtgttctgtttggtgggttgagagcttgaattcgagccgttttcttgcttcttcgagctggtggtggttttcttggcccttggattgattctgggattcagcggcggagacacctacctccgcgtgaggatttctgccatttcttgcttgctgcgtcgagggatttggtccccgccctgcttgcttccagctcagttcggtgccttgttggtgttcatcgatggattccggcatgggcggcgacgccatggagacattacggggaaattagctcggcccgtctctcggtcagtacggtgaaattcctccccctgttcttgcgattcttggcgttccgtttggtggaagatttgatggaaatggtggtggtaaatttcgtgaccgggtttttcttggcgcggttgcagcctgcagatttgagagattggaggagaggtgtggattaggagggggaatcgagcgaggaggaagatgtcgttcaggagcctgatccaggagatgagggacgagttcgggagcatctcgcggcacagcctgcggtcgcggtcccaccgcggcggcggcggcgcgccgcgggtggcggcggtggggccggcggaggcggcggcgatgcagcagagctgctgggcgcagctgccgcccgagctgctccgggaggtgctggtgaggatcgaggagtcggaggtgtggtggccgtcgcggagggacgtggtggcgtgcgccggcgtctgccggagctggagggggatcaccaaggagatcgtccgcgtcccggaggcgtccggcaagctcaccttccccatctcgctcaagcaggttcgcgctctcgtttcattctgaaattcccggttgcgatgtcgaactgttagtaatttgattgttcattgtgttgaagcttcattgtttaatctttaggaattatttgttcattgtgtcaacactttatgattgattggttagctgctgaattgcgttcgtcaagcggtgaaggatgaaagccctgcattctgttgcgctgttgcgtatgtcggctttgctctgatggattgcaagcagccaaatcatctttttaatggatgttgtgaaccatggcattctagtatgttttaatttttggaaggtgtctcccttatgtgatttatctagttttgggctagaaaacaaactgcatatcaagaaaatgtgatggatgcataaatgctatctgatgaagccgtttcccttttgattgcggtgcttcacatgtttagcatgatattccagtatcaaatgccatttctctgctgtcattttcgtagaaattgacgccacttcattgactgtaacctttggttgacaagttcattttagtgtcatcttagtcctaatttactcaagtctacgtgatgtgcagcctggcccaagagacggcactcttaaatgtttcataagaagaaaccggactactcagacatattatctgtatattgggctcacagaaggtatgctgtttatccacccctggtacgccaaattaagtacagctatgctggcgtataatggatatatgcttactattttcgggaagtttctttttacagcacttgccgatgatgggaagttcctacttgctgcacgcaaatgcaggaagcccacatgcacagactacctgatttcccttgacatgagtgatatgtcaaaggggagcaacacctatattggcaagctaaggtgatcttttgagatttcatcactgaaaagctaaagctaaatttgttcctagtttctttagtagtatgtgtaaggaaggccctttagatgtactataggctgtttcatataaaagcatcacatggcatttttccccctctccttttgctgtaagtgttagaatttggaaagtacaagaaattgaagtgctatgcatttcacatctaatctattcattcaacttagaacaaacctgtatgtatttggatgtcaagtgcataactcaaacttaatcttcagttatatcttttttttgtttgtttcttacagatctaaaaatatagcctacaataacaattaaaagaaccagctaaccacctttgttttaacaggtcaaactttctcggaacaaagtttaccgtctatgatgcccatccaccatatgatggagctgttgtctcaaaaagtcggtctgcacgtgtggttggtctgaaccaagtctccccgagagttcctgccgggaattacccagtttcacatatttcctacgaattgaatgttttgggtgcaaggtattgaatcagcacttgtgttatgccgagtaaatctatggatagtattggtaaatattgtcatcaacacctgagaccttaatatgtgaattcatcgatagttagaatcacagtggtgattactgcaattgcatgattgatcaattagacatgctgaatctattttttaagaaaaggctctaatgataaaagtggtgataacatcacaactccgtgagccttctggctgttatttgagcacacatggctaggaataattatatagagaaggcggctgaccagctgtcataattccatatacgcaaccttttcattgttgattgactttgcatgctagatttgactgcttctacaatacttcgtagaaaattgcagtgatttttgtgatgcattcctattgcagaggtccaagaaggatgaactgcattatggattccatccccacatcagctgttcaagagggtgggaaagctccgacacagactgaatttcctctcagtggcctcgactctttcccatcaatttcattcttcagatcaaaatcagctcgaatagatagtgcaacttcacaattatccactcagaaggaagaaaagctggttctgaagaataaatctcctaggtggcatgagcaactgcaatgttggtgcctcaacttccgtggacgggttactgttgcctcagtgaaaaactttcagctggtggcgtctgatgaaaatgggccaactaaccaggagcaggacaaggtgattctccagtttggaaagattgggaaggacttgttcaccatggactaccgttatccgatatcagcatttcaatcatttgcaatctgtctgagcagttttgataccaaaatagcctgtgaatgagataaggtgatcatttctctctattcagctttactactatcgacatttacacatggttacttaccctgcttgatataatgacacttaatacttgcttttatctagatggtcttcagtttacctaattgtttcttcaacagtattatgaaagctgactcacattttcagaaccttccaaacttcagacactagatagtcagattaggagtactagtagagcagtagttgatccaaaatctgagctggctgttaggcatatctgaattcatcggtctgcccatatgcaaatcgagcttttctgttgggatgtcacatcagaagagaatagatggcaacacatgtatgcaatttgcaccagatgatagctgccctctgtgttttacccttagctccgtaatcactactgattcagcctgttctgtaaactacagttgcatacttgcttgggtacggtttatgtgccatgaaacgtgacacgaagcaaagaaaaataattttagagtagggattttatgtttctactcttagcggtttaaatagaaaacaataagaaaaccacgtagaccaatctgaaattaagtttcaaaaattcaaatttagccttggtttataggctgacgagttgccaatggaactcgcaaaaatacctcttaagctgcagttgcgcagttgttttccatcactgtccaggcatagctgcattcatgcagctaaatcacaatcagatgaaccgcatcctaatcaagatttttggccgcgaatgcaatgtacctgcaggtgctggatgaaggacgaaccgtggaagcatgataagctggatcggcaggcgtagcgtgcacgagtcacgcttgacattgaagcacaaggatttgtttggatttgggcagaaaaaaaaacaccaagtccatctcctgaagttgctgccccggatgctgctgctgcagtgtacataatagccacctgtgatctttctggcctcctggcttgtaattctgttctagtttgttttttttttctaattgttacacattcttgggcggtgccggctgttgaaacctagagagtttcttcttctttttaatctcccccaatttacattgtaaacggcaggcttgtgtagccaaaaatgccaagttgtgtgttgccaagttgcaacttgatgtgttctttaaattagtgtaatacatggagtaataggctgcagtgctgagaacagtgtcaaaagcagtgttgtggattgtgtgatttgttagtagagatcttcttcaatgcttgaaattaattaggacccttgatcagatatgatagagagaaggtacctgaaaaaaggtattaaaagggcaatcaggtatggaaggtggaagggtaaaatggtaattattttttattaaattatttttgggaaagggcaaaagcgagagaagctacaaacgtttcagcggtgaacttcacattctgacttgtatatactactatatgttgacgaatacatacggtaatcatttgttgatttgagtcgagcgtttttataatgcctaatgggccttataaattctactgagtaagaaactagtggttaccatggtatcaggatgtatctgagagccaaaactgtgtgtatttgttaatccgaagcagtattttgttggacctaatctcagttgaggataagaagctcgtgttcttccaacgcgagctaatcatgcagattacgtatgttaatcatgcatcaatcatcatcgtataagcattgcaatgtcatggacaaaagaattattggggtacacgtctcatgttctgattcttgaggtaacaatgatgcaatagcatcactagaatacaatctctcatctcgatcataagatcattacaaaataccatttttgacaaatactcatttgaccccactaatacagggggcatcatccatctcataattctcagctacacactgagaatttaccgctgattttcctaataaaaatggagtagtaatagtaaattgtactgctgtaattacagcagtatactggtattactactgcacatatgtacagctacgagtcgcagcgtgccagctgcgtctacactgtctgcgcctgcttcgcggtggcgtcttctgcggcgcggccgccggacggcacggcgagccggccgccgtcgccggcggcggcggggagggtcgtcctcgtgcgcctcctcggggcactccatggcgcgcaccagctgcacgaacagcggccagtggtccggcgagaagaacttcgcgcccatccgctggtacgtgaagtggcacggccgcgtgcgctcggcggcgagcaggccgccccacgcgccgggggcgccgtcgccgtcgcgcgccacggcgagcgacgcgctctcgccggtgagccgcgcgccgtgctccgcgcaggcggacttgacctgggcgaggaccgccgccgccgccgcggacccgtccatgcccgaggcgatcaccgtgcacccgcgccgcgcgaacatctggcgacggggccgtacccgccgtggagccccgcggtggcctccgcggggcgcgaccgcgggagcggcaccttcgcggacagctcgacgggctcgccgtcgaacaccctgcgcgccgcggccaggacgcggtcgccgtgcgcgaggagctccccggcgtaccacgacaggaagaagcccccgtacgcggtctcccacgagccccccggggacctgaagaaggtggagctctccggcgactcgccgtaccgcggcgcgtcgtgcggccccgacaagccccacagcggctgccccgccgccacggcgtgccgcttcagccgcgccagcatgtgcctgtcgtagcactggaattcgcccgcgccgccatagccgccggcgccgtcgctcccaggcggatacgaagggtacttgagctcgccattgggacccaagctcaccgtcacatcctacagaatccaacaaaaactagtattaagaaacactgcaacttcgagaacgagacgaaggtgttcttgatttcgcttaccgtgacagtcgagcccaagaagtcatggaaggcggcggcgaagctgcggaagaaggcctcgtaggcctggagcggcgacttgccgccaagaaccgggagctcgtcgacggcgaaggagaggcacccgtcgcggcggttcccggagcggtcggcgaagaggatgtcggggtcggcggccgccgccgccgcgacccaggcggggagcgcggagccgtgggtgtcgagcgagacgcggaggcagagcccggcgtcgcggaccatggcggcgacggcgaggtaccctgcccacccgagctcgtcgccggtgggccccggctgcgtgacggcccacgagaccggcagctcgacgccgtcgacgccgaggagcttcagcgcccgcagccccgccgacacggccttgccgcggttcacggcgcggccgtcggcggtgaccacgtcggaggggagccccacgaacagccttaccgccgcctccccctcctcctccaccaccgccgccgcctcctcgccggcctccctgctccggtcgacggcgaggtgggcccgcgcggggctcagcctcagcctcgaccaccgccgccgcgcaaatccgagccggaccaaccccggtcgccttccacccaccacctcctccccggtgcaccgccgcctcgccggccttgcaaccaccgccgccgccgccgctgcctgctgcatcagcacagcctccattgtcgccgcttacgtcactcgatcgcgactttgctcctttcttctcggcttctcgctcctttgcgttcgctcggggtgtgcgtgtgttcttctctctctcgtttgggtttggtttggtggtactgaatttttaatttttcgcctcgtatttattcacagcgaagcgaaaagaaacaaaaagaaaaacaccgaaaaaagcgccagtcgagtgccacgtggcacggcgagcagcagccgcaataatacagagcgcgccaggtggcctcgcgttctttttttttttttgtttttcctccgccgctcgcttcctcctccatccaatgacgcgcggggcccgcaccggcctcgtccaccgaatgacagcgtgggccccactccacaccaaccggggtgaggtctgtggtctttgtggataaggcggcacgtagggacgcgggtgcggccacgtaggtggatttggacggtgggctggagggcccacccggcaggcagctagtagtaccgcgttggcgctgactgagatgttgggcccacgcggcggtcggcggccatactgtgggagtggatctgggcggaagaggaggaggacgtggtgctgactcggcgggcgccgacgcgtggctgtgcggcgccaaaaaccgacggccccgcgcgccgtgcgtcgattgggcgccggttcgcggcgtcgtcgcgtgtggattgcgttggttcggggaaaaactactcgaacaatggattgagcattgctgtttactccaaccatctcctaatataagatattttcatatttcacttacactatctatatcaaaatctcctatattatcgaacgaaggaagtacgattcatttaaatagtacgagtatatgataaaatttttaaaaaataaacaagatagattaatatatgatatattactcaacaaacctgcataatcaaatttaacttttacacattacaacgaataaagtaaatttaattgtgaatatacgtttactagttatagtttattttgttttctttgttacaacttataaaagatgaattttaacttgtatgtttatggagtgatttatcatataataatttatcttgttttaatttttttaaaaaataactatttagtaggttatatgtaaataacaaggaaatgtatttttgaggatttacaatccactcgttggtttcggccgttttccgcggtttttctcggtgtttccgcttcacgtgggttatgagcgttgttttggtcatacgtctgctagcaggtgctagctaccgacggactgactgtcccgaggaccggaggacggcagaagaaggcgaaaaattggtatcgtgcagccgtgtgggacaatgacctataccatgtagtgttctatctaaataaatttcggcagaaatacgtgtagaacaatacccgaccggatacaggccaatgaaaaaaaatctttaagatgatacaaaaggagaaaaaaaaaataatatgcaaaaaggaatcgataatctataagaaagaagaaaaaaagaagtcgaattcacgctttggcggataataacgatatataggattctccttttggataaaccggtagcttcaagatcaggattacggaggccatgggccggatgaattctacctcccccgtttcacaatgtaaattattttagcattttctatatttgtattgatgttaatgaatctaaatatatagattcattaacatcaatataaatagattcattagcattaatataattgtgagaaatgctagaataacttatattatgaaacggaggaagtatcaaagatgttggtggtgcgagtgaacaaaggactgtcacgtgagaagatgttctaggcgacagcgaaggagccgccgtttcaagcaccacacgaagcgagagatcaatccacgccaccagcaatcagcaatgcgtgaacaactcagccacgacgattattaaggtcattacggcgccggtatcaatgatcaaacactgtttattaaaatcattttgaacaaagcaacaatttttgtacagcgataagttttactcgtatgctcgtattcagactgtgcctgctaatatattgcgcatttatgtgcaattgacaccaatccggtgtatgccttttctcaatcttttgtttgttcagatgtcattcctaattgggcttgaacaatagccaccgcccttacctccaaatttgtctgtataacgttagctagttaaattttaaacttgtcaaagttataaaataaacggagaaagtattaagtttcatagtattaagatttgtgcaaccacgtcctctttctagtgacgaagggagtagcggcgagcgagcgagcaaccgactgtcccgagaagaaggcgaaaaattggtattgtgcagtcgctggggagaatggccgtgtagtgttctactagacttttacggagtactataatttggtcagaagtgtatgtaaaggaaatccagtttgcgtgaaacaatacgctaccaattgctgtcccgtgaaaaatgaactttaaacgagacagaaaaaaatatatatgcaaaagaggaactgataatcttcaagaaagaaaaaaagaagtcgaattcatgcttcggcggataatggtgttataggattctccatttggataatggtgatatactccctccaatttcaaaatgtttgatatcgttgactttttagtacgtgtttgaccattcgtcttatttaaaaaatttaagtaattatttattctttttatatcatttgattcattgttaaatatactttcgtgtacacatagttttacatatttcacaaactttttttaaataagacgaacggtcaaacatgtgctaaaaagttaacgttgttaaatattttaaaacggagggagtagcttttaagatgaggattacgaaggccatgggccctctcttggttgaaacctggaacagattgtcacggacaacgaaatggttgggtgcgatcgagggaacaaaggaatgtgacagcggaaatgttctaggcaacagcaaaaggagccgttcagccttccagttccagcaaccagcatggacggattcaccacacgaagcgagagatcaatccacgccaccagcaatcaacatgcaatcagcaatgcgtgaacaactcagagcaagaataatagtaggctataagcaagttatatatttatatagaagagagataaacaaaagtaaggagtattggctatcatgcaaaagctaactacacacaagctccaaatattatatattaaattcatagtgaaagaaagagagaggatgaagaaaataaagataaccttatagctaatctactgtacatgttagttttagcattaactagtaagtaagtaaagagctctgctattatagcattgactagtaagtagtgagctctgctattaaacttgctcttaggcacgacgataattaagatcattacggcggcggtatgtaatgatcaaacacagttgatcgcggcagcgggattacctcgtaacgattggagcgattattttggaccatattagaaccattttgaacaaagtaacaatttttttttacagcgctgcgttctactacatccgtccagtatagtacaaatataaaaattagtacaaatataaaaaagaataagttatacttaaaatactgttgataacaaagtaaatcgcaaacaaagtcgaatgattaaaagttatgataaaaactcaaaagtactactgtgcctgcaaataaggagtatgttgcgtaatttatgtgcgagtggcatactggcatcaacccggtgtctgcgttacatttctcaatcttctgcttgttcagatgtcattcctaattgggtttgaacactagctcgccatttctttacgcttgttatttaagatatggaaacgaagtaaggtaagttgctcaagggagagatggtttggctggcctcagattagcattttggcacatgaatcttggccgtcaataacccgggtttatcactacccgatgcgcagattagttactgaggctcataccatacgctgtcatcaccggccaacaccaccaactctccaagattcaacaatcgctagatcgaaaatcaggatgtaaaacaacaaaaaaaaaaacacacagaacaagagcatgaccaatccataaacttccaaatcaagacgatgtattgcaggaaggaaaaaataaatcacagtaacctcaaagatgaacaaaaaaccaccgagagaaacaaatggggatagacaaacaacgccatcgataaaccagtgacaaagaggccaaaatcagaaagaggagatcgaacgaaaacggttgaacacgacggaacttggagaagcatcgatcgccaactgatgcggcggcggcgaaggctagggtttcgtctcggggccatcgagtcctctcgctttaataaagccttggaaagacgggctctgagtgggcctctgttattgtggccttcacagcgaggcccattgagctttgctgatttcagcccagtggcgagttcctttttttatttttttggggttgctttgatgagaggctgctcctccaaaatccaaaaaatgaaaatgaaaatatcaaagtgacgtcagcgcaatcgcgctctcggatttggtcgcgacgccaccaccaccacaaacgctcgccggccgggctctgatactgccggcctccacgtcgccctccgcctccctccccgcattccgtcgagcacctccgcctccctagccggcagccgccatggctgccctcctcctctcctcccacctcaccgccgcctcctcatcctccaccacgtcccccactgctcgaccggcgccaagcttcgtctccttccgcgccgccaacgccgcccctaagggtgcccgtcggggttggcctttccttgcttcgtcggtagagccaccgcctgctgcgtcggcggcgcagccgttccggtcactggcgccgtcggagaccaccgtgctggtcacgggcgccacgggctacatcgggcgttatgtcgtccgcgagctcctccgccgcggccaccccgtggtcgccgtggcgcgcccccggagcgggctgcgcggccgcaacggccccgacgaggtcgtcgcggacctcgcccccgcccgcgtcgtcttcttcgacgtcaccgacgcgggcgcgctccgtgccgacctgtcgccgcacggccccatccacgccgcggtgtgctgcctcgccagccgcggcggcggcgtgcgggactcgtggcgcgtggactaccgcgccacgctgcacaccctccaggcggcgcgcggactcggcgccgcgcacttcgtactcctttccgccgtctgcgtccagaagccgctcctcgagttccagcgctccaagctcaggttcgagggcgagctcgccgccgaggcgtcgcgcgacccgtccttcacctacagcatcgtccgcccccccgccttcttcaagagcctgggcggccaggtcaagaccgtcaagaacggccagccctacgtcatgttcggcgacgggaagctctgcgcctgcaagcccatcagcgaggaggacctcgccgcgttcatcgccgactgcatctccgacgagggcaaggccaacaagatcctccccatcggcgggccggggaaggcgctgacgccgctggagcaaggggagatgctgttccggctgctggggcgcgagcccaggttcatcaaggtgccgatccaggtcatggacgccgccatctgggtgctcgacgcgctggccaaggtgttccccggggtggaggacgcggcggagttcggcaagatcgggaggtactacgcgtcggagagcatgctggtgctcgacccggacaccggcgagtacagcgacgagatgacgcccagctacggcagcgacacgctcgagcagttcttcgagagggtgatcagggaaggcatggcagggcaggagctcggcgagcagaccatcttctaggcctcgctcgccttcttggctgccattgccagtttcttggtgcttgtaagttgtaaattactacttcatccagagtgtttgtagagatgtgagttgttcttaatgtttcagacgccattagccattcaattgtaccatacaatgcattgcctaattccaaaggaggatagttttgctgtgtcagatctggtatgatataaataaatcaaagctaatcttttgacagattactgtgatttgtcgtgcatcaactatttcattagcttctggtatgcagcagactctgttttatcctctagcatcacgaattcatgattcatgacaaactgacaagccgattacagggaattaaatattttgtaaccattttgccatgaaacgagttactcatctcttaacacagaattgtcctctccaatgtcaacatatctgcgatccgaatttgacactattttactgatcctcatcaaaggagagcttttgcagtagtaacacagcagacagtttgcagtaaaaccatggggaaacagccataatgacaatatcctttgcatgtaaatagtatcactgagttcgatgcaacactatatacagagattcgatgaaactaaattctcctcagcgtggcgtagccactgggtgggtacatagttacatacaaaatgctgatattttttcttgtactatatctgcttggtcctaattagtattactcatgtccaagatgcaaaatatattacagaaatgaaggctcaaatctgattgactttagcaaaacggcccttaatcctcagcctgctatcagcacgagctttgcgggactcataccggacctgcctgtcgaatctgcaataattagaatttcattgtcacacagttatgtttcaaatcgaaaaatcctgggtaagagtccaagagaagcttcaagaggaaataaaaacatcatgcttgccataagcttatgtcaccttcttgtcttcctcttctctttatagcgagaaatgaccaagttcctgtcggggcaaggaacaaattctggcattttgggtagaacttgcattggcgtgccatttccagggtttgtctggtgggtttcctccatgctgctaccattgctcatgctggggcaaagttcagacatctgaacaaatgatgaaatacatgcttcagctgagctggctggaggttgctcatatgtgaactcgaccttgcacggatcatttagcgcagggtaatcgctgttatcccatccaccattctgccatatagataaagttatattaatagatagccaagtaagcatctattttgcgcaaaagaactgacaatcaaaatcttagctctttatcaactaggcctactctgcgtttttcatggccaatttcagtgtggatacaattccccctatctgaacaggactgtcaataaataatcaatgggtagaatggtatccttgtccaggtttaaaaaattaatgtatgtgtcagtaggtgtaaaccaaataagaatcttacacaaaatcacgaatatgacaatagataggaaaagaacagaatcatatcaaatttggggcttcttctctctgaaaaagagaaagagaatttaggggttcttcactagaatgactttattctgactcagatgtatcttgagttgctagcgcttgagttgacactacagaataaattccccatcaacataggtacagcaaagcatgcctaggaatatcttcaccgcatatgatacagaatctgtatagtttctaccgttcagacgaagattctgcggacactaccaatctagtaccatttatcgcttgactaacaattgcagtgacaaaagtacatccatagggtaaacagcactgcaaattagtcagatatgctgaagattgtagatcaaacctcataaccaggcgtcggcatggttgcaacctcattgctgtttgcagtaccgaaattgccatgtccagtgttgtgttgtgttgttgttccccatgaaggtaactgatgatcgccggcctgcgccgcctcgcgatgagcccaaatctgcgcgccgccgccgtctgaattggcgagctcggttagctgtcgtatgacctcctcattcaccttcccatccggcgagttctgaatcttttgcagcagacaagaattaagccggataaatgggagtaaattaaatagaagttgattcagaaaagggggggatttttttttttcggacagtgaacagtagaaggctgtaaaagcgaaccttgggggaagatggcgtgaggagaggctcgaatccatggcaggaggtggtcgggacgatgagatcctcgaggctgagcacctggggctcctcccagatggcccaccacccaccgtcgtcgccccccgccgccgcggtcgccgccgccgccttgtcggagtaggagatcccgaggagcgcggcgaggtcgagcgcggaggggcacccggtgtacgggtgcaccgtggagcggtcgtggagcggcgccgccgggtcgcgctccccgccgtggcggtgcctggagaagtcgcagttggagcagaggaagccgcccgcgccccggcggaagacggcccccgcggcggcgcacgcggcgcagagcggcgcgcgcgcgtggcgggagcacaccccgttggcgccgtgcacgtggcggtcgcatggcaggcagagcctcgccgcgtcggccctgcaatacaccaccgccgccgcgtcgccgcagtagtcgcagcccgccgccgccttcttggatccctcctcctcctcctcctggaccacctccacctccggtagttcttgatccttcttctccgcacctacctccacctcatcttgacccatctccccgaccaccacttgacgacctccgccgccgccgccgccgtcaagctcggagagtgagtggcgcgtacaaagtagaagaagaagaggactagaggagggagagtagaagatgacgagagagatgacgcctcgttattgcttgggggataagaagcaagaagaagggagggggaaagaggagtgagagaattgtgcaaatggcgaaagagacggtggggagaccagcgcgcgagaagatgctacactcgctactacttcgctagcctccgctcgattcgttcacatctggacaggtgtcaggtcacgagctaggattagagaagctttttttttttttttacctgtgactgcctcacatggattatttatcactgtctttgcggcccatttggtcggagggagtttttagagcaagttcaatagtataactcactactagctccaaatcatctataaccaatgtaatagccaattcatacaatagttgcttactatactattaatacctggtaccacatgtcatacacattacgtcttgtagtccgtgttgcaactagctacaaatctgtagctcgctgctcttctctctcttcctttatctctttaaaatatatttatagctggtttatagcctgctattgtacttgctcttacaagggattgagagtttagaaagatgaggctattaaataccccctccgtattttaatgtatgacaccgttgactttttaaccaacgtttaatcatttgtcttattcaaattttttatgcaaatacaaaaatacttatgtcatgcttaaagaacatttgatgataaatcaagtcacaataaaataaatgataattacataaatttttttgaataagacgaaagatcaaacgtttgttaaaaagtcaacggcgtcatacattaaaatacggagggagtattttgtttggttatgagacatgtgaattttggcgtgatgggatagggaattgagaaaggaagtcccccttttcaatacctgggtagatgtggtaattgggagggaattcctcctttactttgcctaaacaaatcacagccatccattttcattaatgacctaatctccaactaaacttcctatcaatttccaccacctccaccaaacaagatattgggataaaaatcaaattcccattttaatctcatcatcaattccctcgtgtaaactctcaatccttttacctcaagttgccaaacaagccgttgttgttggttggagacgacgacgtccgggggagtagggtcagcgtgtcaggcgcccaacatctcgaggaaacagatcccctaactttgtgcagggctataaggcccacatgtcggtgccacaactgcaaactgcacaaagtcagcggagtctcgtccgcatctcggttggtgggtagtaccatttccgtttgtcgttttaatttcaaagtcaaacccatttagatttaatcaagtaacataaaaatagtaacaaattttaagatataatggcattaatttgatgctatatgaatgttaatgtgtttttataagtttgatcaaacttttgtataaggctgtgtttagatcaggagtgtatagttttgacgtgtcacatcgtatatacgaacatacatgtgaagtattaaatgtagactaataataaaacaaattacagactccgcctgtaaaactgcgagacgaatttattaagcctaattaattcgtcattagcaaatgtttactgtagcaccacattattaaatcaaagagcaattaggcttaaaagattcgtctcgtaatttacacgcaatctgtataattagttattttttcgtttatatttaatactccatgcatgtgtccaaactttcgatgtaacagggtgaaaaattttgccggcatctaaacagggtctaacaatgaaaacgatttataatgtagtaaaaaggagggatagtagcgagttgtcaagaggagtagagatggtgatgagtggtcgttgtcgagggcgtactaaggagcgttgccggggaggggagggaggatcaaggatgacaggtgacgggagtcgagagggagggaggagcggtggcttctctatggttcgacggcgacggcgacggcgaccggtgacgtatggggtgacgtaagagatgatggttcctgtgctaaacaaaaagtacagaatacctaactccattcaacaaattatcctcatcatataattccattatctaaaaaaaatcctcatcatataattaaaaaaacacaaaaaaaactgatgccacaaatctcaaactaatataatccatctccccgtagtttgtttgtgtgtacgtggcctcgtatgcaccgtcgatctagtacgtacatcatatggaacggatcggatatgcgtcgagaagaagccatgcgtgcgccgcgatgttctccctgaacgcgaatcgcgacgcgtcggacgcgaagatgcgccgccgcgcgccctcctcgccgccgccgccttcgtcgtcgtgtccagcacccccgttgatatcaatgcgacgatgggtggtgagcgccgcggcgcggcggtcgtcgatcgacgtcctcccacacggcggccacggcgcccaccgcatgcatccttgtcctcgagcggccgcccacacccctgatgacgagcgtcgtcgtcgtcgtcgtcgtctccggcgacggcgcgtctggtgcagctccagaagcatgaggtgtcccgtccgtcgaccagctcgaacagcagcacgtccgtgttccccaccgcctcgtcgtcgccggcggacgagacatcagccggaacgcctcggacgacaggatctttcttgccagcggaaggcccgtagcaccatggatcccggttgtccagctactgtagctttttctccgacggcgacgcagaggcgccccccgtgacgtgggatcaaattggcttcgggtggtgggcgcgtcggcgtcgagtcccggggtttggtggcgcgtgatccgtgtgcaaaaaaaatttaaacgaacccctataaatcgggcgcccgattttttaaatcggacgttgcttcaccctataaaaagcattatttcatcaattgcgaaagaatgtttcaattgttaaaaaaaaagagaagcacggtcagatcgctagatgaaaaaaattagatcaacatatgcaacaaacgatttaaagtcattgaaacacttaccccatgtacaacaataaaccccgtatccgtcaagatgatattattaaacaacgattttgctatccatctcccgtgtgaatttttctatggcatttcacacttttttttttggccgcacgctatgcaccacttgtgatgtgagctgcagctcacggtcacggactgtgtcagctagcccacgcgtgcaccatgatagagaaacatggtggcaaggtggcctctgaccggcgagccggccaccggcagtacgaccaacgctattcggcgagcgacaccgtccctctcgtcgtcgtgaaatataaattacaatcctatataactaaatttgcatttgtaaatttagttgatatgacatgtaagtgcaatgtaattttgataaaactaatgtgtaagtaaatatgtatttgttattttctttaaaatataaaattacagtcatatataactaaaattatatttgtaatttcagttgatatgacatgtaagtgcactgtaattttggtataagtaaatatgtatttgttatttttttaaaaaaaataaaattacagtcttatataactaaaattatattttaaaatataaaattacagtcctacataactaaaattacatttgtaaattcagttgatatgatatgtaagtgcactataattttttataaaaataatgtgtgagtaaatatgtattttttattttcttttgtagttcgttgtatgtaaatataaaggcagaaaaaatttgggtgatttttttttgttagaaatcacacgacaaatgaatagacagacccattaaacaatatttaaaatccactgcaacatttgatccatacatagaaaaacatcacgagtacactagccgaaacattgcttacgcgcggaggaagttcttgaacatccaacccttacccttgagaacggcaacggacttctctggcaagccgcgctgcggcaccatgactgctggtcacctcgacggacttctcttgcaagctgcgctgcggctccacgactgctggtcacctcgccggagctgttgcatcgccggctaaagaggccgttaagcttacgcgcggaggaagttctcgaacatcgagcccttgagagctgttgcatcgccggctgaagaggccgttgagcttacgcgcggaggaagttctcgaacatccaacccttgagaaccctcgagaacagcgacagacttctatagcaagccgcactgcggtcaccacgattgcgggtcacctcgccggagctgttgcatcgtccagtgcttctggatgaaggacgacccccagctccgctccttctcgaacgccgtcaccaatgacctttgcatagctgccgccgccataagctggcccatcatccgcctcctcaccctcctatacgacgccgccgccgccaccgaccaccccgcgaacagccgccggcgctggaacacagatacggggaacagacgagagagagacgggtgcccgatttttcctttccgcatcggttttttccatcatgcacaactctccaatagtcacaaatttaaaagttctaggaaaaaaaacttggcgaagttttctggcaactccgattatttttctttaagatgtggccaataagtatttcggaaatgctaacgatctgtcgacagaaaatctacctccaaatcttgtagattttggtccaccggataaactttgtgattcgtgctccagggccttctcctccaactctggcgacctcctcttcttctccagcgccggcgacaccctagactccggtagaggaccctacgggttagggtcccgggttgaggtgggggtgggaagggtgggagggggaggggtaagagggaggagttccggttttagagggatggccgtgagaggcggcagcccgaaggtgggcggcgaggcggcggcgggcgccgccgaagccgcggggtcggaagctggcgatgggccggtgtaggcggcgggggcaaagcagaagggtgtattaggaggaggcggccggtggtggtgccctgccgccggagacggggaagacggcggcggggacagtgcgccgccatccgcttgaggaaagaagaggagagggaggggaaggggctggccggggggcctcgacggcgccgttgacgcccttcggccagccggcgaggcggggcggtggcggcgggggatcgggcggtggcggtggaatgcgtgatgggagggagtggcggcggcgacatgagcgaggggaggggaacgagaggagtgttagggttaatacctctgcacgaatctcaaagtgtatccgatggttcaaaatttgaaagatgggaagtgagattttctatcaacagatatacagacaatcccaaaaacaattcatgttgaaacttttttttcgagcaatgaaatattgcaacatattttaacatataatgcaacatcatcaggagatttgcaaatatccggacgtccgacgcgtagccctctccaatcctttccgctgctaactagcagtgatacgtgacacgcaatcccagggagatggtacatgacaatagaatcaacaacggcacgttctatcgggaaactcttgattgttcacccatttaatacatgtaattcaaatagttatgaaaaaaaattgaaaaaaaattgacaagatagatcaatatgtaatatatcactccacaaacatgcaaattaaaattcaacttctataaattgtaaaaataaagcaaataaaacttaaattagtatatgcatgtatagttgcagttaaatttgttatttttgttacaacttgtagaagttgaatttgaacttgtatgtttatagtgtgatatattaaatatcgatctatctagtcattttttttgaatttttttcataaccatttatttgacatacaataaacgggtggacgtccactcaagttattagaatccgtctcccgttctatcgccattcttccaagtggctaaaagaaaacgtaggttaccatgtttttcctatatttacttgcttcgattcacattcagcttcaaatattgttgccattatttgggaaactactccattcatacctttaggatttttcatgtcgcttaaaaagttatcaaaaatttaaagacatttagtaacaaagatcaatatatgatatattacttcacaaatatgtgtatgttcaaattcaatatgtaaaagtagaagagaaacaacaaatttgaaatttgactatgaatataatgcgtaatctgtggtcaaatttgttatttgtttgcgttgtataattcaaattttaacttgaatgtttgtggaaagatatattatatattgatctattttgatttttttttcaaaaattttaaacgctatgtacaaaacgagaggatatcttctcgggggcaaaatctacttggccattattttgtcactataaattggctaagttcgctagacattcttagctagcgagcaacaatacgtgggatttcatcggggtaagaagatggcattctctgccacaaatatcaagtttcgatgaccgtagaaacatcaaaaaatttaaaagctttgaaagtgtagccaatctagccagcttggcttctcgtcgtgacaagatgtcgttggtaggaagcactagcagcgcgagcacgtcgatgagaggatgctcgatgttagagacaagtatatagtctataagacaatacaaaaattattatttagagatcatatctttataataattcaccattagaaaatgattttttatggcgttggcttattattttcgttggcggaaaaatgtaaaaaccgccagcaaagtcgtaacaagggggtgggggaaccgaccgccagcgaaaatgaattttcactggtggcccgtctaaagcggccgccagcaaaaaaatgtcaatttttggtggtgtcgacgtttgatgttgcgattccggtatttgcatagtatggagatcattggtaccagggtatacgcgagactgaggtaaaagagacgggaacagggatttttatacaggttcgggcccctgaattgtcaggtaataaccctacatcctgttggccaaagccgatattactcttattcaccataatcacaccagtacaatattttgggtagcctatctaactgttgtcgacttggcggtctgaaggtctgactcatagtcgacaacagggtagtcttcctcctcgaatccatgcccggcgagatcagagatagcgctttagtctctcctgacagtatccggagacaccgtaggggactagccgtgcttatctccgaagtcgatatccggcgtcttgtcttggcgtatgttggcttgtatgttgtggcatctgttgttccatgtatgttgattgtgggtgttgattgtccgtgtcccctctcctcctagggggccttgtatttatacccataggtgtccccttgtctaagtagaactaggaaaaccaatatggatacaatccgagtagtccttgtcgtttccatgtagaactctggttgtctttccttattcggaactcctcctatatccacaggttgtttccgtataggacatggtatgtggtgggtcctgccgagatttactcaactactattaggtatgtggtatccataaccctgataggtggcggtcacttaggtgcgccgccagcgaaaatatataattcgctgacggtcgaatttttcctggtggccaataaacagaaccgccagaaaaaacccagctcgtacccaatatccctcacattaaaaaccactcacctacctcatcctcttctccttctctccacatcccctcctcttcttaccccttctcttatcttctcctccatcccgggctccccaccggcgacggcgatggcggctctggcggcagtgaccagcggttccccgcgccacccctgccctgccatcccctcctctcaacactcccagatccactctatcctccagatccactcttccctcctcctcccttcccaacgacgcgtagccctctcctcctccctctccaccgacggcgcaggagatggaggctccggcggtggcaaaggggatgggtcgtggcggtgaccgggctctgcagcggggacggtgctggcgcgacggatccagcaggctcggcgacgtctagtctcggtgacgacgacgacgcaggcgacggatccggtggcgagctctccttctccctcttcctcctccaccgccaccagctatcgtcgccaccatcgccgcgggctgccgtcgcctctactgccaggagatcggggccggccggatccggccgccgcgacgacgggagaggctggatccaccgccgtgacgacaggggtggccggatccaccgccgcgatgacctgggaggccggatctgctgccaatgctgatgggggaggtgccgcgacgacgacttcaaatttttgtgatgcttgaaagcttgggtgaatggaaatttttgaatgtaaatttttgtgaattttagaatgcttgggtaaatttctgtgaaatttttgaatggtggagcgttgatggaggcgggcggagcggtgtcgctccgtccatcattttttaaaaaaatttggccagcatttacaccagcggctggcatggtgtaacccgacagcgataattcattttcgctggcggtcgtcttatgcctgttgccagcgaaaatggattttcgctggcggctgccttaagacgaccaccagcgaaaatgaattatcactggcggtcgataaccgctagcgaagatcttgattttcactggctttttgctttgtgacggcttcaaattccgccagtgaaaacccaaaatggccgccacgaatgatggttttggtagtagtgatgggaacggaaatatattgttttttattactattctttcaattcttttcaccctcatgcaagagtgtttctatgttctagaggctaagtgtcgttgttaagccgttgttaccagtagcaacaattgtttgcctcttttctttctctctcttccatatcaacgaacactcgtaattaggaagagtaagagatcactattcagtgccacacaaagcgtgttagttttgattaagaaatctggcacctattgtcggttcccaactaacacctagcagtggcacctttgagtcacctcgaagatgctagtttaggaaccggcacctttaaggttctcgggatgaaaaacagggggggcaccgagcacatccaccctgcttcgcccccaaaatcaaacgctttgaaccattagatcaatccacaatgaactctagatcataatcatcgtcacaacaacacaacaacaacaacatcatccataacaagttgtcaccgccgccggatctgccgtgcaagaagcttgggacggaaggggaatggaggtggtagaggacctccgggaaagccaccgccgccactggatccgctcgctggagcaacgatgccatcgcctccattggatctgccacaagaaaatcttgttggtggagagggagaaggaccactagatctgccgccaatgagggcaagggagcagggtcaagagagagggggggttacagggataaggacaagacgggatatatgggtggttgataggctcggctctttttttttcatatagtttttctaattaactgacacctataatatattataggtgttgtttcttctaagtaaactgacacttatagtattggtgtcagtagtatttctttataaccggcatccatagttttgaaaagtgttggttctatttttttttcccgcggggatgagaaaaagtgtataggaaccagttttaactgttccgccacctataataccatatcatttgtgtgtgttttaagtagtgattaacaacccttgtacatgccgttatgtcctcgtggtgcaggcctcaccaaacccgcacttcaacatcccggtgtaagagaggaggaaatgccagaggcggctaggtggagcatttttcaacaaaaataatgaatagtgatggaaataacatgcttggagacattgatcatttcatcaatttaaatgcctaatgcttagtcgcacgataagcatgtgttggatgaaaagatgcttgcatacaacaacctctgctgatcgattcaatcacctgaagacttggttctcatgtgaagcgagaacatgcgcttgtggccgtttggcggctgcgtttctcatggagccgatccggctttgacgcggaggagcaacggattgagcgtgggctgccgttcggtgttagctctatataggagtgaaggagacgtctttgaaggacacagaacacaacagccatctactctgaaattcctcaactaccgccgtgttgcgtcgccgtcgatccaagccggccgtggtgctcatcgtgcaacgagcattccggcgagcggtgtctccgagccttcgccgcattcgcacctgcacgggggcggtgtaaaggtttctgggcagcgtatttctacacggccgctcgacatcatcgattgactgcagtgcttcgactcgctgatctccgtcgatccattcagtgagtgaattctttcgtttacaaaggaaaggaaccggtgcatttctaatctagttttgttcgtacctgagttttgtatatgcatggtactgttcatctagattaaaatattgcggctagattaccattgtgattagcctaataacttacttggcttggttatttatgtcttgtttgatatctagcatgatagaatttatgagtttttcttgtcctatcatgtcgcaagtaggttatgcttgctgtatatgctaaattaatggctaagtatgcactatttccaacaaatagtacttgtgcatgttaaaaaacatacaaaattaaaactgcatgcatacatctagtctaaaaaatataaatgagtccagcaattttccatgtgcaataaattacacaccaattccactcgtgcaccgtcgacgatcatcgcagccgcctctcgagatcagagaaacccaaacgtgcgcacggctggcgacggatgcatcttgaagaaggcgtgcgccaccgtgttctccctgaacgccacctgcaataacccgccgttgcgcgcgccgcacgcgaacacgtggagcgccctccccctcgccgccgtctcatccacgccgtacagcgtgatgcgacgccgggtgaacgtggcgccgccggcgtcgccgccgccgccgccgtcgtcatcccacacggccacgctcgccggcgtagagactggtaacatgcagctatatttgcattcccagacaggtgcccactgctcgccggcgtcgccgccgccgccgccgccgacgtcatcgtcgagcacccacagcttgagcgtcgacatcgctccgcctttcagcaccgcgagtgccccgtccagctcgaacatcagcacgtcgtcgtcgtcgccgttgttcgccgccgtctccggcgacggcgccaccagccggaacgcctcggacaccgtgtcgaacgccacgagcttcgcgggggcgtaggggtttaggtgcgggtgtctgccggcctctacgaggtcgcccatccagtagagcttccccccggcggcgacgtggcccaggtgagagcacgggtgtctctccacgagctggtcggcggtcgcgccgccggggttcgccgccgccgccggccgagatgacgaagtacgacgagctgtgcttgcgcgacggatcggggcccttggacagcacgcggtactcgccggacggccggtggaggtagaagcccagcgcggcggacgacaggtgcggcgggaggcccgaccaccgccgcgttgtcgggtcgcagatgacgcggaggcgccgccggtggtcggcgaagaggagcaggccgtcgcaggacgcgaggagggtgcagtgggtgtagccgccggggaacgacgccgtgtagcgggcgagggggcggcgcgcctcctcgccctcggcgccgccggagatcagcggggcggggacgaccacgctcagctcggcatcgtcgtactgcctgccgttcgagtccgacggccgcctggagacgcggaggagctggagcggcggcgcgcggcgctcgcgggccgcgaggaaggtcgggtcggcggcgacgcggcgccactgcttgcacacggcggcgaggcggccgacggagttggcgggaacgaggaggaggatctcggcgaccatgtcatcgctcaggcttactggccgtctctcgcacggcggcggcggcggcgccatgtttggagagcgtgtgctggctgctacctagggtttttgtttttgtttttttttaaaaaaataaggttttgtttttagttttgcttaaggatacgtaagcccatatataaaacgtattgccccaagggcccaagagataaacatggagatcatcagtcgaacgacacgagatgaacgcattgagataatcgaaggacatgcagaatcagacgtgtagaatcgcttggcagtgctttgagttttcctgctactttgttttagaaaaaaagaaaaaaaaacgtatgcacggcacactattttgatcaaattcgtacaacacacataatgtaccgttcaacaaagtcaaattcagtatacgaacggtagtggtattaagcggaattgctaactatcatttgacagatttataagccttccatcattcgttttttagccgttagatggtttttgagatccatgctagcatccctcctttctataggataagggattatgagtttttgcttgcaatatttgactacttgtcttattaaaaaaatttgtgtaaatataaaaaacgaaaagttgtgcttaaagtactttgaataataaagtaaatcacaaagaaaataaaacaataattctaattttttttttaataagatgaatggtcaagcagtgcaagcaaaaactcaaaatcccttatattatgggatggagagagatgtaagctagactgtcttaaccaacgacttctcttgttgctactagtacactcaatagtgcatgttttttttcttcttatagaattttcttttaaatcactcatccgatctatgatccgattacaccgttgtattcgtaacaattaaatttttacaacaaaatctcacatgataatattttttttatgaaaaatacaatttacttttataatatatctaaattacttttagatttcattaaattacttcttagatatataaaagtaaattcaataaatggtaaaagtaatttacatatattatagaagtaacttaaaaaagtaaaaaaagtaacttgtcacgatatcaaaagtaaatctattatggaggtaaaaacctaagtttatctagaaattaaatctaatcaacatattatagaactaacgataaagtaaagtatattgttcagtgaatgtctaaaaagtaacttaatcaaatttaaaagtaatttatacgtatggtaaaagtaacttacatatatatgataaaagtaatttacaatataaatattttttattataatataatcatgtaagatattgttataaatatttaattacaacgaacacaatggtatagtcatattgtagatcgaataaatattttaagagaaaaatccataagaagaaaaaaaagagatacactttgtgcaatagtaaacaactagaccatctctcacgtacgtctctcacgtaagtgtaccaactaacacaatggtgtagtcatattgtagatcgaataaatattttaagagaaaaatctataagaagaaaaaaagagatacactttgtacaatagtaaacaactagaccatctctcacgtaagtgtaccagttgcaagtaaaccttctctcacggatgcgtcgctctttaatactaaatcgagagcgctctcggtttagattgtacttgctaattaactaggtccacgttactgttccctgctgttctccggttgaatatttatttgtcgacagcttgcgttccgcttggagagacgatttgattttccccgatttctgcatagatttgagttcgctttgcctaatcttcgacaggcttcttttgattggaggcggcaaaacttggagcatgatttggtgagattactgggctattttctttgcatttccttcgaattgagcagtgttttccgacctacttttgtttatgattcaccatttcaccggagttgtcgttgccgattcgatctgcgagcaatgatgagatttctggatctcaactccacctgagcccaaatcagccgttgccgactccatcattattgatttgagccgtgtttttcaatgctattttgtttacgatcccacgcgtgctaattacatcgtgcttatactataattatatatgtaatttttcagacttacatcataaatgcactaaaattatatatataatttacgaacttacaatataaatacatatcgactgtttttttaaatattatgacgttataaatataattactctcttaatttaaacagatgagatgatatttgagctttaatgggtcacggatgattggtggcctgtttaatagtgggttggtcatacaggtttcgacctgttttttacttttcgtaatggtttgtatagactttttgataaaaaatataagaacggttacgaaagagaactcaaaacccacagatagaacataaaagtactctagttacgaacataaccagaagtttaggagatttgtaatgtgaagtgaaagaggcagattagagtgagtgcaagaggaattcgaagggtagacagggatatgttcacggagtcaaggaagaaaggagatggagggtctgagcaccgaaaagagttgaggatattgaattgaaaaaactcaccaggtcaaactcgcagggatgatatagcagaaagaatgctcgttggagtctcgcggtggcagaggttcaccgacgtctgtagtagtggtggtagagccaccagggtagatgagcagctggagataggtaagcaagcgggtcgacatgtgaatctacttatatattaaatcttggcttccttattatggtctagcttaccgtatcttaccgtatcgaaagatataagtgggtcgtcccataaacatatttaggtcaaattaataggttacccgcgtgagttgcccactattttaacatataaacgggttcgcggacttgcatccataactggagagactcgcgcgcccggcggtggtcgtagccggtgtcgcctctcagctccattctaattctaaagttccctcctgcgaggaagaagcccatgcgggccccgcaaaccagagtcccactcccacgacctaaaatgaaaaaaaatccatccaacggcccacgatctccaccaggccgaaccaacggtgagatgggccaccaagtctcgcccgctccctcgtataaaaactccccccaagcccaagccctaaaaccctctcgccgccggcaccccctctcccgccgcatcccacaacacctcgctctaaaccctcgcggcggcggcggcggcggcggcgcctactccccctccccaccatctcgccgcagccggaccttcgcctcgcgctctcctccccccatcgtcgattcgcgtccaatcgagccaaggtttgcgccattttcttttcttgagggtgtatatatcctagctgctcggtttgacccaagctttcgatcttgtggtttttttttttgatttgggtttgtgatccaggtgtaggtgttctcgtgcggtgagagagatgctggtgctgttcgagacgcccgcggggttcgccctcttcaaggtgctcgacgaagggaagctcgacaaggtcgaggtgagtcttccgccaccgcctccgcctccgcggtttcagctcttcgtttgctttgctgctgtggagtgttcggtggactaattgcgctacgcgtttgtgttcatccttttttaggatttatggaaggagttcacgacgtctgactcggcgagaaaggtttgtgttttttcttttcacgttactcccaggacaaaatattcttcttctttttttatttaataatctcgttattgcacaagatatctcatatttatggagttaaataagccaggacccatggcttcagtaggttgattcaacataggtgattacaaccttctttctttttggggttttgtgactttgagagaagcaaagtgattttcaggaataaaaaaatacaactgagtaataattctctgatgctctgaaccgcagttttgttttggatgtgtaatttgtatggtgagagaagagggtaatggttagttcagtctcctataatataaatgccctgatgcacattggaatgacatggtgtggagaacagtattatatacataagctgtgttacttttctactttgaattgtgatgagcatctccatatcttcctcttactactgtttattttattattttgagttgattttctttcctgaccaaacaaattaactatattcaggtggtcgagctgaaggctttcaacaagtttgagaacacctccgatgccctttcagctgcaaccctcattattgacagcaagcctaccaagggtttgcgcaaattcttgcagaagcactgtgagggtgaaacgttagctgtagctgactctaaacttggaaatgctataaaggagaagctggttagtaggttccttggttgctttgtttatgttgaacaaacaatcatgcttataatttgacgtgcttttgcagaaaattgattgccttcataacagtgctgtgatggagctcatgagagggttaaggaaccagctcactgaacttatatctggtttgggtgcacaagaccttggtccaatgagccttggattgtcccacagcctgtctagatataagctgaagttcagtcctgaaaaggttagtcttttatttattccactattcatatttattgatcacgctatccagtgcttcttcctggctctgagtcatatgaatcaacatcattatcttttgttagtttccaaactagatttttcaatgccatgcttctgttaactttacatttaacttccatttgcaattaattagtctagcacttcagcattgtgatggactgaggttaacgttactgtttttatttgtacatgaccccatcctgacaagctaactgaggtaaattgtttctggttatacaggttgatactatgatcattcaggccattggattattggatgatcttgataaggagctcaacacttacgccatgagggttcgtgaatggtatgggtggcacttcccagagctcactaaaattgtagctgataacatacagtacgcaaaagttgtgaagatgatgggtgatcggactaacgcagaaagccttgatttctctgaggtaaattctggacatacctgatctgaatttaacggccatgactatacaccacaactggttcttgaatatgaagcaaatgcttttttccagatactctcagatgatgaggttgaagcacagttaaaagaggcggcagtaatatccatgggaacagaagttagtgaacttgatttgctaaatatcagggagctgtgtgatcaggtgttggctctttctgagtacagagcccagctgtttgattatctgagaagcaggatgaacactatcgcaccaaatttgactgcacttgtgggcgaattggttggtgctcgacttattgcacacggtggcagtttggtaaatctggccaagcagccgggcagcacaattcagatacttggtgcagagaaggtcagttgctatttgtgaaccttgaactctttaattattttccactctttgtagtttatgcaaaattgtcccttggatgatgggttctctaggcacatggggaagggatgcttgattgttgttttgtgtaactttcctttttttcatctccttatatttctgtctaagtctgggaggtaagtttgattcaaacaactcaatttttctgtgttgtgctg

SEQ ID NO: 15708 - DNA, 556 bp, Oryza sativa
ttgcactgcatttttctgctttgccctctgcaatatcttctcttctattggatctttgcatataattctatacaccgttacctacaataccaatttgaaagaaaatacaaggaaatgagctaccacatatttcattccaaaattcaaatgatagtgttatataatttataaatatagataatggacaatgcgctaaaaagagttgagctattttgtgacgtgccagtgctatttaatactcctttcgtttccaaatgtttgacgttggttagttcagttttgagctaaccaacgtcaaaccaaaaaaaaaaaggaggggcatcactaaaaagagttgccataaaaggcagaaaaatgctccaaaagaaatacgtagctgaggagcacactataagctatagtactatgattagataaagtatttataactgaagcttcagttacctcctttgtctgaccaagtctgtgtgttctatccattgcttgctggtcttgtggtgggttccaatcaatttcataaaaaataactgtatcagcagcagtcaaattaatacct

SEQ ID NO: 15709 - DNA, 5443 bp, Oryza sativa
accctgatgtgctgggccggtggtcacttgattccctgcttccgcattggcgcgcgctgacgtgctggtctcgtcgataaccaatacctcgcgcggcgtattcgttgacgatgagccatagtcttcgagcaggtgcaagactgatggttcgtggggatcgatgtcgattactccaacaaatcgatctaaaattagcgtcgctcctttttccttgtcctcatccctgagggggatgtgtgactgctggaccttagaaggtgacgttttcatggcgctgagaaagaccttgcagcttgagaggtcgtgattctttgttttgtgaataggacaatagacatcacgagttggtaaagtacgctgaattccacgctctttgcaggcatgaatttcagcgtggacgttgagaaaaacccagcaggcttgcgaggtgtgttttctggttttgtggataggacaccaggaccttgtcacctcggaagtcatcctcgtcggctcgtgattcttgtcggaaagacaaggtttggccgcactaggatccttctcaggctcggatgtcgtcgacgttccgatctccgcttcggcgggaggatccttcaacatgtagtcgtcctgggttatagccactgcgttctcgtttccggccattgacggaccagctgagatcggcactgtggtgtaaaccgggaagacgatttcgccgacttgagtccacaccagtgttgttgaagtaggaactccttggttgaggttggtgttgacgccgttgtcgacgaagctggatgtcatagtagtagaaccttgagcaccaagtgcccctacctggcgcgccactgtcgacgggggatacccgtagaccggatatagagggtattagggtacactggtacgaggatctacgtaatacgacatcgagtaggcagaaaacaaagattatactggttcaggccccttgataggtaatagccctaatctagttgatatgggattatatgatggaaaccacagattacaaagggaatagtggaactcgacgataccgacgagatcgtagtcgagttgattcgactagatcacccggcgacttggctcctgtaggctccggcttcgtaggctgtggtggatgtgttggcggtaagattcgatgccctaggtcctctccggggggtcccttttataccgcaggtcaactggtctccaagtaggactcggagacatcggacccgatacgatataatgacgacccagttcaatccgagtaggattccttccatctgtgaactccataatgaatttccttaacgtatgccaaaaacatccgtatacgcgcaagtataccatatcgatatgtgacgtatatcaaaaagtagagggtatactttacccgtaaccctgacagaaatgcagagctttcaaaaagaactgctcattcttccaattatatttcttgtatttatttatgcccccgtctcggcaagtgttttatagatgatgcattcacaagtgcgtagactatataacgtgaatatacatttttttgtgtaattgaaaaaaaaagttcccacatctcagtttgaacctcaaacaccggtacaccgtcttgcctttaggtttttgaatttttatgattcttaatcttttaattctaaacataaatcatctctttacttatttctaaacctgaatatttgttgccacgccacttcgtctgtgcgtgacgaaataatattgtcacaccatcaataatcgatttattgatgtgaaaattttgctttgtcatgtcaatatgaatggcttggcaagagaacgttgccacgtgcccacgtcagccagagtgcgtgtggcaaaataacaccgtcacactagccagggtagtgtgatactctctccgtcccataatataagggattttgatattttgcttgcactgtttgatcactcgtcttattcaaaaattttgtgaaaatataaaaaagcgaaaagttgtgcgtaaagtacttcagataataaagtaagtcaaaaaaataattaataattccaaaaaaaatttaatacgacgaatgttcaaacggtgcaagcaaaaagtaagtaaaaaataaataataattccaaaaaatttttaatacgacgagtggtcaaacagtataagcaaaaagtcaaaatcccttatattagaggacggagggagtagtattgttctagatgacatggcaacggtatttcatgacaccactcttgctgacgtggtcgaaagattcagtttaaaaataagttttgttatgatttaggctgtgtttagttccactctaaaattggaagtttaaaaaaattagaacgatatgacggaataattggaagtttgtgggtgtaggaaagttcgatgtgacggaaaagttagaaatttgaaaaaaaaattggaaaacaggacattactttaaaattaaaattttaaaaggttaaaaaaaaatcttggcctccccccctctctctctccactaaaaaagcatgttcgtttgaagctccattgttccactccacggttcaactaaccaccaaattaccagactacccctcggagctcgaggccaagggccgccatggatcgccgggacatggcgagccaccgcggccggagttccactcgtggccacggatggggccgaggctggcgaggtcggggagaaggccgcggccttggtctcagccgcggcgccggcccctcaccgccacctcctccttcctcctccacctcttccttcccggcggcggccagcgccaccgcggctggtaccggcggcgacgccccgccgatcgtgggcagctgccccgacatgtgcccaggtaacgcgcttcgtccaagcctcccgtgcgctcacgccgacgctggctgacctgacctgacccccgtttggcggggcgaattgccccccacctgttcgacgaaattgcgcgatcagttggcccctaattggatggatttggttggcgcgttttagctcatggatgctactgttttttttcctgctgcagcgagggagagggcgcagagggagcggctgagggacctggcggtgttcgagcgggtgggcggcgaccccgcgcgcacgtccccttccctcgccgtgaagaaggtgagccatccatttttctccgtactcatgtggaggccattcctgattttttttttctttttgaacttgcggttgggtcgtggtgatgcttcactgctggtcatttttggtgcgtatctgcttggattgttctctccatgcaaatggacaggctatagcttggttccattccatgtggtggtttagtctgttttgattggatttgatatggagctggaagcttttttttgtgcatgcaactgtgcatgtatttttgcttaaaagggtgatcagttgccgttaagcatgtgttggaacaatcaacactttatgttagatgtagctatatagttacatatgccaccaataatgcaataacagcaatgcagcactaaatctgatctacgcttgtcttgtccaatcactgccagagtgtaaggaagctattcgggtagcctagccttcaagagattgaatgtacgatagtgtcagatttatatttattttgtttgatttctttttatagtttattggatgaaatataaccctacttagtacttaccttgtactagtatttttgcaggggtgaagatatgatgaaaggacaggattatcaattcatttaatacttatttttatcttgaatatgtggtcatgtttgcagataaaagaaagcaatgtgcaaaagcagattatgattttttttacattatttatttagcatgccattgttattaggtaaaaagagcttgtatcaacgaaaataatagttatacaatgagatatcatgttctgcacacttgaggtgaaactgtcggaattcatttacttgccactgcaaacttgagtaaaaatgccactgaaaaatcataaaaggtgtgtaagataatgaatctttaccaaccacatagaatagccaatttgccacctgaaaacactgttataattacaaatttgcactacagtttcatgtggtctgaaagatttcatgaaccgcgtgtgttttaagagaatcaggtagctatttgagaattctgtgtatctccgttccttttctaacacttggtttcctgctagttttgcagaactatctcttccacgagtgtacaggcatcagatatacgccctctcccagtcctgcgagaaacaatggattatcttttgcatttattggattcctcagagcatcagtttgagatagttcatgattttatatttgataggacaaggtctgtgaggcaagacctcagtattcagaacatagtgaatgcccaagcaattcaaatatacgaggatgtggtacactcatatcatccatgtttttatcttattgtatagacctctgaattttagggtacttatttgtctggtttagattgttgtgtctggaatctaacttttaacattatagaattgagcatccttatactctatcacagaactactactcaacaactttctctttgttttccttgtaaggttatgttccatcctttttaagtagttgaggccagaaaattcactcatccaaactcttgttagatagagtaatactcgatatgcataaaatgttgttgaggttctcgccttttctctctaattggtttgggagaaagtatgtttcttttccgattatgcatgaattagttctttcaggcattttctacttggcatctgtgttagccactaagtggtcctttttgttcgttagatgctgttatcttttgatgttatgctgccggatgtcattttgttaaggtggaggaacatatttgcttcaagtgcaagcatatagggtagattattcctctttcacagctttatctgatgcatgcccctgccttctgcagataaagtttcatattctatcccatcagaagctttctaggtcttcccaggattctgatgcttcttccctgtgttacctaaacatggagcagctaatgaagtgccttctttctctgtttgatatgtatgatgtaattcacaagaacaattcacagagtagtaaagagactgaatattattccttctacgtgcttctacatttgggctgcaagatacccaaaatggtttgcccccaatttttattgccttctaaataatctaatttatgttattctcttgttgccaatactttcttcttactccagctagtgaatagtagcctaatttcctgtttatctccaggtagattcactctctttgtggtatggccatctatctgcttcaattatacaatcaaaggaaatggtatttgctagatctatattaaggtaactttatgcatattatttgtatcaacatacatagagccttcatttttgtcatgctct

SEQ ID NO: 15710 - DNA, 881 bp, Oryza sativa
aagaactcactggtacagctaaaagcatattaatgaaaacacaaacaatttgtcctttattcaggtgtttgaaccaacttattatgataaagttatattctacacaaatcttagagcttttcaaagcaattgagcagttcattgggaaaaaaaaatacaactatgaatgacagaattgtgcagatgaagaaaaatctaaataggcaataccctagcatcatggacagaggaaattagagaacacttactgtaagcattttagctgggtcaaagttactcataggtggagatgacccaaatatcctatatggcagttgtagcatcggctcggggaatggcaaatcagtatgtaattcttctatcagagaatgagggctggttggttctctagggccattgaactcagaagttcgagcaaatcccagaaccagtttcttggccaatggatcatgcatctcatcagttaacttgtaggcaaaatttcggtctgcgcaccagacatttatctgaaacgaaagaaaagggtaatgagtcattcaatagtagcaccaattgagcattgatagcttgtgtagataaaataaatacatttcctacactatatggaagttttgaatacttttaatactagagtagcctaagaatactgtaagacaactccatacacagcctgatgcaacatacaaatgatagaactgggaaaacaagtcatcacataaaataaaggaacttaccggtggtgctctagcaggtggaataaaagcatatgttgaacgaagaagtcttatgttagacacaagcctttcatggtgagaaagcactagtgcttcatatgggctatcactcgggcctgtctcaatctttgttcttaggaaactgga

SEQ ID NO: 15711 - DNA, 1790 bp, Oryza sativa
tggttgcatgttacatacatttgctacaatgcttttgttatgaatattgtgttatgcatcctttctcagttaatatgcttggaagaggttctccaaggttgaccatgcttttagcgaaagctgcacaaaagaagaactctctgaaaggtcgtcctacaaaaaagcatggaggttctccaataggtatgcaattatagaacatgtgaaattcatgtttgaaattattaaatgtagattatacatcaattcttatcttgtgtagaaaaaacaagagcctcttggaacccagccctagagaagattcttgttgagttattgcatgagcacaacactcctgagtataggggtcagaatggatggacttcagaagcttggaacaaaatcgtgaaggaattccatgagaaggacatatatgtctgcttaacaaagtcccaaatctaagaaaaggagaaagagctaaaaagagaatataggatgctgaaagaggctagaaaacaaagtggagcttcatggaataaccagagatgcatcattgaggctgagcctgctatatggaacaatataatcatcgtaagattatttctgaccattacttaattttgtagttaattacattatgcatcatttagtgttttccttttattgtgtagtcatttcctaaagccaagaagtttcgcaccaaatctttccctctatttgaggccttggagaactttacgatggttagttctatcacaagctataatccttgttttcaatatcacaagttataatcatgccttcttgcttaccctttcctgtactcaattttcttgtgtaggacatactgcagaaggaacctacaatttcacctcaattgagccattgcaacatccaatcattactcaaattgagagtgatcaagatgatctcggtaacactgagattatctttccagattatgaggacactttggcttatcaagtacaagatgatgcagatgcaactgaagatgataatgcaaatgctgaaaggcttaaagagatgccgcaaagaagggttgttgctgtaccaagaaacaaagaagaaaaagaacccaagaggcaaaaaaagagtgttggcgtagaaggacttatggaaaggtaccttgatatgaggaccaaacaaactgaagatgaggctgtacaattagcaagagaaaaggaggctcatttagcaagagaaaaggaaattaatgatttttcaatcaagaggtgcatatctgttctgaattcgatggatgtgacaaaggcaaaaaaggtcaaagcatataccgtcttcaagaatgcagagaacagagagatttttgtgagtgcttgtgatgaggatccagaatctgccttgagttggttaagaagtgagatggcttgataggtacggcttctcttccatataaatcttttttggtctgctaagcgagtaagatgggcttcactctgtcttgtgtgactctctgttgttagttacctgcatgttgtttagggctgtaaaccatatacttcatcctagcaacaataggtgcaagttatatactgtacccttcaattgatttccttgtctttgattcaccaagaactagttctacctgaagacaaagattggtactgtatgatagatatgcatgttttatggttctagattttttgagaactcatgttcaagtcttttctgcattggccatatatttatctgttatacatgatttctgcatcttctgaaaattcaatcatttcaagttttgtttccttttatctgtttgtgagataggaaag

SEQ ID NO: 15712 - DNA, 52488 bp, Oryza sativa
  unsure (1)..(52488): unsure at all n locations
tttttttctttgtacccatcactgtttttcctgtgcttctaatctgcaatactgtcccagcaagctttgaagcgttgttgctcagattagctgctcattacagccattgtaaatgaaagctttgacgtaattcaggtctgattacagccgactgatagaacaaaagcaggtctgctcggaggagcagccacgggatttatcatattttgatagctaaaatccctggctaaaacgaacatggggtttaagagagagcaaggaatttcaacccccatagggattgagtgacatgggagggattcactcaatccctccctggatatattccacttggagattaaatcccaaggaaccgaacaaggcctcaagcgggacaagctgcttgagtagcacaagttcactcaaatagaactttaccacttgaatagtgttttcccaatcgctagagtcttttccgagttggatacttagaattctcaagacctcctttcccttagtgttttgaccgaatgaggagaacggtgtttaccccctgctacaacacaccggactgggggatttttgccattgcataaagggattcattccataatgctcaccacacatgtggagagggttgggaagttggcgctgtgaagtgggacgacaatcatcgacgacgaggtgaggggcgtgatgctaacccgccgattcacgtccacccaccgcatgggactgtgagaggcaacaaaatgctaggcgttggctggcggctagttctggggtgaactacaagctaggggccaatgatgaaagggcaaagctgcagacagcagaccataggaacacactcatcgagttgcatcggttgcaggaaccgtgagcccaagccaaccgttagtggctcttgtgtgcatcataggcctagtgcgcaaaggctggtaggatggtgacatcgtggttttggggccagcttattgacttaaccggtttaactatggtcaacgcgccatgtcaaccgaaaccaccttcaaaacaacaggggaattgttttgcacttgttttaatacttatggaggcaataaacccggttttatatcatagggatgcgaattggattcgactgatagttgagagagccaaatagactttttcctaaacctagctgggtggcccgcgcaattgcgcggctagcaaaaaaaatcatatatttttttaagtatgattttacttgaaatttattaaatagctatctcattcttaagactatgaaagaccaaaccttatcatcatcatgtttctaattatatagtttataaaaatcacactagttgctaccccttatgtcatctcctttatttgcttgctcgatctatcactatttctattcattcttctgggaacttttaaaaattggattttacagtttttagagtttattgtcacgttgggtttcatttttataatttctagatgtctcgtcaaacgttgctattatactcctctacggctcgtccactatctcttctctttattgtcattaattgagattttaaaaatcgaacataattatagtttgggttcatttttactttctagaagtcccgccaaactgtcagcggttttgctattgtactcctctacgactcgcccgctgcctcccttctttattgtcattgggggtttaaaatcgaacatgattatcattggtttttttactgtttagaagttccgaacctttaaaaattggacttatagtttcattttttacaatttttagaagtcccatcaaacgatgccactatgcccctctgcagcccatccgccacctactctttatgtcattgtgattctagaaatcgaacataactatcggtgcaattcattttttattttctagaagtcctgtcaaccgtcggaggctctgtagctatactcttatataccccgtccgctgcttctcctttttattgtcattgagattttaaaaatcgaaaatgattatcaatgtggttttttttttactttctagaagtcccggcaaccgccttacttgtttgcttcacggcatgcccgacgtctccttttaatcattattaggattctatttggtgttttattaacagtttttatatgccgtatcaaccgccaccaactctattcttttataggcctgttacttaatttatctcgtcatgtgttttagatagtcttttctttcaatagtctttatttttatcacaatttttagttatttataaattttattcctaattgaattttttttttctaatttcagagtttatttttttaaaaaaaattagttaatactgtattgtgttcttttaatgtttttattttttattttcaatttaagttgttttaaaattgtattcctacttgaactctgttttattttttctaattttagatattattatatttttatttgaaattttaattaatctcgtattgggttcttatatggattattctttcaatattacttattttaaattccgaatttcatctaattttaaattgtattcctacttgaactcttctttattttcttttgctaattttggatttatttttatttttattccgaattttaattaatcttatatggactcttcttttaatattccttatttttaattccgaatttcagctaattgtaaattgtattcctacttggactctcgtttccttttctaattttggattttattttatttttatttcgaattttgattaatctcatattgggtttttatatggaaatttctttcaatattggttatttttaattccgaattttagctatttttagattttatttctatttggactcgccttttctttttttttctttttctccgattaatgtgggaatttctagcccccacagcagacgtggtggctcctttcaaagctgttttaataatatataatagatagataaaataaaaggtgccgctgctctgggtttatttgggctgaaacatagccaactggacttaacttaagtaggctgacgtcggtatgttttgggctctattgggccgcgctttctattgggctgtgaacagtgggcctatggcaggttgcctttccctaccatttattcaatctcaatcatgacaccgaatcaattgtttcacatttttatttatcctacaaatttaatctattcattgctcatccaagaaaaaaaatgactgacaaatattaaacctgaaaattttaatggacatgcctaatcaaaacacacaagtcaaccacattaaagaacaaaaacctgttgttaattctttcctataggtgctatacatcaaaaacagggtgagtgatattttgaaaggagaaaggagagggtgagtgatattaattttgcagctctaaccacatctaatcatggttgattaatcatctctatgttccaactccctccccagaagccattttcagctacttcttgttgttccccctaaacctgctcttcaccaccctcgtcgctgtcgttgtcacctccttcagcttctttctggctactctctctgtctaaattcggggctttgatcggcagaggctcaacgtcatcaggaggatcatagtttgggtcagctagaaacgtgagcgccgtcaccacgtcgctgatcagaggccggctgctcgcctcttcttgcaagcacatcgatgagattgccagtgcctggtacagccctttcagtgggaacttcatgtccagcagtggatcagccatcttcacgaacttcttcttgtccctgaacagtggcgctgcctgcatttcagacatacagtataagatcaccatcttgattctgaactgaacgagaaattttcattgactgaattctgaatctctgatctttttttcacgaacacgtcaatatattagaaaaagagcagcatacaactgtggcacactgaggcgaatataaaggaatgttacccagtgaacaagaatctgctcgcgagtgggcttggtggtgtcgatggctcggcggccggtgatgatctcgaggaggacgacgccgaagctgtagatgtcggacatcttggtgagcttgccggtcatggcgtactcgggggcgcagtagccgtacgtgcccatcaccctggtggtgacgtggctcttgtcgccgacggggcccagcttcgccagcccgaaatccgacagcttcgcgttgaacccgccgtcgaggaggatgttggacgccttgagatcccggtagatcaccggcgggttggctatctcgtgcaggtactccatccctctcgccgcgcccaccgcgatcttcatccgcgtgtgccatgacagcggcgacgagttcggtgtcagatctgcacaaaaattcagaacaaaaaaaatcatgaactttagctcaaacccgtctgcattttgctatgcagatgtaatgatagttactatacctaggagatgatcttgcaatgaaccgagtggcatgtactcgtagaccaggattctctggtcgcactcggtgctgtaaccgagcaaggtgacgaggttggggtgatggagaaggctaagcatcagcacctcgacgaggaactcgcggttcccctgcaatccatccttgtccagctgcttaaccgctatgacctgtatgaacatggacacaaattcacatcagatacatgctactgatgcattcatcagtcatcactgaatctttcagggtgtcaggttgatgaagagactgaggaaggacagttcacagttaaattccgttcaaaaaaaaaaacagttcacagttaaatggtgcttacttccttggtgtctgggatgaatcctttgtagactctcccgaatccaccttcaccaagcaggttttccgggctgaaagagccggttgcatcggccagctgacggaacgtgaatactctgcttggaatgttgtggttgccgatccgtagtatctctcctgccgctgccctgttcctggtactatctgcacgaacaaagtttaggatcttgttagcttatcagccgtaaccaaattttaaatttcgacactccaattttagaattgattttgaagtttcttttttcaatgtagatttttttttcaaccttacctaacacagttaataatacaaatataaaggttttactcataaattatttttagttgctttcctttatttttctctgacttataagtcatagctcaaaggtgaaactaggtcaagagcatggtaattttcagatgaattatacatatcacattttcgcctttataagatataaaaggagatatttttgctatttcggcacgaagaaatcaggaaaagaaaaaagggaagaaatggtagtatattttattactctcgagggagatctccttgacgaggctggccaagccggtcggttgggtcttgcccttcttcttcttccaattcttcttggtcccccacttgttcttctccagctccgggctcgtcgcggcgctcttcctcttcttcatcgtctccagcgtcagcggctcctccgcctcccgcgcggccttgccgaagacgccgcgcaccacccacttccgcttcttcctcttcttcgcgtccgacgccgccgtgtcctgcgccgacgtcgtcgcccccccgccgccgccgcagaagccgcggatccacgagcagcagctggcgcagccgccgcgcacccaggagcagcagcagcacgacctgctcgccgagctcagcagccccatcgccggatcgacgcgagagtgggcgagcaccctcgtgccgacccccgcgcgccgccgccgacgccgacgacgacgccgcggggtgacgatctcctcccgcggcgagaagaacacggcatgcaaggcgctggaaaaataaaaatgatgttctatttttttttctctgtggatgggaatgagcctgccagactctgtttttctctggattgataaaaatggaaggcctgaagccaagtgcgtctctgtgtttttaatggttgttaattttagcaacactgttatttccattccctaatttttcgcattaaaaattggtgttagtttctttgccatggttgatggttagccgaggatgtttgcatgatagggattaaaacattggaaaacagtctaaaccatttccataatcatatttttctcgaaaataaaatcaaaaacagtaaaattggaaacgaaaacaatatcgaaaatattgaaaaattggaaaaatacggaatgaaacatgacggtacatattggaaaacggtagcaaatacagaaacattaaaccataaaaacgtatatttaactttgcataactatgtaatatatataaataattcaaatttatactatataaattataaattaactccattttagacatgcattcaagttatgtatttgattgaatgatcaatcaatctaaattgtaggtcaagtagagacatactctataaatatataaatatatagacatatttagaagtacaacaattttaattttcacaaaatcacgctaaatatggaaccatttccattttcaatattatttattatttctattttcgttttggtcgattaccattttcatataactcggccggcagaaagtcagaaacgaacgccgatcggccagaaatttccattacctttttctgtgattttataatccttaagtgtcgcaccccaatctaataccgccgtacaacggcacctgacaggagcatgtcatagggaaaacggcgcgaaccgcttcctacgaaaccgcgatctcggtaccagtcccaggacatagtgctggtacccacggtgacaaatatgaatcatagcaatccttaaaataaatagaggacttatttaccttaacaccaacagcagcagcaacagcagcggaaccaacggtctaacacccaacaccacaggcgacggctgggaaccaggacgaaaccctaatcttcacttcactttatcttctcttcagggcagaggaactatatatatatatatttatatagagcaagggtgagtactttcgtactcagcaagtcacgggaacttaggtggttaatgcaagcttggaagagaggcaaggttgttttgcaaatcttttgtttgaaatcattttgaaaccactaagtgatttatttctttctaagtttgggccgaaaagagacttgcgtctcgattcgactttaagagatgtttttcaacagctcatttagtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttatccacaagatacgaacttattccgaacacccgtcggtatcggaggttcgcaacaaagcctttcccaagccgacccagggatacctcatgccacatagaaggatcaaatcctcacataaacataggccattttaggcgttcacaattcaaactccaaccacctcgatcggtaattcagcaagcttctcgttcttgcattaccaggaacccggtttggctccaaccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacacgcttagagagcacgaataccgaggtaccacaagggtggagcgacaaggaatcagggtagtacgacctacggaaattagtgcgactactgggtaggtccgtcggtttgtcacgcaaaccgaggccaagcaagttaagtgtgtgattctactaatgcaagttgaaaacaaaataataatgaatttccaattataggagcaaatgatcaaagggtgactttccttgctcaaggtcttcacgaagcttcacgaatcttcgagaaatcccacgatcgacaaaaatccggtaaccgcaactatacgcaatcaatcaaaacctaaacaaaagaccaagaaaaggatcctatttagactaaataatagtgccattaaatagatctcaattttacgggaatactggaagtggaacggggttaatcggaattacggatcgggagatatgaattttgggagtttaattggaatttctggacaaggaaatgatttgtcgaaatttttttttgaatgcgggcaatgatttataaattttatagaaaagaatattcttgagaattgacacgtgggaccaacatatggtgagagaggtgaattgggagggagcagatatggacttttggtcactgcatttgggaagggagcaaagatggactttagcttttgggtgggggtactgggctcggcatgagggaatataactggactttggttgattggaccgggggagcagcgcagcccaacggctggcgaggccgagagagggggggggctggctgacggggcgtcagcttgacccggtcaagcccacgtggacagccacgttggatggaggaaagggaggggaggccgggcggccgatctgacggctgccggcgagcggtgcataccggcgagcggcggtaaaccgggaggggcggcgtgcaccggaagcaagcggggatcaaggggagctaattcaacggtgcggatgaaggagaggtggcgctgcagcggctgccgaggcgggcggccgcggcggcgcgccggggaggctcgagagggctcgggggtggtgacggcgccgggaatcggcgagagtccggccggcgacggcgcgcgacggcgcacggcggcggcggaagcagagctacggcggggcggcacaacactgagtggggcgtcgccgggaaaacagagagggggcgcgagaaattacgggaggacgacggcgagctggttagacgagagagaagggccgacgacggcgcgcgactgctcggtggcggacgcagcaccgcgtgtggtacgaggaggaagaagccggtgatgcggaaacagagcgcacggcgagctacgcgagtgcggggacggcgaaaaaggaagctgaggagctcaccgacgggaggaacggtgtcgccggcgaattggggatgggaagggttggaaggctgagggtggcacgcgaccgagcggcggcgcacggcggatgacgccgagccggcgcggtgtcgaggcgtgtgcgccggggaaggagagatggagtgcggcgatgggcggcgcagagctcctcgttgactcctcgtgcgcacgtcggcttcccggcacgcgcgacggcggaggaagggcgacaatggcgcggcggcagagggaagtaaaacgggaagaaaagagggggagctcgggcttgggttttataggtgaggaggagaggtcggtttggaggagggaaaccgaccttggcggtcgagcgctcggctggcgctcggcgggcggtcacgagcgggagcagcgttttcgcgggctgcgcgaaacgtggcgacggcgaggatgcgaaggggcggtggaggcggtggatcgtacggcgggaattgaatcgcgggcgcgggagcatcggcgtggcgcggtcaaggtgggggcacaggcgcggcaggacgttgtcggcgtcctctgcctccgcgcgcaagaagacaagggcgagaggagagaggccgggtttagaagggaaaaagtgagggaggacggtggaaagggaagcctctcccttccgttttgggcggcgggcaggcgaggcgcgtgggagcggcgtccttgccggtcggccatgcgcgcgagaatcggcagcgtggctgggattttgggcggcgtcggcgggagtcaatgagagagagagggagagagagagagagaaagggtgagagagagcgaggaagaaggagagagcgagcgcacacgcgcaacgcacgtgcgagggggaggaggaggagcggctgagaggagatgggccgagggaggcaaaatagactttttcggaggagattgattcgaagagaatttgaacttggaatttgacttagattttggaattgggatctggatgagaggaaggagtagacggaggattcaagatggggttttggatattttggatccggggaagtattttggcgatgattcaaagagagggatagaatttcagagtttgatttggagacttgagtcggaagaggaatttcgaggaggcaatttttgatggtgacgagagggatcaaggacggatttgaattgagatcttggcacaacttagactcgcatacaaagaacggaaattttcgcatataagattttgccgaattagtttttaacgtctcacgaaaagcggagcgttacattaaggtactaggaagtaccatattttctagtataaaatttgatatctctcaatattatttccagtaataggagatatcaaatttacattaaaaatgttggtgcccgttgctacctcttaacgccggtaaaatttctctttgttttttttttttgtcaaggttctgattttgataattgtcaagaactattatccagggattattgcagtagtattgaagaataaaattgtccagaacgcacaaaatcatatatagtactttatcaccagctattttgttttcaaaacatttcattattcattatttgttttgatcactatctcgttgcatgcaacacagcaacggtgtgatcctactagctatgaggcaagccagctaagcctagtactggccggcggcgaagatgctgcactgctggggctcaacccggcacatcgacggcagctgcgccgcgtactgcctcgccctggtcagcctcacgcgggtcatccccggctgctgctgctgctcgccgtagtagccctcctccgacgacccctcgccgtagtacccctgctccgacgacgacccctcgccgccgtagtactccgacgacgacgacgaccagccttgctccaggggcatcggcatgctctcctcgtagctcctcaccatccggcggatggcggcgcagcggcactcgcggctcacgtcctgcagctgctggcagcactgcatccgcaggccgagcgcgcccgggcggcggaacatcggctggaacctctcccggccggtgagctgccggtcgagcacctgccggcacgcgtccagcgggctgtcctgcacctcccgctggcactgcctgtccctgaacctcatctccgactcgctcagctgcgcgccggagatggccaccatggccgccatgagcgccgccgcgaagaagacgaccttgctagccattgatgatcaatcagacaatcactagaagtgtatatgttttttttcctcttttgtttgttggtgatgaactgatgatgagatgatggcgatcggatggggttttatagggtttttgtggccatggttgtgtgcacggtgagcttcgtgtagatcaagtagaagcttgagggtgacatggatcggttggaaaagagcaagagagcaatgctgcaaagagtgaaaaaggtttccaagatttggagcttgcaaaaagatttttttttatttttctcttggtgttgggtaatttctgaagttatgtatgtggcagataacacttttgtgtcacctatttttgtcataaagagcggctttacgtttgcctctgataaaagattaatggatgtatctacactaatgagattgtcctagggataactcttagctctttgtgacgtggtggaaatgtgcagaaaatgtgtgtaactgcgcatgttgcttgttggtagtagttttgtacttttatgggtgactgaaagaaggcaattatctattttaaaaaggccctttaatttgaggaggattggaagcccacggtatatatggctcacagaatattttgaaatggaataagttcatttaaggtcccttaacttgtcaacaaatttgattttcgtccttcaatcgaaaaaccagatacaacgggtccctcaactatcaaaaccagtgcagatgaggtccctcggcggtttggatggtggttttggctgacgtggcgcttacgtggctaatttgactcggtcttcatctgacgtagcattgacgtagcgcttacgtggcaattcgatccgaaaaataataaatctcatgggacccacatgtcagtttcaacaaaagaatgaattaaaaaatggtggggcccacatggccccacatatcattgtcacccctcctcttcttcctcctctctcaccatctctcccctctcctccctccaggcgccacggggccacggggaggtccggcggcggcggccggcgacgtgggagaagggcagtgggcagggcgtcgcggcgggagcgctgggtcttcgctcacggcgtcggcgcggaccccgcgcgggggctcgtggaggagatcggggccgcggcgcgccgcccgtctccgacgagctagagctcgtgcgagcgcagtgccgggagctgcacgactgccgacgagaagcagaggaggttcgaggtgtacaggagcaacgttgagcttgttgagaagttcaactccatgtgcaatggctacaagctggctgacaagaagtacgttcgccgacctgacgaacgaggagttcagagccaagaagatggggttcagacctcatgtcgcaattcctcagagcaatgcctggagagagcagtgatgatattctgccgaagagcgtagattggaggaagaaaggagcagtggtggaagtgaagtaccaagaagattgtggtgtgtgagcaatagcatggtaaagaaagattcaaacctgtaaaaatgttggagattaatcgatggaaatctgggtgttgtgtggatgcaggttcttgctgggcgttctccgccgtggcggcgatagaggggatcaacaagaacggtgagctggtgtcgctgtcggagcaggagctcgtagactgcgacgacgaggccgtggggtgcggcgggtacatgagctgttcgagttcatcgtcggcaaccacggcctcaccagtcaccacggaggcgagctagccgtaccacgccgcgaacagcgcgtgccaagcggcgaagctgaaccagagcgcggtcagcatcgcgggctaccggaacgtgacaccagcagcgagcccgacctggcgagggctgtggcgacgcagccggtgtccgtcaccgtcgacgccggcaacttcatgttccagctctacggcagcggtgtctacacagggccgtgcaccgccgtccgccgacgtcaaccacggcgtcatcgtggtgggctacggcgagtcccccaacactcccgccactgacggcccgcccttcccccgcgtcgtcggccgccgccgccagacctccccgtgaccccgtggcgctggagagaggagaggggagagatggggaaagaggaggtgtgagaatgctacccaccattttttaattcattcaaactgacatgtgggtcccatgagatttattatttttcggatcgaattgccacgtcaatgctacgtcagatgaagaccgagtcaaattagccacgtaagcgccacgtcagccaaaaccgccatccaaaccgtcgagggacctcatctgcactggttttgatagttgagggacccgttgtatctggttttcggttgaaggacgaaaatcggattcgttgacaagttaagggacctcagatgaacttattccttttgaaatctggatcaaaatgtagacttcctggtagccccaacattaccgctatgggccacggatgggcctactgtttgggcccaattgggtctaatattcaggcccaaccgcccaagagcaacgtccatgttgggccggtttaatggtcacatctgccttcagactgctagcaatcggcctggttaaccggtttaacttccatttttttaaaaaaaaaaaaatcctcgtcaactaaaaaaaaagtgactcgtcccagcctcgtgaagtattaccagttcatactttggctgtgctaatcattggcaactccgaaggtgaaatctcgttgtcaaatgacaaaagtgatttaagtgatcaatcattctactcgtgtgtgcaggcagctagcagaaggccaccggccacatgcactgatgcaccatccagtttctttaattcttagcatctctccaagcagcctgcagttagcagagtgtactggggacaaaagaatcggagttagatagcacaggttaattagcttccagaaactggaaaaaagaaacggagcaagtaagctagctagctaactaaaacagttcagttcactgagatgatgagtcgccattgctgctgtttctgaactgtctagtgtctactagttgcccatgtggccatgagagatgagccccccgatgaaagctggtgtttgtttctgcttctgcctacctgctatgccttttctgaacaaaatgataccacttcaactacctaacagtgtgtccactggtccatccatctacgagttgttgcaggcttagccggcgacccggcgtctctcgtgcgtgcggatgattgatcaattccagcgcggcgacgccgactccgccgccggatgttcgatcgatcgcttctcatatcatcgtgtattcgtggtgatcgctgatcagagctctctttcctgttagttgcacatgtgcattccggctctgacgactcaaaatgcatcgtcagctgctttgagttttcagtttgttcgtttctcctttttgttggtgactggtcgtctcgcttgattcaacctagctagctatagctttcaggtgtaaacttgagctggatcggagcactctctgattggattttcagctcgccggttcactgtgttcatttatttcaggatttgaaaaaaaggggatagttagctaggaatggctcagctgacggacaacgtgttgtggactcatcgatcaggcctgtcgcgtgcaatgaacgatacgtaagttaattcagtacataagcgtagagtttgtactttttgcctactactacttcggttctgctcatgattcagggttcaggacatcgtctggatttctacattcaaacaggcaaatataaccagtacttagtgtagacggattctaatcacccagtggacattcacttgtttattatatgtcaactaaatagttataaaaaatttttaattttttttgacaagatagattaatatgtaatatatcattccacaaacatgcaagttgaaatttaatttctataagtcgtaacaaaaacaacaaatttaactgcaaatatacatatactaatttgagttttatttgttatttttcttttacaatttgtagaagttaaattttaagttgcatgttacgtttgtggagtgatatattacatattgatttatcttaccaattttttcataattatttagatgacatgcattaaacagtgcacatccattcgggtgattaaaagagtttccccataataatcctaactctcgttctagaacccaaatattaaacttatagcatatttgtcatttttcactccttaaatggatgttccctcgtttctcgcatgctatctaaatagttatattttttaaataataataataataataataataataataataataataatatagatcaatatgtatatcattctacaacatgtaggtttaagttcaagtcatttttttcataattgtttatacgatataaataaaacaaggggacatctgaacaaaagagaactatctcagaagaaagcagcattttttttaactcccattctagtactgaatcttgaacccaaataggtaaagaggttaaacggcacatttgccatttttttactacattttcacataactaacttatcagaagcgcaggatggtacatgttctccctccgtttcaaaatatttgacaccgttgactttttagcacatatttgaccgttcatcttatttaaaaatttttgtgaaatatgtaaaactatttgtgtacatgaaagtatatttaacaataaatcaaatgatgtgaaaagaataaataattactttaattttttgaataaaacgaatgattaaacacgtactaaaaagtcaactgtatcaaacattttaaaacggagagagtagttaattaaggtgtgaaatggtattgtttcctcgggcattaatctttgtcagttgctacagcctgcaacagtgcacatggcttgaaccgatggttacaggccacagaaaaaaaaaagggaatccaagtactttgtctgatcatcacctctaaagttaatcaacatgacagcatgtggataatctcccacgtcctctcagttgcggttcagaagttcacagcgagaaataaattactcttcaaattgaccaactttgctttagattccatgcaaagcacacgcctacaggatcgatcaagcagcagagacatctcgcactgattttgtcagtacaacgtacaaaaatacgttctcgatcgacgaattcttctcctcatctctttcgctgctgctgctggcctgctgctaacaaccagtaggtgctgcattcttgactcctgcccggcgcccgcgatgatcagaactccacaaccaactgtttccgtagccgattttaaaaaagtttttgcagtacaattggtacttcgttcttggatggcaattagtatctgaatgcgtacctgctacaagaaagattcggcaaagcgaaaacaagaacagctcattgtgccatttgcataatttgcatgcgtgattcttcagaaagtgcagctagcaggtagctaagccagcctaccacatgggggaatagggacaggatgggccaggacggcgccgcgctataaatctcgcgccaattcttgcccgcaaattcagcagcagcagctaccagcaacaagcattctcttctagccttagcctagctagctagctttgttgtctagctctgatcgaggttggtggtgatcatggcgtcgtcgagggtgatcctagcgctgctgctcgcggcggcggcggtgatggcgtcgtcggcgcagctggacgagaagttctacagcaattcgtgccccagcgtggaggccgtcgtccggaaggagatggtgcgcgcgctcggcgccgcgcccagcctcgccggcccgctcctcaggatgcacttccacgactgcttcgtcagggtaagctgtgcatgcagtgtccattctccattgcgtcgcggctgctggtgtatagtagtagtgttcgatcaggtcgcctgacaacctcgtcgccggccggcgtcgactgtctgtgcatgcagggttgcgacggctcggtgctgctcgactcggccgggaacagcacggcggagaaggacgcgacgccgaaccagacgctgcgcgggttcggcttcgtcgagagggtgaaggccgccgtggagaaggcatgcccgggcaccgtctcctgcgccgacgtgctcgcgctcatggccagggacgccgtgtggctggtgagtagagtatagtacactgcaatgcacgcatgacacgtgtactctgacacagtttgcagaagcaaaaagttctcacctcgacttgtcgtcgtcgttgtcttctcttccagagcaagggcccgttctgggcggtgcctctcggccgccgcgacggcagggtgtccatcgccaacgagaccgaccagctgccgcctcccaccgccaacttcaccgagctcacccagatgttcgccgccaagaacctcgacctcaaggacctcgtcgtcctctccggtaaccatcaccattgccaccacacaaactctcttcacacacgtacacacatccatccatggtgtctgacacgatccattgtcgatgttgatcagctgggcacacgatcgggacgtcgcactgcttctccttcactgacaggctgtacaacttcaccggcctggacaacgcccacgacatcgacccgacgctggagctgcagtacatggcgaggctgaggagcaagtgcacgagcctccaagacaacacgacgctggtggagatggacccggggagcttcaagacgttcgacctggggtacttcaagaacgtggccaagcggcgggggctcttccactccgacggcgagctgctcaccaacggcttcacccgcgcctacgtgcagcgccacgccggcggcggctacaaggacgagttcttcgccgacttcgccgcctccatggtcaagatgggcggcgtcgaagtgctcaccggcagccagggcgagatcaggaagaagtgcaacgtggttaactaatcatctctcttaattatcgtcatatatcatcagctgctcgccgagactgtgattatggatttcagcttttgattccggccgtgaccatcttataattaatttccatgtagatcattatcgtaagatttacctgtcccttctttttttttcttgatttcaatcacttcattaattaattgttttgtttatatagcgagccatgcatgtatgtaacaaagttttctccaagtacgtgctcatcatgatcatatgaataaacttcattttttttcaccttgcattattatacatttattattttttatcactcattggtgcctctatctctttgtcagacagttactcagttatgatgccactgtcgtcattttaacatgaaaactagtaaaccaaaatgagtcattactaaagctgtaacacacagcaacgcatcacatgggttgcacatctgatcattcgcaactgacaactataattggaggaacaatctggtcaagaatggactcatctatcatgcgtgccatgacaagtgttccagggcaatttgataattgatatgctgttcagtactgtcagcagagtcccacaaacctctctggcgccctgcattttgttaaccccattgtgcctgcagctctctggcctgaatgtctgtccaaactgaacgacagaaacatttcttaagtagctttggtcacatggcatgcacttacgaaaatgcaattgattattgctgatcatgatggcatctatgacaccaaatcaaattaaggccggtacgaacattggctattattatacgcgaccggcctgtatagtatgagatgggtactgatcagtcctgacaccctgagtgctatctgcgatctatatttccgtattgtaacttcatcaagcagttaataattcggcaaatttagcatctcccacgtttaactgagcactggcacacgaacctacacatatgccatttacgcgggccgacctattcaaaggaggtatcaaaatttataattataaaaaaaattatatctctcgatatctctctgggacagtaaatttttttcgaaatgatttatatacgcatgttcaagggtccttacttttatgctcggctgctcagggaccttgaaattggaagaattaatcttaacaacagattagaacgacaaaaccgttgatggaagagctgctaacgtgttgtaaaccaatacgcttattagtggatcattggatctgttccttgtttttcgcacaacagtagaggcgtaagaagatgtagaacacatatgtccttttacttgtcctcgagaatattgcagaaatagacaattgacatagagatatagaatagaactctctcttattagatttgttctcaagactatctaaaaaattgctggaaaaaactttcaaatctaactatagtataattataatataatttccactataactatagtatgacatgtatataagtattaaaataatatatgcaactttatatctaacttatatagagattacaatatagttacactatagttataatattacactacaactatactatagttacatttaaaagtttttttgcccaaaaaacttgggacggttttttagcaattccgtttgttctcgtgtacaatcaaccatcaatgtctcatcctactctctacatataatatacaagggtcttaataggagataaatattactatctttactcggctttaaattggtccagaagaaacgaactttatctccacaggagatattattttccaactttgaacacacacctttcaacataaaatccccacttgagctaactagcttgtccatctaggcccaatatggttgggcctgggtgacccaattcggcctgtctctcccaactaaaagaaacgtacggcctcatctgatacaacccaactcctcaaaggccccaacgctttccctcgcgaaaacgccgcgccaccgaacaccagcagcaagacgcgtccgcgaacgcgcgccctgggccgaacggttgccgcactacagaatttttttcggttttagatcttttggccgtactttttttcatctgggtcccttgccgtcctctattagggcggcaagggatccagatgaaaaagtacggccgcaagctctttatgggcggccaaaattgtaattagccccttgccgccctctgtatgggcggtaagggcctaatcgcaattttggccgacggcggcagacggcgcggtcgacccaccgtctgccacgtcagcttgccgcccaccattagggcggcaggggctatttctacaatttttttggtcgatagattattcctgtaaatattaaaaaaaatctaaaaacgaaaaaaattcttcccgcactacactgcactccggcgcgcgcaccaaccaaccaaccaaccaaccaaccaaccaaccaagcctcccaactccatgagcaagttgcagcagccgcaggccacaggctcgagcttactagctaggcggagtagagtccgtcgcactcaacgctctgtttcacacacgcacgcacccatctgaaagcacggcgcgaccaaacgcatcgacctttggtttgcccgcgtctcgtcgccatctttgtactacgccaatggctctccgctgcctagctgctgccgcagtacagcttgatcgttgcccgtaacctcccgtggctccgatcccgtctccggcgcggcgcgcggctcggcgttgagacagtttgccgcctcatgtcccgggagctggagctgctgctgtttttgctggccctacgggcgagcggcgaggtcgtcgcgggttcggcggaggcagcggcagcggcagcggcgtggcccgcgctgcaggtggggttctaccatgccaagtgccctgtcgcggaggacgtcgtgctgggcgagatgaggatgatcctcgaggaggatcccacgctcgcgccgtctctgctccggatgcactaccacgactgcttcgtccaggtaattaacaatttttaattgccccaagctacttcatgctcgtccatggcgatcatcgtggttgggttggttgcaggggtgtgacggatcgatcatgctgaggtcgaggagcgggaagggggagagggacgcgacgcccaaccggagcatgcggggctacgacgccatcaatcggatcaaggcgaggctggagaccgtctgcccgctcaccgtctcctgcgccgacatcatcgccatggcggcgagagacgccgtctacctggtacgcgcctcacggaacaaatccatggcttctttgcaaatcgatatcgcgctctgcttctgaatgctccttgattcgcacagagcaaggggccgtggtacgacgtggagaccgggaggagggacggcgacgtgagcgtggccgagtacgccgagaacgacctggcgccgccggactccaacatcgtcgacgtcaagaccttcttcagcgtcaagtctctcaacgccaaggacatcgccgtgctcttcggtacgtatactaccacgccgtctccttttccccttttgcttctcgcgttggacgacggcgacagcttatcagaacgccggtaatggccattggccgccgccggcggcggcggcggcgtcgtgcaggatgccacagcatcgggacgtcgcactgcggggcgttccagaagcggctgtacaacttcaccggaaggatggaccaggacccgtcgctggacgccggctacgcggcgaagctcaagaagctctgcccgccggggcacggccacgaccacgaccacgacggccatggcggcgccggcggcgcggccaaggtgcccatggaccccggcagcggcttcacattcgacctgagctactaccggcacgtgctcgccacgggcggcctgttccagtcggacggcagcctccgcgacgaccccgtcacgaggggctacgtcgagaagctcgccaacgcgtcgtcgtcggaggagtacttcgccgacttcgcggcggcgatggtcaagatgggccgcaccgacgtgctcaccggcgatctcggggcggtcaggccgacgtgtgacagcctcgtcgactagtttattcggcgtcccgccacatttgtgatctgtagaattttatatggttttctctgtaacatatatgtaatttcgatttagattagggaaaggttgagacttgagagaagttgcagtttctacgcttttgaggagactgattggaacagcgtatgaatctagagttaaacacttgtcagttgtcaaactactacaaactaatgaatctgtacagatgggcttgatgacgaaccttgcagggtgtaggttggttattcagctgttcttcgtagtagcattgttagtttggtgaatccaccgtttggtcaaccataagttggtcaccaaatctgaccagattgtatagattacttaggaacaaagactgcatcaaccttatgcaagctaacctatgtgaaaaaataagcacggaatgcttttgctagttagaagtctctttcatgagcagctctgttgctcactgcttcaagcttaagtacaatgccaggatgcagaatatagaagtagcgcccttctgtaagggaaggagaaaaaacatagcattggaagcagacaaatttcaaaatccagaatattggccctttcattggtttggacctccagaatcgaaaaatggcattatttggtaaatttaaatttatttgccaaaaggtaaaaccaatgttagccattatgccagnatgacagagaataatgaggaccctgtccttttctactccatatgtagattccggttgctattactacaccacctaatgctccaatggatgccaaaattttcatctttgaagcaccttgcttagtcactggtaataccagtaaactttctatctgcaggaaaagttgaaaaaatggtgcatataaaattaaaacctgcagaacttttctgttgaataactacctagatggatgatggatttcctattggtacgaagcatatcactgtttaaaaatatctaacctcgattggttgttcccaatttttctttattccagaaacatgcccttttcctacaactgccaccaccgaggaatgttcctttgctaccttcaataatttggaggacatatacctgcaaacacaatttcaataattcaagcacaaaagattgtggtggtaatcgagaatatcaacacaaacttttttaagtaactcacatatcacgttcatgtaggagtgtctccatcaaggtaggaaatgccttactcatctcttgaataacaagtgttagcatgtcaacatcctccatgtccttcagctgtatagacaagcattgtcattgctatgcaaatggagtaaagtctggttaattgtctatctatactaaagtctagaaagtatattgagttatatgaaatcacacactagaactgtacatttcaagtcatccaggaagacatcataccattttattaagttcctccgggcttggtaaaaatatggactggaaaacaatgtagtacaaaaactttgccctgtgccataatgacattctcccccaagtccttctcaaagtgatcttcgaaacagataaagacgatgataagatggcaccactgctaatgaaatataagtactgaccaaactattgtttattctgtagaaagttctaacgatatcaagattcatattctattaatcaaatcttctatatgatagagatcattgtaacaagatatggagtacatctcaacttttgagttaaataacaaaatatctaacctcattagtccatatcatatagcaaaagattaagacgcaagcaaacagtggcaactatcttttattccatccaatcagccagatgtgatgaacatttgaaaaatatgtagtttttttccagatgtcatgtcaaaagatgcaccattatgataaaaatatctcatcacaattcaaaataatgacaagtgaaaaagtcaatagcatgaatacgtggttgcttaacttgaggtaacataataaactgttatcatttgtttgtactaggttcacaaaaaaatccacactaaaagtttatcacatttatccacgtatgaaccttaaattggcacagccagtcagctgttatgaatatcctctcccttcttcttcttgcatctatctataacctgtatggaggttatagacaaccaaattcaaccactagataagtaggttgcatacctggacagggcgatctccaaggataactttgccgccataactcattgcttcctcaaatgccactcggaattcggccccaggtaacacatcaagttggctagcaaccttggatgccaaaaacatagcccaccatgtaaattttttttaaaaaaaaacttacctaacaataagtacgaactgcaaaacaagcatcaaggcatacctttgcaagaaaccagctgtagagtattccaaaagtgttcatcttctttttcttccacatgtcaatcatttcgttcatggtaggaacctatgatgataacagaatgataaaacaagttaactacgagtagatataacatctcgaacacttatgtcaatgatggctgcaaaccattaataaggctaaagtctgttgctacacactagcatagtgctataagttatatgcacttaatcaaatactgatagaaggcatgtcagcactggctcctatttatgattgatcagatagtctttggcatggccatccatgccaattgccaatacgaaaatgcaatacaatgccactgccataattccaacttctaattctctcgcgtaaataaatcttaaccagtgttgtaagagatatatccacaagagatatcttttcccagttgagcttaattccatgaagtatagaaccacattatcactctaaatagtttgtattcactatttgagggaagataacagacaaaattcagacgacaatagacttcagcactctcatagtgtattctcatggttcataattcattcagtttttacatgtacaataacctcaaacaaaaaaaagaggaaagtgttcccttcctcgtgcaatgtacataggtaacaaacatgacaacccaaaatgaagtaaattctgcatgatcatacctgaaggttttgtggtgtcagaatggcgactctgctggcacagagctccaagaaaacagcctacatttgttaaagaggtgttaaaataattagtataaggtgttccggatcaattatcaataagcactccacaagaaggcagccaacctgccaaatgattcaccaactggtaaattatcggtgatgagtaaaaagaggaagaacctgaggtttcaggtagtcgatgacggcttttacttggtcacatgattcctacaaagtgaatcaacatacgaatattcaatccacagtataatcatagtaagcgcgactttgatgcatataagttgaaagtacaggacacaacaacagttaactaaatttgcatcggtcatagcgctaccactaccactacaaatacacgtctatataaattactataaaggaaaaaagggtagtcttttgttggtacagttcgtgttcatgaggattttacgagcctgtttggcacagcttcagcttcagctccacctctcttctagagttggagctcagccaaacagttttagttccacctaaaatgggagcggggctaggtggagcgctctcacaaaatgaactagagatgtagaacctggtttaggcagctccacaactctactccagacccaactcctggagttaaatttatgagttggagctctaccaaacaggccctacatgtttgctgtgtttcgctctccagttttttcttttttttcactggtaatctcaaccctgcaagttcttcacttcctaaataagttactaacgaaatttgaactaagttactagtgaaaacttaaaatttggactaatgcgaacccgcaatccaaataaatcgagaccagatcgtcccctaggtgttctccaaaaagttcgaggctacatcatatatcgagctgacgaggaggccaattcacctgtgaaacatgggcggtgccgacgacgtagacgcggcaggtcccgcccgcccccggcggcttccgctcgggcgacgtctcgcactcgaggcacaccacccccttggcgagctcctcgggcagctccttcctctccctctccccctccccctccccccgcaccacctatgtccccgccgtctccgcgtcggcgaactccgacgcgtcctcgtagcccccgccctcgccgtcggcggccggatccatgagcagaccgagcggtgtgaggccgcggccgcctcggatcgggccagtgcacagcagggcctggaccagtgaggcctggagcggcgacaggcggcggcggaagagaggcggaagcgggaggcggcggcggtggatcggcggcgacgacgagtctgggaggaggcgacgaggagcgcgaatcatgcggcggcgggcgtcgaaattttttttttgagagggatttttttttttttttgatgaagagaaagagttcgtcgtgcgggccggagatggagtggacttgggggaggaggtggggcgatgtacggtctggatttgtttcgtcgtatcgtagaagggatctggcccgtccgttcggtacactggactccgagtcagtgataactacggcgcagccagttttgtcttttttattgcttcatcgggccggaaccggatgaccgggcgatggaattcagggtcggtttgtgtcatttaattacgacgttaacgttaaacatgtacaacaataataaactgatcaacgttaatattttgtaaagtaaatttttagagtaaattgtacccacggtacaaagaatttggtagatacgtgcgatatagtataataacttgaagaaaaacgagtagactggtatataaacttgacaatcacgtgcattttaatcaaaaacataaatatatatctttgattaatcttaactgctaggttttggctcatgaattcaatttcgtgttttgccatgttcataacccaatacaatgaatatgttgattaggcgagtcgctcgaaaattatgttatttgcatgcacttatttttgataatcatatatcttttggtttcaaatagatagattattttattgttacaactaacagataaagcaatatataatacatctaaatccttgtcaagatggctggcatgagtggctgctttttttatatggcataaaaagtatggtgtgcaatattgatatttagccaaaatgcacgcactagccaagttgttcccttatatactcagtttttaaatttttgcactagattacacccacctaccccaagtttacgtattgtagatgtaatttactcaaaattttaaaataagatcatctattgaaaaaacaaagatagtatgtaaagagcattataaaataatttatcgttctatgggagaaaagaaatgaaaagaggagtgaaatgaaaagaggagtgcctctgcgtcggtggtaaaaaagaaatgctgtatgtcagtggtagatatcatcgaccaagatccgactgtgcccaataatcaatactacacatgtctagcatgccggttatggttgaaataaagttatttaaatgatgcattcgttttttttcaagttttattgagaaccttttaaaacaaaggattaatgtataaattttgtaggatttaaatcttatagaatttttatatttgaccttttttgatataaaggattgaaagaatatctaacttaattgcatgtagatttgttttaccgttatacttattttctccgtcaaaaaaagacaaaccctgagtttccgtgtccaacgtttgaccgtccgtcttatttataaaaactatgaaaaaaactaaaaaagataaatcacttataaagtattaatcatgttttatcatctaacaataatgaaaatactaattataaaaaaaaattatataagtcggacagttaaatgttggacacgaaaattcactatttgtcttttttttttttttacggagagagtatgtatagaatcatgtatttttttctgcttctctgttatccattcatggaattcagacaggccattaattcgacacatcatcaatattggtcccgctgatatttactctaaccaacaccaactagagtgtcaagagaagagtaggaaagcttgaagaaatcaaacacatcatcattccaatttccaaagaggagagtcgcagaaagcaatggcttctactgaccgcagcaagaagcttcgcgtcctgctcatcccattcttcgccaccagtcacatcggccccttcaccgacctcgccgtccgcctcgtcaccgccagaccggacgccgtcgagcccaccatcgccgtgaccccggccaatgtctccgtcgtccgatcagccctcgagcggcatggctcagcggcgaccagcgtggtcagcatcgccacctatccgttcccggaagtggccggcctccctcggggcgtcgagaacctctccactgccggcgccgatgggtggcggatcgacgtcgctgccaccaacgaggcgctgacacggccggcgcaggaggcgctcatctcgggccaatctcctgacgccctcatcacggacgcccacttcttctggaacgctggcctcgccgaggaactcggcgtgccctgcgtttcgttcagcgtcatcggtttattctccgggctcgccatgcgcttcgtcaccgccgccgccgcgaacgacgactccgattcggcggagttgactctcgcggggtttccaggggcggagctacggttccccaagtccgagttgccggatttcttgatccggcaagggaacctcgacggaatcgacccgaacaagattccccaggggcaaaggatgtgccatggtctcgccgtgaacgcgttcttgggcatggagcagccgtaccgtgagagattcttgcgcgacggcctcgcaaagcgcgtctacttggtcgggccactctcgttgccgcagccaccggccgaagctaacgccggtgaggcatcgtgcatcggttggttggactccaagccgagccggtcagtgctgtacgtatgcttcggcacgtttgctcccgtctcggaggagcagctcgaggagctggctctcgggctggaagcctccggcgaaccgttcctgtgggcggtcaggaccgacgggtggtcgccaccggcggggtggcaggagcgcgttggtgataggggggtgctggtcagagggtgggtcccacaaacggcgatactttctcacccggcgacggcggcgttcctgacgcactgcggctcgagctcgctgctggaagccctggccgcccgccgtccacgctgcctgacgtggccgctggtgttccaccagtttattcaagaaaggctggtcccccgcgtcttaagattggcgaaaaggtgtgggactggccaacgaacctgcggcactaggaggcgatggtggtgccggcggcggcggtggcgcgagccgtggcgaggttcttggagcctggtggggcaggggacgcggcgaggctcagagcgcaggagctcgccgccgaggctcacgcggccgtggccgaaggcgggtcctcgtaccgcgatctgcgcaggctcgtcgacgatatggtcgaagcaagggcggccggcggcgaggctgcggctgcaccgcaacctcagtagcctataatgccaatgcgttcgtctgtacgatgtcgagtcattccactgttgcaggctcccagttcatttcgctcagttgtcatgatgcactgatgcaggccttgttgtgactttgagaaacgtttattcagagtgcaaaccgcagaacacttcttcagttcagttcaatgaaatcagtatattgacttggtttgtaatttgaagcttttaggggtagtttggatatagggactaaactttagtctatgttacatcggatatttgatattaatttataatattaaatataagctaactataaaactaattacatagatagatgctaatttgcgagatgaatctattaagccaaattaatccatttttaacacatatttactgtagcacaacattatcaaatcatgtactaattaggcttaatagattcgtctcgcgaattagcctccatctatgtaatttattttataattagtatatgtttaatactttaaattaatgttaaacatcctttatccaaactacgctttagtagtttgggaaatctgataagaaatgggttgggtaatcttttcttctctttttgaagaaaagaaattgtggatgatttgaacagctattcttcgccattcttgacaatctccaagggttctcttacaacgctcgggacgagccaggtgacaccgatgaagattgcagagaagcttgcctgaacaaatgctactgcattgcatactcaagtgaatctggatgtgcaagctctgtattacgacctgtacaatctgagctcagctaataaacctccatacagcaagatctatgttgggttccaagctcaggagcaagaggggattgaccacaagatgtgtcctcttggtggttggatcaatagctgtagcttctgcaatgtttgcagtgttgcttctatgcaggtacaggagagacttgtttggttcgagtaaattcgtcgtagaatgatctttggttgcctactcatatgcacagatcaagatcaagaaggcaacggagtggcgacggcgtgggcggtgcccggtggtgcggcgacgggcgaggccgactccgcgtggaggcgtgcgcggagcccgtgcgacggcggcagcttcggctggcgcagcattggcggggcagctcggccagcgacggcgaaacccggcacggcacagtggcggcagtgcgtggcgtggtggcggcggtgcatggcaggcggaggccggcacggtggcactggtggcggcggggtgacggctggtggcagtggtttggtcgtgggagcgaaggaggcgacggcggcgcctggtggtggtcgtggcggcgcggtgctcggtgacgacggcggcggtgtcctccagatccgtgcgactcggctggatctggagggtggctggcggtggtggctgcggcagctagcggcggcggcggaggacaaggcggcggcgtagggccggtttgctggctgctttggtggcgaaaggcaacgatgtagcggctgctttggcgatggcggcggtttgcggagacgacggctggtgatagcggcagcggcgacggcggccggcttgcggcggtcgtgactgtgaggcggtggtgatgtcgccggatgcggcaacggcatcgccggcgacagcaagtggaggcggggaaggagtcgggtgcaaggtgtggatggcgacgggcgttcggcagcagcggtggtgaccgtgactgcggtcaccgaaggcatgacgacttcggtcggctagccaagggcgtggcagacggctacttctgactggtgtggcatcgtttggaggaggggtcggagaccagcttggcgcagagaggcgcagctgatggtagcggaggccggctcggcgtgagaggcgcggctggcggagatggaggccggcttggcgcgagaggcgcggccggcgatggaggaggcgaccttggtgtgagaaggagctactggtggttgtggcgcggtcttcggcgcacgaaggctggccggcgggggggcgccaatgcaggggtcccacatgttggcagagcttgagtggtggtggagcatcggggcaccacccatggatttgcaggtggtgagcagcgggtgaaaacccagcccggccttggccggactggcaacgatgattccccctcctgagggcgttgttgtgctgtctcatccctcaagggtggttgccgggcaaaaagcccagtcttgctcctttgagccctgacggatggcggcggcggttcttccgtcgcttctcttcttgaagacgtcgttttgacatcccctagggggcgatctcgtctgtgtttctttgttggtctagcagcgatcggtcacgcttagcagcggccggtccggtgcttgccttttcccaggcttgtgtgttggcgttgtcggtgtgtgggtggtagtatattttttcctttttgctggttacgacccttcagggttgtaatcttgtaattttttcctgctctatcaatagaacttcgcaccgtctcgtgcgagtcgttcaaaagaagaaggcaacggagaatttctgtgataatctcggagaaggcggattcagaagcatttttcagaggtacttgcccgagaagaagaagaagatggtaatgaaggagacgagtgtttccgagaacgtgggagcacacacgacggcaacattgggcgacttgaagtcaccctccatctcctcccacggcggcacgttcttccggtctgtgaacagtgacagaggtgagaatgcgtcgctcccgtcctcctcgatgccaccgccggcggcggcttgtcggtgcaggtcgcttagttgcatcatcatcggcttgtctcccccttccccgccgccgccgccaccaccagccccatcgatctagtgctgccggaggcgggatgcgagcaacgccgactcatcaaacacctgctccgccaccagattgcccttctcattgtgcatgcgccgaagtcgccgtagaagaagccgtgcggacttgtagccggaggaagaacgcctgagagagaggagagagaagaggagggaatgagaatgacacgtggggcccatgtaggccccaccattttaaaaaacatttttattgtaactaacatgtgggcccacgattattattattattttccatatcaagttgccacataagcgcgacgtcaatatcatgtgggagaaagactaagtcaaactaatcacgtaggcgccacgtcagttaaaaccggcgtgcaaaccgccatgggacctatattgcaccggttttgtaattgagggacccgttgtatctggttttaccgttgaaggacgaaaatcggattggttgacaagttaagggaactcaagtgaacttattccttcttcttttccaccgaagcagcaggcccaggccaatcggcctgtttgtcttcctctctaccagctagcccaaaccagctattcttcccggaccatctttgtttcctcttcttcggcccatctgtcccaactcgaccagcctcgccagccagccaaccaaccaggacgcgaatttttttcgtttttagattttttttttaatatttacagaaataatctatcgaccaaaaaaattacagaaatagcacctgccgcccaaatggtgggcggcaagctgacgtggcagacgatgggtcgaccgcgccgtctgccgccgtcggccaaaattgcgattaggcccttgtcgcccatacagagggcggcaaggggctaattacaattttggccgcccattcagagcttgtggccgtactttttcatctgggggcggcaagggacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttatttgacgtattagtactcggataatttatataggcctatcgcagtctaggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacagctaggtggagttagaacccttctggtgtctatccattctctgtattgacatctccttggtggttcctgggaggaaagaatagatgtaaagcaagcaaagttagtaaatgttgtgagaaaataaggaatcatgtaattaaaatattcttaccatgaaatcgtcgtcaagaatatttggacaaacaaagaaccttcgacccaatgttgtaggatttatggaacgaagaacctgacaacgatcaccacacctacatcttggacgggctttccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgctgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggtgccgaaagatacatgcatgatcggcaccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaaaagaagactgctctgctggccctgccccgcgccgcgaccacgcttggtcctccgggcctgtgctcgcacgtggtcctaggagtaggtgaaacgatccggtggcacagcacgggtagcacgagtgtcccgcggaggagtggcctgcgcctggacctgcgtctgcaccggcggtgcgcctcccagctgtgaggggccgatgacgtcctctgtcgagtctgaagcgaagtcgaagtcagtgatgtcgaagagcacggtggaagacaggaaggggtccgacgaggtcccagcatggtccagtggtggaccctgactcgacgtgccggctgcctgtgacgctgaccctgcagcctgggagaagtgggcggcctgcgtcatagcgaactgggcgaaacctacacatcgacaacgggacccttgtaagctaagacataaaatgtatgtaaattgattgtggaagtaatgttgtttttttaagtacctgtggggggcacaacagaaggcctagccgaggaaggcagggtgctgaacggtgcacgaaaccctgaagcaatcggcaagtgaaacggctcacttatatgtgcgaggcatgtacagaagtagtaataaaaatacttacctccgtgcggaggaggagtcggcctaggaacttgcgcagctggacggggaccagtcggtacgggtggccgctgtacagctgcgtctgcccgagcaacgtcgtctgcacgacaggtgagcactcggagaatcgagcgcatcgagctcctcatacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccaactccactgaggcacctcgcctcccgcggcgtcggcgatgctcctggcgtagtgcacgagtcccttgtcgaccgcgtgcccatgaccgccacagaacatcacccagccaaaaagccagagcaagtacgcctccaaacatcggctgtacgagtactcgtcggcctccgcctgtagctgctcaacctgcaagcagtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcgcgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctacgagggacctgtccacagtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccatcaatgcagagaatgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcatggcaaattgtcatacaaggcttcgtaagttccaaatctcatctctattattttctatttggccctccaggccttggcatagctaatagtatacttgtatgtctcctcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgcgaccggttcgacttggcaaccctaaactctttatgaagtgacactgcaaaatgttttaccgcctccttcatatcttctgctctgctataaatcgctccctgaataacctcattttctttgtactcccatctcacactatcctattcagagacgatcagtccagaaaaatcctcactagcccattctgctggattaatatccgtctcatcatctgacgaatcaccttcctttacacgctcgttgtcagaatcctccctctccatttcatccacaatggcaccgacagtctccccctcgtcggccactccacctggttgaatgcccactggagcaactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgggagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacagacgtttcgtggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctataatacgcacttctagattagtacaactaaaaccctaaaaatataatgcatttattcaaacaaatttttaaaaaatacacactatttttaaaaaatataatcccccgtttgccacgtcagcttgccgcctcagaggtgggcggcagggtctatttttataatttttttggccgatagattatttctgtaaatattaaaaaaaaatctaaaaccgaaaaaaattcccaggacgcacctggacctggtgcgtcggccggcctcgccgcacctcgcgctcgcgcgcgcaaccctaacccgccctccctccctgccgcaccgagctcgccagtgcgccgtcccgcgacaagccgtggacaacgcgcccccctttccgctgccccttgaaatctcagccgtgctgtagtgccaagcagacctcacaacgacgacttcgtcgcttccccgtaccaaccaccgcacgtacagcgccagctgtacgtagatcgcgtcacccgagcagcgtttcgcttgtacccgcccggcgcaccggccccgcgaccgcgatgacgccgagtcgcgccaaccatccactccctgtcgcgcgccacgtcgcctgctgccgcccgtttacttttcctcatctcccgcgcgcgccttccgctgctgcacccagtccaccgcgccgccatgccgcgccaccggagctcgacgcagaaagtggtgcgccgcgtccatcctccccaccaccaccacagtcctcctcctgtaacatcctgtgcccctttttcatcgtcatcggcctcctcctttcccccaccaaacccatctccagttctccaccatcacacgatcgagcatctcggggccgcgacttcttgcttttccgccctcgccaccacatcgacacgccgagatccgccgttgcatcgcctccaatcgagcccgctcacctcctgcatcaccagcaccactctccgcctccctggccgccgtcgcgccgggtcgagtgccgctcgcgtgcgcgcctccttccccaccgccgattggattcttgtgcagaaatccatcaattcctcaatcctcactagacacatcaacgctccaactccaggctagagaagagcagaaggcttgcggagaagaatggcttctgccgagcgcagcaagaagctgagggtcctgctcatgcccttcttcgccacaagccacatcggcccctgcaccgacctcgccgtccgcctcgccgcggccagaccggatgtcgtcgagcccactctcgccgtcaccccggccaacgtctcggtcgtccgatcagccctcaggctgcatggctctgcggcgagcaccgtggtcagcatcgccacgtatccgttcccggaagcggccggcctcccaccgggcgtcgagaacctctccaccgccggcgacgaaaggtggcgcgttgacgccgctgccttcgacgaggcgatgacatggccagcacaggaggcgctcatcaaggaccaatctcccgacgtcctcatcacagacttccacttctcgtggaacgtcggcatcgccgaggaactcgccatgccctgcgttcaactcaacgtcatcggtttattctccacgctcgccgtataccttgccgctgccgtcgtgaatgactccgattcggaggagctcaccgtcgcagggtttccggggccggagctacggatcccgaggtcagagttgccggatttcttgaccgctcatcggaatctcgacttagtggacaatatgcgcaagttggtacaagtgaacacgaggtgccatggcttcgccgtcaactcgttcttgttcctggacaagccatactgtgagaagttcatgtgcaacggcttcgcgaagcgcggctactacgtcggtcccctctgccttccgcagccaccggccgtagctagcgtcggtgagcccacttgcatcagctggttggactcgaagccgaaccgatcggtggtgtacatatgcttcggcacatttgctcccgtctcggaggagcagctccatgagctggctctcgggctggaagcctccggtaagccgttcctttgggcggttagggcggccgacgggtgggcgccgccggcggggtgggaggagcgtgtcggtgacaggggattgcttgtcagagattgggtcccgcagacggcgatacttgcccactcggcgacggcggcgttcttgacgcactgtggctggaactcagtgttagagggtgtgacggctggtgtcccgttgctgacatggccgctggtgttcgagcagttcatcacggaaaggctggtcatggacgtcctgcggattggggagagggtgtgggacggagcacgaagtgtacggtacaaggaggcggcgctggtgccggcggcggcggtggcgcgggccgtggcgaggttcttggagcctggaggggcaggggacgcggcgaggatcagagcgcaggatttcgcggcggaggctcatgcggccgtggcggaaggtggctcttcgtatggagatctgcgcaggctcatcgacgatcttgttgaagcaagggcggacgccggcgagtccgcgctgcaacctctgtaacctgtcgtttctctatacgataccgagacattcgttccagactccatccagttcatctcgttctgttgcgttcaatcaaaataaattacgatgtgatgtattgatacatgggatcacctatatatttgttgatataattttttaaaaaatttgacagatgtaattatagtataattgtgatataattacactgtaacttatatgtaacttctatgaaactttcaaaaatatcttgtaatataatattggtgaaacggaggttgtggggacgagtcctctcacatgtgtgcgctgtgactttcttattcctcacttttataagtcttgaaacaaatataacggttcaaaattacgtgaaaattaagttatatataagttacactgtagttatatgcatgcatgttacagtgtaacactactggataaagggtttttaatcctagtttgtaaccccttagtcccggtttgaaataatcaggattaaaaatcattaagatggagccaaggtaggttcgttcttttctttttttcattatttttaactttgaatattgatttcactatatcccaaatcatcccgtgaaatccccaaatcgatcatcacataacaaaaaggatcatctccatatccccaaatcaatcatctccaaatacatcacaaatacatcatatattcaaatcacacacagatcaaatacatcacaaattctcaaaaacaatttcatcacaaatcctaaaaaaaaaacaaatctcctgccgccgccgaccccgcccctgcctggttgcttgccctcccggctccggcgtgcgcaagccaccgcggccctccgctggcctcgctcgctcactcctcctagctcgctcctcgatctgccgacaggaaggagaggataagatcggctttaaagaaaaggataagagagagaggaggaataggaatatgaggagtttaggaggataagtaataggaattatatacagtatatggatttttaagtaccggtgttaccaaccggggttaaagatcaatttttagtctcgtttggtcacaccaaccgggactaaaaatccctggccccctgacagcctctaatagtaaatgaaccgggactaaagatgatctatagtcctagttggtgggccaatagagttttaaactgggacaaaaaaaatcatctttagtcccggtttctattcaaaccgaggctattgtggattttggccgaccaggcaaagatggtttctccatcagtataattatactagattgtactgtaattgtatctgtcaaaattttaggcgaaaatttattgataaatatatagcaaaattgttgatacataacttttttttttctgctgctgctggaaaaatcacgttatggagagtacaaattaaccgaagaacatttctgacctcacttcatcgagaaaaagactatttttctgagtacatgtaatttttgctagcttggatataacgtgaagcttttagtttccggcttgctaaaattatgacgctatatttttttaagggatttcagtcactttttttctccatgtgattgctcggtctcttatatgtatatgtatgttttcatctctcctattttctatttcaagtagataataaattacttgaatcctaattctctcgtacattgtgcattagaaaaattacaatcataatgtcgacgtttgatgtcgcgatttcggtatttgcatattatggggatcgttggaactaggatatacgcgagactgagataaaagatatggggacagagatttttatacaagttcgggccccttaattgtcaggtaataaccctacattctgttggccgaagccggtattactcttattcaccataatcacaccagtacaatatttggagtagcctatttaactgttgtcgacatggcggtctgaaggtctgactcgtagtcgataacagggtcctcctcgagttcgtgcccggcgagatcaaagatagcgctttcgtctctcctgacagtatccggagacaccataggggactagccgtgcctatcttcgaagtcgatatccagcgtcttgtcttggcgtatgttgatattgtgtcttgatttattgtttcgtgtcttctatggtggttgtgtgttgatcgtctgtgtcccctctcctcctaaggggccttgtatttatacccataggtgtccccttgtccaaatagaaccagagaaaccaatatggatacaatccgagtagtccttgtcgtttccatgtagaaatttggttatccttccttatgcggaactcctcctatatccgaaggttgtttccgtataagacatagtatgtggtgggtcctgccgagatttagtcaattattattaggtatgtggtatccataacactgacacataatattgaaacttaccatgtaattatagcgtgagttttgatactttcagttacaaatataagtatatgtaattcatagttgtaaatatagctagtttcgagggaggtcaagcagactacacgcagcaagtcaacactgaaaaggagagtggcgatgagtcatgggcaaggccaatgtttgtgactcaattgacaataagagtaggaaccgctgaagatagcaataactatggcaatgtctgcaatggttaagctcatggaaaaacacaaggtggtcctaccgaagaaaaaaaattacttcccaaccatgcccaacaggcaaagagcaatgaaaatattgtattatattccttgtggtagcaccttaagcttaagatcattttttgttgcactaaacttatcatgtgctcacacaatggctaaggtgttatactattgcagtatttaatgcttaaggttaactttttggatacattgtggttgcctgaggccgcaagcatcagccgcgccaccgcccgtcctcagacctcaggtgcggcgagcggcgagcctgtgacttgcaacaagttcccgtttttatttaagaagaaagcagttctcattttttttaagaagaagagagttggtctaaaccagccataaatcctcacagtcgcttggttaattaaagcaatcagaaaaacaaaggacagggtaaaagcctgcggcaaacaactactgagaccacagtgcaacacagggttgccaagctcttactcaacctaaaccaccagaacatgtccacacaaattctatctgagttttagccgacacacttggttgccaagctcttactcaacctaaaccaccagaacatgtccacacaaattctatctgatttcagccgacacacttttcaagctactaaaacagtatggtctgtaaaaaaaaattctatgtaaaagttggtctgcaatataaataaattaacttttcaattttacaataattaaaactcaattaatcataactttcccgtttcatgtgccctcacttaaaatcttcatgttaagcaatttcaaacataggcacatgttgggaaaaaatttctatggaagattttttaaggagtaaaacagcttcaaagacgctgttttttgtttgaaagacgctgtttaactgtgtatattgcttatcgatagaaaaaaaagggaatatttcattgtttagataggattagtggcctagtggatggccattacaactttaaacgttattcggggcattatatacgtcgttcaccgagtagttattctgcattcattcaaccaacacagcaacgttccaaactagagaagaacaaaaagctaagggcgtctttgaatcgtaagaatgaaaaaatgtaggattttgatagaaatgtaagtgtaaaacagaggattgcaaaacacaggaatgaccgtttgattggaccgcaggaaaaacacaggaattagaggagagataaagactcaaaggaaagtttccatgaggttctacctcatgttagaattcctccaaaatttacatggcattaggcattccatagaaatttcataggattccataaaattcattcctttgattcaaagcgctatatagaaaaaatttctataggaatgaaatcctctaaaattgttatgaatttcctttaaataaaaaggggcctaagcttgcggaaaagaatggcttctgctgagcgcagcaagaagcttcgaatccttttcatcccgttcttcgccacaagccacatcggccccttcaccgacctcgccgtccgcctcgccgcggccaggccggacatcgtcgagccgaccattgccgtgaccccggccaatgtctcggtcgtccgatcagccgtcaagcggcacggctccgtggcgagcagcatggtcagcatcgccaagtatccgttcccggatgtggctggcctctctccgggcgtcgagaacctctccaccgccggcgacgaagggtggcgcatcgacaacgccgccttcaacgaggcactgacacggccgccgcaggaggcggtcatcagggagcagtcccccgacgtcctcatcacggactcccacttctcctggatcgtctacatcgccgagggcctcggcatggcgtgcttccgattctgcgtcatcggtttcttctccatcctcgccatgcgcctcctcgccggcgccgctgccgacgcgaacggctccgattcggagtcgctcaccgccgcggggtttccggggccgaagctgcagatcccgaggtccgaggtgccggacttcttgacccgccaacagaatttcgacaagtttgacatgcgcaagttgcaacagtcgcaagacaggtgccatggcatcgtcgtcaactcgttcttgttcctggacaagccatactgtgagaagttcgtgtgcaacggcttcgcgaagcgcggctaccatgtcggcccactctgccttccgaagccaccggccgtaggcaacgtcggcgagccgtcgtgcatcagctggttggactcgaagccgagccggtcggtggtgtacatatgcttcggcacatttgctcccgtctcggaggagcagctccatgagctggctctcgggctggaagcctccggcaagccgttcctttgggcggtcagggcggctgacgggtgggcgccaccggcggggtgggaggagcgtgtcggtgacaggggattgctcgtcaagattgggtcccgcagacggcgatacttgcccactcggcgacgggggcggtcttgacgcactgcggctggaactcgatgttagagggtgcgacggctggtgtcccgttgctgacatggccgctggtgttcgagcagttcatcacggaaaggttcgtcacggacgtcctgcggattggcgagagggtgtgggacgggccccgtagcgtgcggtacgaagagaagacggtggtcccggctgcggcggtggcgcgaaccgtggcgaggttcttggagcctggagggacaggggacgcggcgaggatcagagcgcaggagctcgccgcggaggctcacgcggccgtggccgaaggcggctcgtcgtacgacgatctgcgcaggctcatcgacgatatggtagaagcaagggcggccgccggcggggttgcaccggcacggcaacctcagtagtctattaatttcgctccgttgccatgagcgatgcactactcctgcagggacttcagaagtgttgttcttgtcacttgtgactgtgagaagcgtttattcagagtgcatgcaaaccgcagtcttcagttgatcagctccaacgaagatctgcacctgcaatatatattggcttaatttggccttgttctaatttgaaattaaagcttttaagttgcatctgatatctgtcgttgccttcagaggtttctaatatttcccttctgaaaatttcatcttgtttacgtgatcatgccaagttagtggatattcacgttatcatccacaagtttctaaaagattgctcattcctcatcagattccccggaaatatcatttttgtcaatccacttgtactacctaatctctattatataaaagaacccagtgatggtaatgaaaatctcccatcacttagagttggtgggattttctaaggctagataaatatatctgcttgttttttttatgtttgcttgcaaattatatttgacaaatataatttcaagtcaagaatctcagatatatcttttgaaatcggttgcaagtcacgggtactttgctagttacttcctctgtttcgtaatgtaagtcattctagcattgtccacatttatatagatgttaatgaatctagacaatctagatatatatgtatgtctagatttattaacatctatatgaatatggacaatactaaaatgacttacattgtgaaacggagggagtaataaatatctaaagtcatggaaaaactaattaatctttctcataagcacattaggcctcgtaagctgaaaaacaaatgccatcaaatgcatgattggataaaatgatgaccgtccgatcagatacatactccctccataaaaaaacaaaccctaggtttccgtgtcaaatgtttgattgtccgtcttatataattttttttatattagtattttcattattgttagatgataaaacatgattaatactttatgcatgacttgtctttttaattttttcatattttttaaaataagatgaacagtcaaatctagggtttatcttttttaaaggacggagggagcatatgtattatccctccggagccttctagtgcctctcctcgcgcacttggcaggcatgaaagagaacaagcaacatatttgggaacttaattggcggcaatttcataagttgagtacttatgaatttgacacatggaccaaatgaaacaaatattgtctctagtttttaatatatgatgtcattgacttttaaatacatatttgactattcatctttttcaaaactttttttcaaataaataatatataaatcatgcttaaaatactttcaacgataaaacaactcacaacaaaaataaactacaaatatgtaaatttttttagtaagacaaatagtcaaccgtgtgtttacatgttaatgatgtcatctattaaaaaccgaaggtagtatgaattgtttatgtaaaaaacatagaaattctatggcggttatgtatgtgacctatgggcaacttcatagtaatatttaggtcaaagatcattttagctacaaaagaaaaaaacaatcttaatctttaacaaagatggtttctcatggtcgtgcaaacacgcgactttgagtagctagtatttgtgaaaggacgacgggtaccattatgttttatagaaaaaaaatatattgtcagcaggtaagcgacccagatcgtagctgatcagcgtgcttacttttttaattagtagtttcagttaccatcgcatcgtgactcacggagtgtacctgcttatattattttaagtcgatcataaatcaaattttgaaatgcaactatacgtcgagcgcccaattcgagggtggaaaaatcggacgcccacatcaagctgacgtcaaattactttaaactattttttctcttaaattatttatccaaatcataaccgaattgcaccattaaattcattacaattaaatctttaaaataagaccacatagggatatattccaatggaaaaaatttaacttattattcaattatttttaaatattgcacgatgttccaccaagtatatcgaaatttgtttcactaagtaaatcgaaaatgtttcaatcgtttaaatcaggcgttgtttcaccttatatgaaaacaatgtttcagttcactgcaacctttggtccatacatagtgaaacattataagtatactaggtgaagcatttttttttggaaaaaaatgaaacgtattcccttattaaagggttttcataatacgtgggtgatttgttgtaaaagaatgtttcagttcactgcaacattagatctatacaaataaaacattattagtacattattagtacactagatgaaacatttttgctagaaaaaaaataaaataaattctgttaatagagggtttcaaaatatgtgagtgatttgtcacaacaaaatatatatagtggagacacgtgacagataagatcaaggacatgtggtggagaacaggagcacgtgacaggtaagatcaaggacatgtggtggagaacaggagcacgtgcacatccgggggagcgtccgattttacctgccccgcctgtcgcccgagcgccacgattctcccagattttggcccctttccattaaaagaacatgagatattgttttccagacaaggacagaacaaaagcagactattatctgttcttgccacgacacagtacgaatcttcgatgacaagagggcaagacaaaaatacgtggcaagcatgcagcatcagaatactaccctttaattaatcgtaaaataatcaaatcaattcagcaaatattaatatatagtctgtgagtgatctagctgagattgagaagcggctattccacaatagttcgatcgtcatctgattgcagacatcgcccactttcgccaaccaagagcaggaaaatggcttcggatggcagcagcaagaagcttcgcgtcgtgctcatcccgttcttcgccaccagccacatcgggcccttcaccgacttcgccgtccgcctcgccgcggcatggccggacgccgtcgaggccaccctcgcggtcacgccggcgaacgtgcccgtcgttcgatcgctgctcgagcggcacggcccagccggcgcggggtcggtggcgatagccacctacccgttcccggcggtggacggcctcccggcgggggtcgagaacctctccaaggcggcgcccggggacgcctggcgcatcaacgcggtggccgacgacgaggcgctgatgcggccggcgcaggagtccctcgtcagggagctccgccctgacgtcatcgtcaccgacgcgcacttcttctggaacgccggcctcgccgacgagctcggcgtgccgtgcgttcagttctacgccatcggcgccttctccaccatcgccatggcccacctcgtcggcgccgtcaaggaaggcgccaaggaggtgaccatacctcggctccccggccacgacttgacgatcccgacgaccgagctgctccaaacccaagaacgccaattcggggccatcagcctactttggcgtcgtcgtcaacacgttcttggacctcgaggccgagtactgtgagatgtacacgcgagacaaacacgccaagcgtgcctacttcgtcgggcccgtctcgccggcgccgccgccattgccggcatccggtgagtcaccatgcctcgactggctgagctccaagcctagcaggtcagtggtctacctctgcttcggtagcctgacccacgtgtcagacactcagctcgacgagctggccttggggctgtaggctgccgggaagccattcctgtgggtggtgaggactgacatgtgggccccacccgatggctggaaggagagggtcggggacagggggatggtcatcagaggttgggccccacaaaaggcgatactggcccacccgtcagtgggtgccttcgtgacgcaatgcgggtggaactcggtgctagaggcggtcagcgccggtgtcccggtcttaacatggccaatggtgttcgagcagctggatttttcacattttggtccttttgaaaaacttatttcacaaatagacccctagaaaaacttatcccaaaaatggttctttggggcgccagagtagctggcgccgtcgtccaacaggacggcgtggcgccgtccccctgccgacgtggcggggcgatgctgaggtggctagggagtgcgccagagtggctggcgcccccccaccgggaattttttttttgttttatttgtttgatatttttttcacgcttagggacacacaagaaccaaccatagaaaaattgaactcaaatggacgtaatatgtgacctgtagaatttttcctctcctctcctctctctccgaactagtgcaaaggagagatgtgcaacttttttatttttattttattttttaatttttttttcacacttaggaactcacaggaatcaaccatgtaaaaaataaactcaaacggacaaaatatgtggcatgtggaattttccaaagttctaccgaaaaacttttctcctcgaaaacacaatcttgcaagcggaatttggaggttttaatatctccgaacccggcaaagctggggagaatcggatgtaacattttctgtagatgtccgtgcatatattatttgcctgattccgagtccgtatgagaaagttacgcctattttaatagatgacatattctgtccgtttcggtagagttttggaaaattctagtttgagtttattttttatacggttggttcctatgttctcctaagtgtgaaaaaaatatcaaaaaaatgaaataaaaataaaaaaaattgcatctctatgtactgtttaacttatatatgtcatttcatgtggttatattttgaattagagtgcattatatttaacatgctgatcaaagggttttactaaaggaattatggtctaattttagtgaaggtgcaaagtagactaagtggtatgctagctattttcagacttagctaagtggtagtttgagtttaaattttttttgtggttggttgtatcgtgatcctaagtgtgaaaaaacatccgaaaaaataaaataaaaatgacaccgttgcaactccatacagagaaacaggaatggaggcggcggcgccagcatggc

SEQ ID NO: 15713 - DNA, 16794 bp, Oryza sativa
gaaaaatccaggttcgagcagttcgtcaccgagaggctcgtgacgaaggtgctcgagatcggagagcgcttatggccggagggcgccggagtacgaaataccaaggatgaggagaaggaggtcgtccccgcgaaggcggtggcggaggccgtgacgaagttcatggagccaggaggggcagggagggcgcgagatgcgccatcaaggagctcgccgtgaaggctaatgccgccgtagcagaagccggctcatcgcaccgtgatctgctccgccttatcgatgatctcatgcaagccaagtaatggtaatgcttgtaagataaaccagctctgttttaaaatatttgttgctctaaatttgttgtaagttaattggccatcaatttctatgaactcatacagtttactatcataagattaatatttttaaattcaccataagaaatgctttcataatatataatttacatttacatgccgttgaactatataattttttcaaaattaatggttaaaaatagacatgtttgactttagacagatctaaaatagcaagtaatttgaaatggaaagagtaacctttttgttctatttgatgcattgagctcctgagtttatcagatttatgtttaaaagacgagctgttttacttttacctcaagttacagctcactgcaacatctactgatcaattcgctcagatgcagcctgaaccacttcccaaactgtagcagttcactgaaacataggctatgtttagttcgtactaaaattgaaagtttggttaaaattaaaacgatttgatggaaaaagtgaaagttaatgtgtagaaaagttttgatgtgatggaaaagttggaagtttgaaaaaaaaaatttgtaactaaacacggccatgctgatgaattcactgcaacactgacctctaagaaagatcattgcttctcctctcttccagtcgcattggaacgcccaggagaaatctaaccaacttggctgtgttcgttataggaggttgggaaacgaaacggttcattagcacgtgattaattaagtattacctatttttttaaaagaatggattaatctgatttttttaaagcaactttcgtatagagtttttttttttaaaaaaaaaacgcatcgtttagcaatttaaaaagggtgcgcgtgaaaaatgagggagaagggttgggaacaatctcatacgaacgcagccttaggtcaccggtgaattggtcgccatgagattgtacagcactaaatacctggatatgagaactttcactgtacaatatacttgtggtatatactgttagtataaacgatctatacttgtgatatatactgttagtataaacgatctaacggtgtatattgatttaattttccacctaaaatatatgctagtataaaatttacaagggtttccctagaaaaagtaaaacttacaagggtcaggaattaatttagataaaaaagtttcggtacccgcatcgagttgtatgaatgtgtttacctagctaggaatgttcagaacgtgtaaggcatttcacgcacatctgttatgttacaccttacattacgtgatcggtaattggtcacttgtaatcaaagtatgtaaaattttaatgatgattaaggaattgtgccaccgcaacacgcaccatcatctctcacaggcgtacaaatgaaatccagcagcgatgccggcagcctgacatgtgaacgagtcccaattagaccggaataactcttaaccacagaattcaattttctataaaacttctaatttacccatctatatactagcactacaatgtaaaagttctccagtaaaatatgcacaaacatatcatggaaattacaataatcgtttttttgaaaaaaaaagttaaaaaggatcaatgaagttctccgtctgcttggcgccttttttccgcatactttacggcaacatctctgttcctctgttctcattcaagataataaaagttagtgcagaacttccccaacagaaaaatgcatgtgcagctaaaatcagaaaacaaaaaatgaaatgaccaagtgcattttttgccaaaaaaaacacaatttgtgataaagactacttgttaatacacaattctccaggtagtttttttattttggaaagaacactaattactgtgcaaataattaccgagataactagatactacaaattacaaagagtaatgactgaggaagaaggtattagttgcttcatgaatggcaaatgcagcagctaatcacttactggaaatcgaatgactacttgaaaattgaatgagcaattgggacagttctaaagtagagagttagggaattacctgctttatagcgttgagagacacatctggatcattactaatgaacctcccatgagcattccgctgagcaatgtacaggttccagtcgaactcgcgacggagatccatgcgcctgaagtgttcatccgtccagcccgcgtatctcgtacgaccaaaagggaggccctttgcgtcttcggtctcatcgagctgctccgcagcttcgttcaaaatactgagataaacacgccagttaattttgccatctttgaacaggtacccgcatcctcctcagcatcaccagctgctggcactgctgctacagtacacatgaacaacattaggtcacaagaaacaggaatcccatccgaggcgactccaaattcatcatacctgaatccgaatcctctgtgttcttgtcgagatgcagaactgcgaccaaccctgccaacgcaccactgtagaatactcgcctccccgtcgccgccgccgccgcctgaatagagagccccagccagggctccgcctgcgcctgcgcgcgtggcgagagcctccgggtgaggagcgaaccgagggtccggagggccatggccgccggccggagtgcgcgccttcttcctccgacgactcgaattcctcttcgccctctcctccgccgccgccgcgcgcctcgattcgatttcttagtggttcatgggcttgattgatgggtttcgcttccgatttccgattgacacggctttggagaggcgttggggggccaaaatataggataggagtccggtttgcctccctcaagtgtagctgcagtctgattcgaataactaaaccctcaactgtagtcacagtctgattcgtatccttaactgtaataaaaactgtaatctcttcttttataaaaattaaaggtgtttccgtgttccatcatccgtgtttgagtcgattataaaaattgaagatgtttatgtggtttgttatccgtgtttgagtcggttttaattttatgttttggttttaatctatatctcttctttactattatagaaattaaagatatttttgccagtattttggtacgtcatccgcgtatgagtcagttttaagttcgtttgcttttggaaatacatatccgtatttgagacggtttttaagatcgttcacttttggtaatacataaggaatcatataagaaatctgtttaaaaaaggataatcgaactcctaactgcagcttatgattttctaaaaatatatatatccaagcgaactcccacagtgaatttcatcttaactaaaccatataataataataagattaaaataaacttcacctgttgcaatgcacgggcattttttctagtaaaataatataataaagcttcctttaactattaaaaccgagttaatttaaccttccgtaagggtttcccatcattctgagcctgcacattttgccacccatttatagggaaaattggagccatgccattataattttgcaaaatttaagatatgccatcctgacccacatgtcattgactcatgtgggtcctacatgtcattgagataccgatgacatatctcaaactttacaaaattataatggcatggttctaatttaccttttttatatcacatgaatgcatgaactcaaaatcattgcagttcactgcaacatctacggacgaattcactgcaacactgacatagagaaagatcagttttaggctcaggtattacaaattttggccttcagatcaaagccaaacaactacgtgtcagtgtacataattttggcctgtggacaaagctcgtgaattgtcaatttttgtgtttaaaccacgaactgttttacgaattaaatttgaaaatacattgttcattcatttttttcttaggaatattcgggatgcaaaatcttttgcagaaatataccgtctatctcgcataaccgttgcgcgaaaatgacgtgggaataacgttgcggacggtatcactaagtgaaaacgcgagaccgcgcggcctcacggaatggaagagcgatcaagcaatcaacgataccggtgccatgcggtctcgctcaagcaatcaacgataatccgtaatccagataattaatcactaattattattattagttaattgttaatgaagtaattaataactaatcaaatggagtcgttggacaatggactgtcgctgattgcttgagccggtctcgctcttccatttcgcgaggccgcgcatggtctcgcgctttcaccgcgtgataccgtccgcgatgtcattcccacgtcattttcgcgtaatagttgtgcgagacagacggtatagttctgaaaaaaaatttgtatcccgaatattcctgataaaaaattgaatgaacaatatattttcaaatttaattcacatggaagcatatgaactcatcaaactcgttatggttcactgcaaacttctactggcgaattcgctcatatgcagtctgaacgaattctcgaaatcgtaaaattacatgaaaacatctgctactgtcgaattcattcagaaaagaaaaaaaaatctagtactgatgaattcactgcaacaatggcctcgagaaagatcattgcttcttctccttccttcctccggtgacattggacacgagcccccggaggaatcttgccgacttggtcaccggcgagtttgcggccatgacgttgtacagcatggtctccacctcgccgatcgtcggccgccgcttcagccgcgacaccaccttgaactgctccgacgccggcgcggcggcgtcgtcctccaccatgagcacccagctctcgccgccgaacctgccgccgtcgacgcaccggagcagcacacccttcttcttgctcagaaggcccctcacctccagccccgtgaaggagtacaccacgctgaaggagcccacgaatcccctcgcgccgccggcgaacccctcctcctcctcgtcgaagctccacgccgggttgaacatgaccaccggcttggtgtccagcgcgtcggcggcggccttcatcttctccacctgcgaccgcccgggcgccaggaacacggcggcgtcgcagctgctcagcgcgtcgggcgccaccgcgtcgagctgcgcgtgcgccgtggattccccccaatcatggggctcccgtagagccacacccatctcctcggaggacggccacacgagcagcagcctcgccggcgcgccgccgccgccgcccttcctcgacaagccgaggcccgacgagaacacgtcggaggcgaggcgcgcgagggagcccggcgagtcgtcgacgactggtatctcggcgcggaaccgcggctgccgctgctgcttcctctgcttgccgagcggcttgcgcagcgcggcggcgaggcaggacctcgcctgggacacggcctcctccctcgacgacggcggcgagggggccgcgcccgcctgcgtggacgacgaggagcggacgggtcgcggcggctgctgctcgcggaggagcagcgagagatggagaagagatcgctgccgctgcggtggcgcgaactgccgagatggtggcgggaacgacggtttgggcgcgagtttggagggaggagtgttcaggaagctcaaggccattggcgccagaagcttcgctgccgggaggagaagataaggtggctgcttgcttttgacatatcaactgctctagtatcagtatgtctcattggccataatttcttcagagattcagtgctcaagctagcctttttttttttttcacttagatgtgattacaaagatggttatgactaactgacagcatgctatgcttaacctttgtattgaggcagactttcaacatcacaaaatgggcaacgaattccatcattagtcactgaacttcagccaacaatgaacagtcagtgtgaagaatacacatattgaagtgcttcatcaaatgagcacaccgaggattatatatgtcgagaatgcttgtacccacacaaactacaataattacaaacaaataatttcatattctcagtgtcattggactgtcgagcatgagttagcgtaagcaaagcattaagctgaaccaggaatgctgaatttgcaggttttgaaccatgataaaaagttattcggttcccagactctcaactcaggctgtgtttagatccaaagtttggatccaaacttcagtccttttccatcacatcaacctgtcatacacacacaacttttcagtcacatcatctccaatttcaacaaaaatccaaactttgcgctgaactaaacacagcctcagatgaatatttcaggaacagaacttgtcaaggattccagggttgggtcatgagaagcagcgtttccttgcataggcagaaagtggtatgtacaaaatcatgcgaaacattataggaactattcaagtcaaattacaggtcatgcctcaaacaatgaggtagatattcatgttcttaatattcaaattcaagcattgttcactagaggttcagattccaatttgttcagattccaatttggtaatcgatttacggttgccatgcaacctgtggccctacagtagatgttcattcagtgaggtatcttcagaaaacattcatgccatcagccatgtcaacaactcaacataagaaacatgaggctgttcagaatcccactcctaggggagtaaccacaagagtaaaacaagttacagttaagaattgtgatggccagtttcataattcaacaaggcaacttcactcaacaaatcatctaagcaggtaatagctcacctcgttttgtgtatcttctcaatcttctcaatccccttctcctcaaactcaccctaagtgaccaaacccgacagcatggacaaatgaaccctcagaaagccagaatcaggtgcactaattgatccattggttggggattagaacatcatcttattgctagtcagatattcggatgacaaagaaacaacttagtatttttaacatgtgctacaatttagttcccaggggcggaaattcagaaaggttgcaggaagagacaccagcacgacatataacagaatatatgtgatcaacgactcaacgaggaaattggtggttaaatgcagggctatgtgatcaacgaggaaattcgtggttaaatcgagggctatgtgatcaacgtttgatttctttccttctgaatgaataaattgtataacattcacttcctacataaattgagttttctgaaattaggccaacattacccacgaattccagtgttgtggacctgctagtaaactgcaagcttctataatcctagcgagcacacaaattcgaaagctttcgttggtgtcaagtgaactcatctacagcagaatacaaaatcaaacatgatagctcaaatcttatcaagatactcatcaacaactcaagttttatttcaagataacgcctgggtagctgatacaggtatgcagacgaaagatcacacctatattactcataatatataaaacctggtacagctcaagatgcccaggtgccggagcatgtgggatgctcagaagacgatgcggaactgcggcgcgccctcgccggcggccgggacgagctcccagcggcagggctcgaggtcgtcggacacggggcagtaccccgcgagcgtcacggcggcgccggactccgccgccgacccgaactcgaagacagtcgcgtccgccttccgctgccgccgcagcacctccaccgccccctgagtgcccccggccgccgagacttccgccacacccgcgccacccgttcccttcgccggctcgggcaagccgccgccgccccgccgccaccacgagaagagccccatctggattagggaaatattagggtttttggactttttggtgggcgaaaaaaaaatctgaaagaagaagagatcgtggagatatcactacccagtgggccccacatgtcagcctctccacaagtttttaactaaagctatatgggcttgtgagttgtgatgcgatgggcttctgggcagcccagtaggaagaagcggcccacggagattagtcgtcgtcgtcgtcgtctccctcgcatggcaaatgcagtggaaatctccagaaaaaggaaaaaaaggcgggaatcacatcgtctactacctccaaacggaatcacacctctcatcctctgctttccgcaaaagccatcaccaccaccaccaccgcctcttcttcctcctcctccgcgtacaagaacctctccccgcgtgcgcccagcacacacacctgcgcctcatctagacaggcagtcgatcgatcagtcagtcgccatcaatgccgccgcggcgggggatcgaggtccggcaggcggtcggcgacggagcagcgccgaggtggcgcatgtcgctgctggagaacacgttcagctcgttcctgcagtcgatcggcggcggcgtggcggcggacggggcggcggcgagggccgtgttcggggaggggtcgctgttcagccccttcctgttcggcaagttcttcgacccggccgacgccttcccgctgtgggagttcgagccggaggtgctgctcgccgcgctccgccgcggggccaggaccaccgtcgactgggccgagacggactccgagtactacctcagagctgacataccaggtaaattcaccatctcgagtactggctttgattaatttctctcctgtttttctccatttctgcgtagttaaggtccatatctgctttctgtttgtgcatattgtgattagttctcatcactaatcttgttagtaaaaattaatgagtatagcatgttttagtttgtgtatgctcttccttagttcatagattatcttctttagcatgttttagcacgttctgaagggaaaaaaaactgagttaaccttacacatttgtcagagattatcttgcttgtgcgcaatccaatcttcaggttaactggcaggaacagctgagcctgataaatgtttgtactttgtactagtgttgctggatcaattttctgaaacagaagttcttgcaaagagtgcaccaaattaattcacatgccgtattgctatcagcaagaacttcagaatcagattcagatgccacggagacagggagttttttcaacttcctgtaggaaaccaaacagttgacatttgctagaagtagccgggttataccagaggataaaacttgcaacatgaaagtaactagggtcatgtggtttccccctttttcttcctgcgcttttctctgctttttcactacagtaacattgcgatctcgctgtctctgaatttacatattctttgcgtctggttgcggtgcaccatccaccatggtccaaaaaaaagcagacatttttttaatcagatgaggaagagaaaaaagcagtcatggcgtgtgccggacgattacgaaaccctaaaaagaacctaatcgctttcacattattgtagtgaaactagtgatcgagttaatcaagaagcaactgctgagagactagccaactgatttttgttcaggtgggaggaaatgcgacgtggaggtgagcggcgacgacgccatgagggtggtcgacgtcagcgggctgtggcgggcggcgccgccgccgcctccgccggacggccgggactggcgcgccgggcggtggtgggagcacggcttcgtccggcgcgtcgagctgccggaggacgcggactggaggaaagtggaggccttcttcgacgacggcgaggggttgctcgagatcaaggtgcccaagtccggcgacgcccaccaagcggcggccgccaccgcctgagaatcctaacctcgccggcgtcgccgcgcgattggagagagcaaattattcttcttctgagttctgacagtgacggtgaagatggcacaaaacttgataagaatttctcaaagatatggagggaccaaaaagtgagcaaagatcatctcacacatgttgcatatgcattaacgtccaatccatgtgcctgcagatgatttgtactagtactaatgtgttagcttaccgttaaaaatggatcattaattagcatcgtgcatatgcatcagcatcacagtcacagcatcgctgtcgaattggtcgacgataaattgggtcatcgagatcataaattcgattccggaatacatgaacatatatacatatctaggtcgctgctttgagaaagttggattcttccattttctttcggccatgatgtctcgctatcaccccgttcttttttctctcccagtgcggcaagatgagaatcggaattgacgaaagcaagactgctttttcttcagatcttcaggtaattgtaccgcgtcgaaactttgattggcctgatggctgatggcactcatcattttggtcactggattgctttagatttttggtcactggattgatttagattttcagcaaataaataaaaaaaataaaaaagcattttttttcactctcagtgcgcacctggcagttgttcggtttttttgtatcactgtagcctgatgccctattaactgaattctcatgccactcgattagatgaacatgtcgacaagtgtcactaggaactccctgttctttccgattctttatcagcagcttttactggtgcatcatgtatggtatcctggagtaatctgtactggcaaatgacaagaaagtgcaacctgtgaagtatcagtacaggtggctcctataaaccggagctgaattccatgtccttttgctctgtttctccaacctaacgttcgtcaaaatcaatgagaaaaagacagagatacgacaaagcagggaaacaaacataccccaaattgtgtttcagtcacgctcagagatgctgaatcctgtggattttacccatctagaattggcctacatgctcgttgtgttcttggagagaccgcccctgggatagaaaattggggtgcagtcgtgcagagaatgacaggttcaggttatgtttattggggaatttcagcctgtatctgaactgacaaacaagagtctggccggctatggttgcttccgcagtcaccttctcacgggctaataatgcagataatattttggttcttgagaaaacaacgaggaatgccatattttttatgtaaaatttagtatcttactttaactaatcatctgagttatggaggtattgagagactaagaggccaaattctacactgaaaaatgtgatacataatacctcttcgaatacaataaagtcacgcaataatgtaactactagtctactacaaataatcatcgtgaaagtgaaacatatcagatacagttactaagctgactgatacaaacatgaacaagaactgtctgaattgagcttctcctttgagctttttggtcaaatgatttggggactccctttgtagtttgatcaggccagtatcaagaagccacgtattttactccctctgttttcctagatagtacttcctccgtatcatattataagactttttagcattgctcacattcatatatatgttaatgaatctagacaaacatctatatgaatgtgggcaatgctagaaagtcttataacctgaaatagaggtagtagataatttgttaccattgatcatcactttttcaattttgaccagtacaataattattgttatatggttagtctatgatgaatgaaagtttaatacctatacactttgataatttggtatcttttaaagtacttattcttttttttggaaaaaaaagaagaaaaattgtcaaagttgaaatgtgaatagtaccttgtactctctcctcgagacttcataatatcccaaacgtatctaccataatattagcacaccaaatctcatactagtatataatcaaagcacaatcagacaaggatgttgtggatgacatcacaattgtcttttaccccatggaaagagtccaaagggatatcctatttttctacaaggaaatgaaaagaggatctttcacagtggtcctataagtagggaccatgtcattccaacaagcaaaccaaaacagccttgcaagcttctcaatccacttcactaatcactaaccttgcaaattttcacaactccaaagagcaaaactaaattgtacgaggtagcaaagcaacccaatccttcagcaaaaaatgatcctaacttgcccaatggacacttgacaagtgtcgcggatcgcagccatcggatgcaatttgattggctcttgatcagcctccggatcgtgtagcgcagtggtggctagcacgtaggtagcaacaaagccatggacatggagcatgagctcaggggcggcggcgtcggggcggcggcgcatgggcatggctccatctgcttctccggcgggccggtgctcgtcgacgggcgacgcatccagcagctgctcctccactgcgccgccgcgctcgagtccaacgacgtgacgctggcgcagcaggccatgtgggtgctcaacaacatcgcctcctcgcagggggaccccagccagcggctcacgtcgtggctgctccgcgcgctcgtcgcccgcgcgtgccgtctctgcgcggcggcgccggcgggcgccgccgtggagtttctggagagaggccgggcaccgccgtgggggagggccatgtcggtgacggagctcgccgactacgtcgacctcaccccgtggcaccggttcggcttcacggcgtccaacgccgccatcctccgcgccgtggccggcgcatccgccgtgcacgtcgtcgacctcagcgtcacgcactgcatgcagtggccgacgctcatcgacgtgctgtccaagcggcccggtggcgcgccggcgatccggatcaccgtgccgtccgtgcgccccgccgtcccgccgcttctcgccgtgtcgagctcggagctcggagcccggctcgccatcttcgccaagtccaaaggcgtgcagctggagttcaacgtcgtcgagagcgcgacgacgacgtctccgaagaagacgtcgacgacgctgtgccaagaactcgcgtccgtgctgtccgacccgccgtcgctggggctaagggacggcgaggcggtcgtcgtgaactgccagagctggctccggcacgtcgcgccggacacgagggacctcttcctcgacacggtccgggcgctgaacccctgcctgctcaccgtcaccgacgaggacgccgacctgggctccccgagcctcgcgtcgcgcatggcgggctgcttcgacttccactggatcctgctcgacgcgctcgacatgtcggcgcccaaggacagcccgcggcggctggagcaggaggcggccgtcgggcggaagatcgagagcgtcatcggcgaggaagacggcgccgagcgctcggagcccggcgcgaggctcgccgagaggatgagccggaaagggttcgccggcgtcgtgttcgacgaggaggcggcggcggaggtgcgacgattgctgagcgagcacgccacggggtggggcgtgaagcgggaagacgacatgctggtgctgacgtggaaggggcacgccgccgtgttcaccggcgcttggacgcccaactagttgagcctagcttagcaatctacagtatacatcaagtgattaaagcttaagctggtgttagactgtctattagctcagaagtgacaacggagaatcaactgaggaggaatttctggttggatttagtggatcgttttaaacttctacttccatgacaagatatttcagttgaattcttgatgttttactctcaatctagattgttttagatcaattataaacatgcacctcccccaaattaatatccgtgaattactgttggaatcgaaatattttctggtgagaatgatgattcagagggaaaaaaacggacgtgagtttggatgcttaattgggtttaggcccattatattgaagcctacactaaaattcacaacccaatccaattataattggcccaaaagttatacatcatgtaagattcataaggcccaataattattgggccgtgatgagcacgatccaattgctacccacaaggccacaaatccaatcccatggtcgccccaaccaccaccgctgcatcgccgccggcgatggaccggcgagtccagcggctggtcagcggcgtcgccgccgccgcggccaccgtctcgctcctgtacctcatctcccacgcctccacctcctgcttccccggcgccacgacgcttcccctcgcccgcttcccgcgaacctcctgcgacgccgcctcccgccgcgtcgtgccgccgggccgccgcctcgcgaagctccgcgcctccgcgcgctggcgccgccgctccgtggcactggcatcctcctccgcattcgcctcgctccgtggcctccgccttctagctggctcctcccgtgccctctgcctggccgccggcgccggccacgccgtcgacgcgctccgcgccgagggggtcggtgacgtcaccgggatcgacttcgtcgacttcccgccgctcgttcgccgcgctgacccccaccacctccccttctctgacggcgccttcgacctcatcttctccgacgaccccgcggggttctccggcgccctcttcccgtccaggttcgccgcggaagccgagcgcgccgtccgttctggaggcaccatcgcgctcgccgtcgatcggcacctcgatccgtcggccgtcgcggtgctcttcaagaggtcccgcattgtagaccagagggatctcaccatggatggatcacaggttaggatgctcatcttccagagtaatggcactaccttgaactcgcattaattcgtttatcattgattgatgccatgttatgctaattactgtttatgttcatgttgtaatgttagatgcgtgtataaaactaagctccgattatgtgtaaattaagcaaggaaaaatgtgacattatctaatgccagttgatgtgcatgaatactaccatggacccatgattttccttcagccatcacttttattttgctgctacaaaatactaaatcagcagctaccaaagctaccatttcatcataaaaaacatgtgctgaagcctgaaattgctacttaacagacgatactggaatgccctctaaataataacacaacccaaaagtttcatttttttccgatgtacttgttatgcgctgcaattaggataaacatcaataaacttaaccctgagtatgaagcttcttggagtttggccagtccattttcttcgctgcgactggtcacttgttgctacaagctgcttactacgatagttgattgagagacgttagtagttaattaagctatttgcatctggcgccactgccacactttggaaggagaaaagcatagtatctactataatactacttgaacacagtgaagaaaatggctcacatatgatatcttaagatcttgtgcaatcctttaatggcgtcactattaaacaggacaatttctgataggaaactaatcataaatcagtagatttccttgtatggagtaagcatttagttatctattcttctttcactaacttttggagagtggtaccctgctaagtgtttagattagcatcgaaatataggcataagcaatattgtcctcatttcagaaaacaatgcaggtcaatgttcaccaaggtgccaagccctaatcagaatgtgggattacataacagtgtctagctcctaatttgcgataggactaggatcattcacctagctgggatgcagatcagaatgtaggattacataacagtgtctcttgcttttcatctttccatgcattcttcattttgcatatttggaagaaattattttattagagtaaaggccagaaggccatgctttttctgaaagcgagtagttttgcagagttatgctggggttaccagctttacattcaacccagagcacacaaggcaaaaagaggagggcaaccaaaatgccagaaagcagggtagaaaaacagcttatatctaatcgaagcagaaaaaaccacaaccaactccagaacagtactccttaagcagtgaacagtctcttgcaacgctgctatcagggactccaaggaactgaagggaacaatctcacactgtctcagcgacaccttacactgcaacaaaagatgataagaaaaggaattgttaggggggttagaaccagcttgtgtctgaaaataatgccatttcacacaatccagagttgccaatacgctgcaagacgaagcataatcttaactctagaaagttgagatccagttctcccaatgtcaaggttaaaagaatcctgaaagctaatatagggatcatatcccaccccaaggcaacccgacaaacacaccaaatgaatgtgtctatagggcaagtaaatgaaatgtgatttgcatcctctaactggtcacagagttgacaaaatttagatctcacccaatttcttctctt

SEQ ID NO: 15714 - DNA, 6320 bp, Oryza sativa
ctatagactgacttttggtagtacaattcctgtttttctctgaaagccacaggttagcttatcaggatttgcttgcaaagctacattttgcagcaatccttctagctcttcccaagaagttaactcagcggtcccaaaagacctcgtgaacgttaaaatccatatttggatggaattatgacgaaggtgtctctcttttttgccaatgattgtccacctatccctttatttgcaacatctataatggcataagacatatatagtacaatgttttgttctcttctattgctgttctgttggctttgtgttctcttctacctcatcatgcctgcctgcctgctgaattttcttcgttggagtcttcgtctttcctggatgcatgcatatccacggctggaaaatgtgtggaatggtagaatgattggtctttttctaggtaaaatcaattcaaagtcttttcagtaactgttcaccattgacaaactgcggtaaatgtttgttcttgccgggcctttgttgatgggcgacacctcgaggcccagcgactttccttcggtctatagcctacaattgtacatatatgcacaagtcaagatgccgctacaagaaaaaaagggggcccatatcacacttaaaagcttggcctgccaataattttgatgaatgttttgttcattacctccaatttgaccaaaaaaatcagcaagaaacccatgtcatgtggtagtgtgaccaaagagctttaggtggccctgtagcagaatttggtaatcacgaatccaaatatatgaagcccaaattctcggtactgtaccagacaattggacacagaaccaagcataccatttggcttttgcaacttggggatttttttttctttctgttttgtgcagaactggctgttattgcagaaattcctgcattccaaacaggccaaggtttatactagctgtgtggaggttctgaatatcttcgtttgttgtgaaaaatcctgcactccaaataggactaggcttaaactagctgagctcaaccgtagggtgtgtttagttccacgttaaaattagaagtttgaaggaaaaaattagaagtttatgtgtgtaagaaagttttgatgtgatgaaaaaattgaaagtttgaagaaaaaattgaaaactaaacaaggactacaactaatgaattcttctaccccggaggacgctggagctcccgtggggggtttgaggggaccctttgagtcgaacttgataattgtttacatgcactacactacacaacacaggcagtactactacttaatatctactaggcaggggcggagctagtgtatactagggggtgtccaggaacccgatcaagaaaattttttagctataccttatctattttcatcatgtatacacctcctcaatgcaaacttagacacctatattagtttaaactcaatctaaagtagagtaaattaagtaagtgacaccaccctttattttgctgtagctccgcccttgttactaggcatgctgcaagcatgcatatgctctatataatcctagagcaagctgacaatgcaaccacagtacagcagtcatagcctccgattgattgtgcgcatgtcggtcgatcggcttcacgaactgcgtcgcgacgatgacgacgacgacgacccggccgatctgccaatcacatcatatcggcgcgtgctgcaggccaggctccatcgatcacacgtacactgcacccctcgcacgcacatactgtacatctcgctgttaggtcgcgacgccactgtcgcccgacggcgaccgcactggcgaccgcgatcgctggcgagatcggaatgttcccccgtcctgccggctcgatcgatcgtcccctcctcgtcgccaccgtcgccgtcgcacttgaccggccggccggccggccaatcgtcggagcaaccaccacacaccctgtacgtacgtgtcaccttcctcttgttgcctatcgcctaatcgaccaactgtactgcaagtgtgcgtgtgtgtgtgtgtgcagcatcatcgttcgccagctagctgggtcacgcactgtgtgtcacaagccacgaattatgccgggtagtgagactatgtgtcgactactgccaatcagtagggattgtctgcagtagatgtcgctgatatatgggatcccgggtccacgtgtcagccactgcgccacgggaaatgccaagcaacaccgcaactgtaggagtagatgaaacacgggtgcatgggcctgggggctagcttgtcgtctcgtcgccgatcgatgcaaacgagagatgtggcttaattcctgggcactgcagagcgtggccgttctccagtcccagatatgatgatgatgaggaaggaggaggaggaggccggcgacaaacagccagggacaagctaaggcaatggcaccagctgacacagccatctccctaccatccgtgcaccagctctcacggaatggggctcctgccctacatgtccccttcggttccttcctcctgcacgtgtgcatgcatgcacgccagccacttgggctcactgtgctgatctttttcacatgagatatatatcctattgattaagaaattgaataaaaaactttgtttatactcttttggagcccattagtaacattaaagaatcgtatgtgtttcaatctggatcactattctcgtcacgtacatcattcacacgttgcaatctgatttgtctaggatcaggtatatatatatcgatcccagctcccagctgtacttgtgtgtgcttgtgtgttcaactaccttacccaaccacccaagttgtcacttgcctcttgatgaagatactaatactagtatactactgaatattaatcattggactattgtgtgcacgtagaacaagtgagtgtgcatatacactattcttttcatctcgtattatagcaatctattacgaatctggatatgaacatatgcagattcataataatttaaaatgtttctcgttaagtattagttaagtattagggagcggagaaagtagccagtattccacgtatttggatggataattcatggttatggacggtcaagatgtagacacgttgtgacatggggtgtgccaccctgcaggtggtggtgtggtcaacaggctggttgccgtcgagctaggcgcacgtacgatggaacgacaagcgagcgtgagacgcgcagggcacgttgctatcatgcctcgcctgccccatgcagcgaccggtcgtcccgggagacgattaaattcgatctatcgatctcccaacgctctgggccggctgccgcccagctcgctgtgtgtggcatgtagtgggtggatggatttctcccacgtgtggaaatttagggttcacgattccgatgccggattgaaatccactcacgagcgatatcatcagatttcggtggaatacgttaagaaaaccgataaaaaccaataaaatctgaatattttttattaaaatttaaaattcagtggtatatggtggccaccacacgcatgccaagagaatagtagatatggaataagggagaagccacactggcttaggaggaggtagcaactagcaaatactactctctctgagttgataatagttgtcgttttggacaatgatacggtctctaaaaaacaactttgaccattattttttattaatatgtataaaagtgttaacaaatatatgatcttattaaagtactttttaagactaatatatacatgtagtcactatatttgaaagacaaatatttttaaaatgattcataatcaaagattctaaagtttgacctcacttttatttaaaacgacaagtattatcagcccggagggagtcctagctagtccgcacgcatcgtgacaatgcacatatgagtaaccaaccgcacattgctagtactatccgaaggcaaaattgccacagaatataaaataaaaagtctgctctttaatttgttggtgggcatcgtgagaatgaggctttacccaacaacacctaaaaacaaaataatttgttacatcacaccgcgaacattaaaaatacaatattcacttggttgagatgagagaggaaccacataaagtatttattttacccttgtcttagacttccttcccaattggttgtgcatggtgacggcggagctgtcttgggccttcgtctcatgacagagtggctcttgcacggtgatggcgaagtgatcttcacggtgtttgtggtagcagaaccacccccaagcagcgatggtgttagccctgaggaccaggggattgggcgattggcctcaacaatagcgaaccggcttcgagataatgccaacgaagcgactccatccgtgtggtatagcgtgcgttgcttgccatggcatacttggcacgaatgcactattgagcccactatcatcacttgttgcgtcgttgttgtcgtcgaagccgtatttggagtcatggggatgaggagctgcccatttgattgggtcaaagatcgaaccactgggctaggaaaaaagtttggtcctaggggcaaagtatccatttcacaaaaaaatgtctctcgaaaacaacaagaaatcataaaagatgtgtgcgtgtgatattcacaagtaaataaccacgtctttacagtgttcatggacaaagctacattatcacattgcctccaacaaagatcatattttttttccatggcaaattctttgaatgttggtgattgatagaacaactctgaatagttctaataatgtttatttttctatataaattttaaatctagaagtgattaattatattttggaacggatggagtaaggaataacaaaatgaattatacgtttgaaaacaaacgacctgggaaacaaagctgtagtacttttccagaggagaaatcaacaacaaagatacggttggctaaaacgacagcaaacggaacaatcatgtcgaatccgagaaaaggggcggccctttcttcctcctcctacccctctgctgctatagctgctgcatcgatttgcatatgaatgcatgcattgatcgatcctacagacagatcgatgctttcatttctcctttggattcaggcatcgagtatttggataagcttctcctgcctttttctcttgtcacagtcactgacatcgatcgagctagctctagctatgccagggttaatctgagccaaaagaatcaacacaactacagaagcagtgttgaaaaaatggggcagtgccttttgtagtttttcatcagctgcaatggagtgcaatactgcactggaccaggcagggtcatggtcttctcttgaacaaggactcatcagatcatatcaccagatgcagtcagcatctgcttcgagctgttgctgttcctgtcaggaatctgctcctttttttcactgcagtgtactactagccatgcaagagctagggggacatggagtcatggagcttttgcattctggccgtttggtgcttgtgcttcatcacattcacatgcagtttcatgatcaaatagctcagctagctgctgctgatgctgtcaccagccaatcttcagagaaagcttgcaccaaccaagcacggacttgccgatcttggagctttcctttgcaataagtttcgatgaactttttgccggtgtgacgtttttccacaaaagagaggacacgaaaaaacagcgagaaagaagatgaaaaggtgacttcaattttttgtctctgtattctgtcatgcttcatagtttatacacaaatgggagaggcacgcaagaacagcaagaaagaatatgaaaagtgtaacttaaaaaagaatgacaaagagacagtctatcagggaaaaaggatggattaattggtgcagaaacgtgaaacgaatagattgatccggtcaaaaaaaaggcctccttattgtgttgattttagccacatatatatgttcatgattcatcgtgactcatgtgtacaatcctatatgcttaatgtatcaccatattaacaatgtaaaaatggttataacgtgaaaaaaaaactattgagaaaaatggttagatgcgtggtgaagtaattaaaaagacaattctcagccaacaccatggcaaggaaacatttttcttcaacttatcaacttatggataatgtgtaccagttctcgaactaaaatttctaacagaaaaaaaaaattctatggacgttagtgttgctttgatacattaaactaagctatttgttagattaatatatagtaaaataatatttagttcatcccaatataagcaattgttcatgatatgcccgac

SEQ ID NO: 15715 - DNA, 598 bp, Oryza sativa
ccttgagtacgactacgaaggacatgaaaagcaccgcacaaaacagtggaatctgtgtcgaaacgattgacacgagtggtgaaaataagtcgtattatgggaccatacaggaaatatgggaactggactatggcctgaatatccaaatcccagtgctccgttgtgaatgggttaaagacacaacaggggtttccgttgatgactacggggtaaccatagtcgatcacagtaaaacaggccacaaggatgatccatgggttttagcagagcgtgtggctcaagtgttttatgtgaaggacccttcggatgaaagaaaaactattgtcatatctggaaagcaacagatcgtcggcatcgacaacatcgaagaccccaatgattacaaccagttcgacgatgtaacattgtttactgatcttcctatgcgaattaagaaggttgagagtacaatcgataaagcgaatatgtcgtacgttcgagcagatggtgttgccaaggttatttagtcatagttattttgtaacctttagttgtcattgtgttccaaatgtacgtgcatgaatttaagtcccccttatgttgtactcattagcatgta

SEQ ID NO: 15716 - DNA, 2129 bp, Oryza sativa
  unsure (1)..(2129): unsure at all n locations
ccgctccccgccatcgtcacctacaggtcagaaccccggccctctcccgctcttgctaccctaccgtacgtcgtgctctctcaggcagctaccgcgcaccgcgcgctggactggtttgatacaggatttgcgtccatttagcgcgtgttcatatgcacagcttgcaagttgcaacgtttcgagtgtttcagcttaccatgcatgattattcatgctttgctttgcttttggggttgtatacatttttcgggatggattttgggcgctccctgtttttttcccttttcttttgaatttttagcacagattatttactcaatgcttttaaaagtgtgatttctctaatgcttttaattagtacttatgcggctagactgcgttcgtttgaaacgattgggatctttttcctttcccacgtaaaccacataaacaggaacagtgtatgattaattaggtattggtttaaaatatattaatatgattttgtaagcaacttttacgtagaatttttttaagaaaataacatttaccacctcgtaaaaagtttgcgtggaaaataagaaagtagtagttaaaaaaagtgaagcgaaacatacctgatgaaccctgagttcatctcgacactcaaggctgttgttggcccgatctttcggtgagttgtgataactacgatttgggagaaacgttgacgatccgactacaactgtacaaatccgttgcgttgcgccttagcgatcgatacacctctccgtgggttgttgatcttgccggtgcaagatcacccttatccctgcaagctatcgagaccaagcaagaccgagatataaagcanctgaattgctagatagacaagacgcacaaagataaattgatacacgataaagtggggttccgaacaagcagacggacggtctagccgacacgcgcgctgcaagcgaagtagcaatggctaaacttacaattaatcaaaacccgcgaaactctgaaggggtacctaactatttaaagagataggaggacgaccaagggcactctagggtcgtgctccacctggttggggcgcaccccacttgggccccacttgggccagggtcccaaacgaagttacaagcccaaaggcccatgacaggtgacgcagcaccttgtttgttcatccgcggatgactaggatggaatttggcgatgaggctggatccattggaaagaggactccgtaggctttccatcaagtactcacgggccaaaaacggaggtcgtatgcagattcggcggccgtttgaaatcaacagtgcagcaggtggccgaatcggattccagcacttggagaccttgatcttgatgtcttcttgttcacgcattatgtgagcaatggttgtatccgtagtagccatggtcacatcagtacccgaggaagatccaagctttttctaactatttctttaggcggtgcagagaggatacgacaagaaaaataaaacggcaacttgactaaagagtgaacaattttattccttaatgctggccatatacatattataagagtcacgagctccctcaggaatcaaacactttgtagtttgtactctagtatttcctatactcactccgtcactcgtcaatacaatataggttaattcttcatgagacttgatatagtttttagtactgcgatttgtttcaacaagatgagtttgcgccaaggtacgatgccgtcgatgcgtactagatacatataaagatttcgcctgcttttctaccacatccagaagttgaatttagaagagtttgattttgaagtcattttatgaaaacaattttttaatataggctttcaaaccgctaataaaaatattaaaccatatttttgtttgcttcttttcacgtacatgtcagctgtggttttgaacaatcaaagtcgtatgtacccctgcattcttaaaaaatcaattctaattataaacgtagatatatgcgtgtcaggtttgtaaatagggtttaatcttcttttagacagagtagtaggcccaaataatttaagcgaccaagtagcatgtattttatttccagtacgtgacacttgtgctctatccgctattagtagaacttttttttttagaactggtattagt

SEQ ID NO: 15717 - DNA, 7936 bp, Oryza sativa
tgcaagtagctcatcagctttgcacttcaaagttgtgttttgctcaagttttgcttagtagcaacgtagcatgccttttatttactccatcgcttggcaatttggcatgcctactgatgattatttggctttgatattttattggtcttgcattactgttactttggctggatgctgtagagtgcagacacaagaaacgacctgctgctgcactcaactaaaaatgtttggttgcactggttttatataacattgaatgacgattgaattgtggttgcgctgcaccaatttgttacacagctgttgattgcatcagttcaactgctcccaaactgacaaggagtatcacctgatttattggtggactgtctcaacctgtctcagttggaacctcgtgtaaagaatgcgacaatcgataggtataatctcaccaattgtcaaagttcagttgtaaaaccattaaacaagcttggtatgtcaaaacccaggatcaatatattctgttcatatcttagctagagcaaatgataaatgattcaatgcacaaatgtttgttcatttaccaaccaaaaatgttagaccagtgcttgttcatctatcaaccaaaaaatgagtacatgaattgtacaccagcgtgatccatcatggctcgccggcctccgggatgctttgcagcgtgggctgccagtgccgttgttggtggtgatcaaccacctcgccggcgttgatgatacccgcaatcaccttctcgtcgccggcggcggtcatggacgccatctccagcaactcctgcagctgcctcttgctgatcctgatcctcacctcgacgcccgtcatctcctccctctccggcgacccaagctcgccgtcgtctgacggcgcggcggcgcaattgcccatcttcttcttgcagtcttctgaatatcgaagaggccgttcgtgcgagagacgacgtatttgtagcttctgaagaaggcagagaagcgggtcagaaagggtggctgatgcaacgtgcaagctgcggaatttatccactgcgatacagtgcaaactctgaattccaatgccaggatagacctgctattttctgtctctctctttcctgacccacagaaactgggtttaatgcaactgttcatgcacaaatgagaaatgcgcactcaattccaaatttgtgcttttaatacttggttgttgttcaaaagtgtacattttttggtcaaaaatacctgtttcagtctgaataaaagggttgcagttctttgacggagtaaatacaaaactgggagttgcaaacccgcagccatcatcgtgtgaactttatgggggaaaaactatggcagatgcgatcaggcagtctgattttcttaatgtttacagtttagtgttgaattttattgatgttttcttggaagcatacagacatttcacagcatataaacaatgttttactaagtggtagaaacacgagcatttaacaaatcaaacaaggaagcactcgtagtttctttctgaagcatttcaccttaaacaaaagaacaccacacgtgcatctttgaaatacagcgtactttcctctgataagttgtcacaagatggtcacaagatgaaattcttggacaaggaggcaaatttgaccatgctgacaaattgtcctcttagatcatggttacaggatgaaactcttggacaaggaggctaaattgtttacaatgataaatgaatgctcagcgtcaaaaaaaaaaaaatgaatgctcagtttcaacttttactgagttgcactccgttcgtgtacaaaagttgatttattttagaacagaatgaatactatattgtattcgtcggtacccaccttaaacaataggatttgttcctgtgtgaaaggaactgttcatcatcagaaatatttgtatgcagttctagtaatctcaaagcttccaggaaagcaattatatagttggctaagcccataactgcaggtgatgtgactgtaccacctaacagcaatctttgtcagatccaatttttattcggttcaggaaaagcccatcaattcgataaccactaatcttgaatcttttgcaactgcacagtggttgaaggaagtcaaaatggttcgaatttattgtctgaaaaaaatggtgctaggatcgtatagaaggaccttgcttcgtcagatacttaaacttggaagtcttataactgggactttaatttctagtaacaaattgatctagcaatagagctagtaaaaacaatggtctaagattattgtttgcagtgatccttgatctgatgacctctaccagtatcaactcaattgaaattccaaacttgaaatagtagtatatattagaatgagcgtacactgcagtaccaaaagtgaatagtatccaatgctggatacatctgacacctgataagattaacaatccgaaaatgcaggttctttacaaatatgatgagcaccctgaaataaacaactattacagcagccacaagattgaataaactcatgtgcacaacaaactatagatctttgacattctaagaaccaagagaatcttaaatatcagcagaagcatctatgtaagaatccaacaatgcaactgattactgatcaattaaccacacttactagatacagccagtgtgtgtgtagagtctagaactgcctatacagcgaagttaagagctagccatgttcatatgcccaccattttgtttgtgccaaactacaagataagctccaatcaatggagctgaaaatgagatacagttgcagaatcataatttatgcttcgacccaactgcctctgatcaacgaatttaattgcaccttttgatccacataattgatagataggagagtaccaccgtactaggcttggtgatcagatgctagtattgccaacgcagatattatctatctttatggactactgatggaacagtagttgaagatctctgaacattaactgtttgtagaggatctctgaacattaacttgtgaaccaaataagtcaggagtttacggctcgacattaacgacgaccagtaagtagaatacagcctgcatggaaattttcagaataaacactcgtacaggtacagcaagtgacttgaatccttcattaatttcctgaactgctctgcttagtgttttctgaatttacagttaacctagtactctactatatgatcatctcacgaaaatcaaggtcaaaactacacatgagcattcagacatccaagcttcctttccctcctcccaatgacatatatagccaccgtgattaaacattattcccaacttaattaattcatccattgattaatcaagctattggaattctaaagcactactggatcgatccaaaacatccgcgatttttccctcatcccaatggtccaagcatcgatgctctgaagtctgaacttggcccaaaaaacccccacattttcagatccctacgcagcatcaatcacaagatccaagaaagagaaacaagagaaatagtgatacaactccactactccagaaacaatgaaacatgcagtgttcagatgctcgagctcagatcactatgcttcgagcttgcagcttccatgcaaaccaagagcaagctctgctcagctggcaagactgaactttctgaaacttcaccactcattctgaagctctagttaatcctacacactataatttatttggcagcaaggatcatgctcggattttgtatattagagaactatatcaatcatcccaaatggtctctgtgggggccaaccagccactgtgctgcacacatggtggcgtgatgctctccttgaccatgccaatgggagctgcacattgggtaccatttaattagggtggtctggctaattaagggagtgtgctgacatgattgcaatggcttctctttacgattattcatctccccaacttggagcttgcggctccactcaaccaatatgctgctgatactagtagatgtctagaagaaagcagcagcatcctgtatgcaaaagctttgcatctgcttgccttctctggtttttcatttgaggcaagttgatagccccctcgtgcactcacattattaaccccagtttgcaccaaaggagaaacatggctgattagattagttttgtagggttctctaaagatgtactgataggttgctacctgctagtaactttttatgagataggagatattggtgtccccagccaagtataaaaataatcctcctactatcagatgtaagacattttagagatgagcatatgagtcaagaagaaaattgaatccattttactccctcaaacttatactatcggagcacttaacattctaaacaatttttcggctcagttttataccttaaactattcacctcactcctggtatttctctctttcgctataagtcgtattttacactaaaattatgataatgcattataacactaagaccaatttaaacatcgaggttttaccaagcatataatcataaaaaaaatactcactctatcctaaattgtagggcgtatatcatcaacgactacaaagttagcatcacatgaaagtcagtagataaacaaaacttgcgcaaatcaattaagtcacttcttcggcttcttgaaaactcctatcaatgaaattgatacgttccaaacagaagtatacataacatgcactattgtctaagctcaactatacgaagaacttttgctcatggtgactttgttaatcttacgatataccggtccggtctctgggggtgcacgtataaacgtgtgttcatagaaacgagtgtgtacacgaaaaagaaaatccaaaatatgtaagtattttttaattagaagtagatgagaatgattgtagaattgattgataagagaaagtagataaaagagaatagttgtgattgattgagacgagaagataggtgaagaaataattttatttgaaataaggtagtactaaaaatagctataattaagaacagtggtagtacgtgattttcaatacatatttttccgggaaattataggtggacagtgggctggctccaccgggagaccggcggcatagtgataactgataaggcacacgcacaagcagccaagcacggcatcgggcatccccaaccccaacccccaccccacaccacggcgcaacgcaagcaattcgtccgcccgcccccgcccccgcccccgccccgcggaaccggacgccgcggcgccatgttccccgccctgtgcgcgtggccccgccgcccgcacgccgcgttgcgccttcgactcggcgtcgtcttcaccctcctcccaccaaggggtagaatcgagccacgattttggtcggtcttttggaccagtggcgtacgagctaccaccacgatgcacgcgtcggcatttatgcagaggcgcttagccagcctaccacacacgtcggcagccgacggcgtcctgatgaccactttcatgtgacgggccagctctctactcttccccccgtactaaagggacacgccacgaactccgtgatccaccaccaacgatgtcgttagttggagcttaacccatcttgatatttggtctcgattaattaattactcgtgatgatctcaatcaacacgtttgctgcatgattttgctacaggagaacgaaaggaatgaacgaacgaacggcaatgcatatatatgctacagtacaggcacagtttttctgtcccgtggcacgtgcgatttcaccgtgacatatagtattggctgccatttgggtactactagtactaaccggttgaagtgtgtcatatggaacttggcagttttgacaggacacgggcgcatgtgctgcgacgcgaacgtgggcagcacgtcctcctgcgcccgcccaacacccggtttgttcgccgagctggcacgctcaggcgttcccagctgtgacgtgccgtgacaagcttagatccttatattctggttaggtgggggtaaaactttccaggccctatcacatcggatgttggatattaattataaatattaaacgtagattattaataaaatgcatctataatcttggattaattcgtgagactaatctattgagtctaattaattcacaattagcctagtaaacattctctaattatatattaattagacttaaaaaatttgtcaagcgaattagcttttatttatgtaattagttttataaatagtctatatttaatactctaaattagtatctaaatacatggactaaagttaagtccgtgaataccaacaccaccttaatcatgcgatgtaattaaggatgaaaaaaagaaattcatgtgtggtttatcgacgcaggatgagaattatgacgagatgaggtgatcgatcgcttcatgcaccgcagatctatcaatactgccttaccagcgtttttgcccagtgaagtgaatccatgtatgccaatggaagggaaaattagaaacctaaaataaggcggaggaagacaggtttcgaagtgatattttgccgatacatttctttggtcaaggggcagttaaggcctacacataacagcatattagtttattggagtgacatgtaaggggtactaccattttagaaatgattttaggttggtttcttactttactctatcaaagaaaggaaaattgaacaagtgcaatgcccagccaaaaaagtcatagggttgctagcatatcttaggacaaaaattgaaggttgcaataaaagctcatccattacaaccagcagatatggcatcattccctcttaaactccgctttcatcctagaaaaaaatatatcggtacttttttaatggatagtagtaattttttaagtatacttagcgtcgttttacctcaactaaaactaatgttgtttcgtagtactccagacctttaaatatagaaaaccactcgaagcttgctaaaataatattgattatattttaaaatataatctaccaagaacaatatatacctttaaaacaagatttcatactaatacattttatagttattttgatgaaagaaatatatatatgtttgaactgataatgttttttttgtgtgtgagagagcaaaatgttttagtactaactatttcgccttttaaaatttttgaacgtataactttttgaagtattcagaacttaatgttccctacatggggcacaatgtttcaattagtgttccactcagatactagatcagctactgacggatttacgccattcccaaattctatcttgtattctccttcgaagccagaatgagaaatggatagtgtcggatatctcatcatttatctcttatcctattcatatttttttaatcagacagaagaacaaaaatctatttgcatatctaatccataccatagaaattaaatctaaggagacaattaaaacataaaaaactgcatcaagaaaaatatgttatattactcgttagctattttaccatgtttataagtggactcataatatattttagtatatatttgataataggggacacagtcgctattcttataccctaagcccatatttttcggtagatatagagttggattttggatagtatcgtgtatcttttttctcttccatatccttcacgtgagcttcaagtctggtgggcaaaatattcatctcattttatccacatctatttatctatagtgttattttgctgcatactatttttatcatatattttctttccaatgttatagtaagtgatctttcactgatggttaactgaaacattttaagcgcttgatttttatacttatatcgacatctatgctcaaacaaggctaattcaactcaaaccatttctctcacatatcctaaaaatcataataacaatagtactaacccataaggagtacatcaaaatactt

SEQ ID NO: 15718 - DNA, 679 bp, Oryza sativa
  unsure (1)..(679): unsure at all n locations
gttaatcttacgatataccggtccggtctctgggggtgcacgtataaacgtgtgttcatagaaacgagtgtgtacacgaaaaagaaaatccaaaatatgtaagtattttttaattagaagtagatgagaatgattgtagaattgattgataagagaaagtagataaaagagaatagttgtgattgattgagacgagaagataggtgaagaaataattttatttgaaataaggtagtactaaaaatagctataattaagaacagtggtagtacgtgattttcaatacatatttttccgggaaattataggtggacagtgggctggctccaccgggagaccggcggcatagtgataactgataaggcacacgcacaagcagccaagcacggcatcgggcattcccaaccaccaacgggactcgagatcacggtatattttaagctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15719 - DNA, 803 bp, Oryza sativa
  unsure (1)..(803): unsure at all n locations
ataagttgcacatgagctccgcgtatgtttgtattctcaagcgtgtcttcttgccagcttgccgctggtctgacgcnctggtatcaacgattctgctggtttggtaaataaatctctcggtttccctcaaaaaaaaaacgcctgcatatttcattcctcacttttcagagaagccacaaccacaaaccagcagcgtgaataatgtttattacggagtaatcactatttccatcagctgacaactttcgatactgaattactgatactcgttcagtctcctgcatacacattacagataagtactgtagtatttttgcatctatgtcatttctcaattactcctagtgccctccattgctgagcggtggaaccttttttttttttttagagaactctgagcggccaatctatccatcgttgtcctctgcgccagatttgggtgccactcgacttttgggtggtggatctatcacgaacagtagtaaccttctgatttgccttccttgaacctctgccagcttcaacttaattatttgtttctttccaaaccagcctccctatagatcagtagctgcaataaaattgtaaacattagccatgtgaaaagtatatcagaaaatttatcttcatatgtagcttcataatattgtataaatttacaatatccaccaacataaaattgtagaaattaatcaaaattactggtaccaggatggcatgtatgtgtaaacagtgtaattttcatttctattatttatacaagctctagttgaataatacaggtgatgaactactgtaccatc

SEQ ID NO: 15720 - DNA, 787 bp, Oryza sativa
caactgatcgatacagttttcaaccagctagaacctactccccccatcttataataaatttatttttgactcctcatttatcctaaaataaactcattttttaagtaaatgtatcagagtttgtgaaaataagaaataattatattaaaaataaataaagtgaagaatatctatattgagatttgataaagtaaaagtattcttatcttttaagttttgtgttgatgtgtgagataggtgaaaaaataatttattttggaatgaaggaagtattagagaagcttagtgatccgataacaaccgtagtcaactaagaaatcttaggttacatccttgcccaacccaaaagagaaaaacatcgagtgattcaaactgccacgttatcaaaagatcatactcatagagtacagatcctgagacagagcatccttgcctgataaagttccattttaagctgcaaacttaggcataaaccagagctttatataataattctctgaatggacttgaacattcataggtcaaacgtccagcaatcacgtacacctttcttctccagactgacatgaagtacaatggaaaggagtagagcataagcagctgaatattacaatgatgtatcattgccaatcacagatattggttccattacgaatgatgaacatgaaacacctgatcatagcttgatgtgtattgtttccttaaaactcatcatgatcatcaagcaactgcgcagttatgcatgcaaattctttattgcaagtatgatgagattgaacactttctg

SEQ ID NO: 15721 - DNA, 781 bp, Oryza sativa
  unsure (1)..(781): unsure at all n locations
agatattctcaaatgtacaagaagtatgctgaggttacttctaaaggtggtaatagagcttcaagtatgctgttctggaatataacatggtgcatgcatagcaagataccttgggataggggtgccgtccacattggggtacattcccaatgatgtcgcataagcaaggatcatcccttcttcaggcctgaaagttccaagctcggctaatctcagggcatgaccacccactgcagcagcaagacttactgctttttctgaagaactcaagaaaattatcaattacatgatgtactgaaatacgatcaattttgagctttataaccagatgcctcatatccagtttgaaacaagaattgatggaacaaaaattacaaaaaagatatacatattttatttgctaacttaagaatagttgatgtgatcagcatagactgctactgttgattgcaagtgcagaaagagttgtccaaataactacacaaagaaatactagtatttttggggtggcttatgcaatgcactttgacatgactgttccatgaacagtagcagtctattcgagcatagttgacatttagtactagaatgataatgcaagtgtagtatattcagtaaacaaggtactctaccgttttcaaaatacagggcttatttaggacgagaatactaagaaatgtatgaaataaagagaaagaagataaaatgagcatactacccatacttaaattgattcgaaattcgtattcaagaagaaanaatgatgagctacttgcagacg

SEQ ID NO: 15722 - DNA, 566 bp, Oryza sativa
aatgcaagtagtgatttgggagcattggcagtagggaagcaagcccacggtttgatggtgaagcttgggtttgaggttcagatatatgtgaagagtgcactggtggacatgtatgcaaaatgtggttgtattgctgacgcaaaagaagggtttgatcagttgtacgaggttgacattgtcctttggacagcgatggtttctgggcatgtgcagaatggggagcacgaggaagccctgacattgtatgccaggatggacaaggaaggtatcatccccagtaaatcgactatagctagtggtctgagagcatgtgctggcattgcagcactggaaccagggaaacaattgcacacgcaaatcgtgaaatatgggttaggtttgggggcccctgttggaagtgccttgtctacgatgtattcaaagtgtgggaaccttgaagatggcatgtctgtcttcagaaggattcctgatagggatgttattgcatggaactcaatcatttctggtttttcacaaaatgggtgtggcaatggtgcactggatctttttgaagaaatgaagatgga

SEQ ID NO: 15723 - DNA, 526 bp, Oryza sativa
caatgcagcgctgggacgatcggttcgggcagacgtccatcctgcagctccgtccgtgctactgtggctgcgtctcccggcaggttgaccggatcgccaagtcgtcggccactgtgccggcggcggtgaagacggccgtcgtggacacgctaaggacgaaccaaggaaacctgggaaacggcgtgctctcgttgcagcggaacggcgtcgccgacaagctcgcctgggcgtgccaccacgccggcgacgagagaagcgtctccgagcagatcctggtatggcatgtggcgaccaggcttctcgagatcatgcgatcagaaggcgctcacggagacacgacgacggagacggcgacggcggcggagacagcgacacggtggtcgtcgcgacacggctgtcgcggtactgcgcctacctggtggcgctgaagccggagctcctgccggaccacccggcctggacggaggagctgtacaagggcgtggtggaggaggtgtcgagggtgctcgcgcggttcgcaggggcg

SEQ ID NO: 15724 - DNA, 499 bp, Oryza sativa
tggttttgaaaaaaatttaaaaaatttgacaagatagattaatgcataatatataggcaataaataaaatgtaacgagtttacatatatttgcagaaaatttgtaattttgttaaaacttgtagaaaatgtttttgaacttgcatctttgtggaatgatatattccatgcttgtggatgctatagcaaactaggcagtgacccaaacaaaaataatcctctggtacttgtggaccttgttaggtcattcacagggcacatacgtaacgtgtgacaatgttggttcacatagacaaattgcttgcgtgtaggagagaggggagtggggaccgctccttcaccggcttcgcgtgaccatagttggtcactagaacctcccactcttgcagcagttctcgatcagaaaaagtggtcatctgcgcgtggagagagagagagagagagaatgggggaaacaaaagtgtctgactgaaaagaaaacccgataggggtgcggaggt

SEQ ID NO: 15725 - DNA, 863 bp, Oryza sativa
  unsure (1)..(863): unsure at all n locations
acagttggcttgcacggtatcatgctggatttttgtaagttcattttctgcatcgttccaattagtgatcctaatcgtttccagattacttctatttggctgcttctccatcaatttggggcagaatatgtgatatccgcatattcgatatgttatctacatagctgttgttaggacatagaacgcaatccatgtggtccccggatattagctgcatctaatgctattgggcaatgcaatccttcaaatggagagttttggacaagcaacatcattttgcatacgattttcattgttctgttttcagttttcaattgttgttggtgaactaaaagatataacaaattttgcagcctagcccaaagcaaccgcatacgcctgatcgttgtaattattataaagcgcttcttgaaggtaggacaggaagtaagcctcttggcaacgacatcattcaggaggtattatttgttcgtgaatcagtacaatttgtcaccttccatgctgtttggtttgattaatgaaatgcttgtgaaccattattaggtgggagcttactctccatcccctcgaattgaaatggaggtggcaacaaagtgggaccgtcggggcctcaacaatttgaggggtactgatggtgctttgtgtgaccgttatccggtatctgccgatgcagaaatctctgcgttaaaggcagagcttttgcaggcccacaaccggatccatgagcttgaagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15726 - DNA, 706 bp, Oryza sativa
aaaacaaaaacaaaaaaaaaaaaaaaaaaaaagaaataaaaaaaaaaaaaaaaaagaaaagaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacaa

SEQ ID NO: 15727 - DNA, 546 bp, Oryza sativa
ttatgtttatatgtctccgtatggataacaaaatataaaaagcagtttattacataacaccaattcaattgagtaattcatatataagattacatccattcatctagccaccacattgcttagttaattatggaccaaataatgtaaaacctgttagccagggtggctagctatctggtttgtttgcgtctatcaactcttagactgtcaattggtcgacatctacgcttatcatttctccctctactattgctgacgccaccaacgcccatgtgaacaccgaagaaggagaaagcgatggcttagcatgtagggcgccgcactgccggagttggtgtcgtggttggggaaaagggataaatgaagggaggaggaggagaagagaagacgctagtatgtaggacatatgtctcttttttattttatttagtgatggggctaccacgtggacaccacgtcagcaaatactgccaatactgctctgagagtctttttaaccggtgtcaagaattggagttgttattatatccggttttgtggttgagg

SEQ ID NO: 15728 - DNA, 1577 bp, Oryza sativa
aacagacctacctaaaacataaacaaagacaattaaataataatttacatttaaaacttttataattgtgtctattattaaatttgagttacaatgaggccctaatacttaaacccttttacgtacatgggacatgtgaactgatatgtctcatgtgcgacttctctttacggttacgcttatagaatacatatgatggtattcagttcgtcagttttttttattgagttcagctcatcgctactttttttctcagcatagtagtgcaagagttacttgaaaacttctaccaaactcttgctaagattagtaagggcctttacaatgcggtgagctgttattcagttcggtcttttcacgtcagagattcggtgtcaatctttgccacgtttgtgggcaggcctaccaaattaaagcccgcatgatcttctttgatcacctgttcttggcgaggggagataaggctacagacgcgttaggagggcgaggcttcgttccactatttctacatgcaccatggacctttgtggcttttctaggtcttaaatcttgatggcctcttgcgccaatcctatacgtgacctgtattgtaaaggccctaccaatccagatacatggtgtatggcctcgcagtgaacacgtaagaaaacggcgtacacgtctatgtgagtcgaattcccagttggttgtccggcccttcacagggatgacctgcacctcgcctgcgtccaagatcagatgtccacgcgacacgactccacgcccgtattagatgcgtgatctcatcatatgcctttttaactctatgctcatctgaagctatagacattcgcttgccgctatgcgctgtaggaggtgtagccataattatttgctctttgcatatttgacacataaatacacgcatctaagtagcttgcaatgccctaacaagatctcggtcattcgattcaaccagttggtggttatgaaaaatcaagacgccgtcatagtgtgctactttactttttctaaagtgggataaaattaacaatccttttatctttggtggcaaattaataaatataaagctaaggaaattgcttaaaaaaactatcacaaagttttttttataaaaactttcaaatgtaactatatcaaagtaatagtgaaagtaatagtgtaacttagtaactacattgtaattacgcattgttacattttaacgacactgatagtataattacaatgtaacaatattagtaaactatataacttacgtataaaattggttaaatcatgttttaatcctatatatctataaagttcattcccctaaatgtagttaatgctaattctctcttctctcatgaagccacatcatctcaattgtttttagcctttggatgattcatcaagggtgtaaattccttcttttcacattacctcaatttattttagtatttggatgattcatcaagggtgcaaattgcatctctttcccccaaaaggcacaccatacaacccaatcatttataacttttggataattgataaaggtacaaaaatatataaaaacatgaaaaaaattataaagt

SEQ ID NO: 15729 - DNA, 814 bp, Oryza sativa
acaatcactcaatgaatcatccaaatctatcaacataccttttcaaaagaaaacatatcaattcgtgagttgaattaaaaaaaaaaaaactcgactggcgggggaatgacttcccatggcttttcattaagaagaagcctcaaccaaaccggtcgagaaaagccacgaaccctggccccccacacgcggactcaccccctatggatcagtccgtaacctgtgctttgaggcccctgctccctatacgagggcccgccataggtcaattcttaacacgtgtttttatgagaggccagtgagtgactttttttaactaggcctgaaattcgcttcatggggagtgaaacccaggacctacacgtgctacttgagcattattcattaggctacaggtccttccgtgagttgaataaaaaaaaactgtggaaggcatatgatgcaagtactcatttaatcaaaacattggatagctttctagaatattgatgttgtttctgtttattttatgtggtactgagaatttaatagttagtcaaagattaattgtgtcatgtgctctctttgggacagaataaatgcctccgctccagataacttgtttatatctagtcttgacatggctttaggtttcaaaccatggttatgctatgaatagcatgcgtacatggactccacttggagaacaaatattccatgttctaggcaacatatgctatgtggtcactcttttggatatgcaactgtcattagtgtgtgtattaaaattaacgtgaaatgtacagatttcaacttcaaattcactatcccctccgtc

SEQ ID NO: 15730 - DNA, 10292 bp, Oryza sativa
  unsure (1)..(10292): unsure at all n locations
cttgcgcttaacgaacatgagaacatagtgaaccaccttccacaacatacaagagcgatatgtactaaagcctcaaagcaaccacctcttcaacaggtcagacgccttctttctcacaaaggtctagcagtgataaggtctgtaaatttaagatgatattgctcagtttgcatggccacatttttgttgtgcaattcaatactgcatatagtaacattatagtcaaaccatgtgcacagtaatagtaataacctacatacctcagctatggagagctcaagacgaaactttggaccatcgtaatggtgcagcactggtctgaaagcatcctcttccaaaggcttgcagagctttctaatgcggatcctcacctagtagaatgaatatagcagaatatcagtgcatgaaaccaaaagtaaatgagaaataaacacacgccagctgtaaccattacctgcgctgggaatctagattcacctttacacttcttatcttcccatgcagtgggatcaatattagatcctccaaaactagaagcctgatatgagcaaaaacagttatagcaacaataacctgttagtttctattggggtacattgttgattacaaatagaagtttatgagcaaaataaagtcccaaaagtattatcatgtcacagaaaagttccacaaatttcatttaaagacaaaagtatttcataataattaggcaaaaacaatttcaggcagaaacagtgcagcataaaaatgagaacccagatagcgttaaaaagtagtagctcagtacagaacaatgatgaataccccagaaatgttgtgtaacagtataacaattaacatgcatgcagtgaaatactatgtgcgtaatgaaaactggagtaggccagtcaaatgatgcacagaaacagtaatctggctcatttataagagtatggtacatagtaacatagatttggagtgcctcacaaagtgtgaggggcgaggtgttcaaacttcgaaagctatattcatacttgttggttaaataggctgaagcatcagatgttttccaaaacaatgatataaatacttaaaaagatgctagaataatcaatctataagtgaacatttgcacttaatttcatggctgcttatggatctttcgttttcaagtaaagagctccttatgaaattcataagatgatttatgagtatctgaaaaaggaaattaacacacctcaaataccccatgaagctgatgggtcgtgtagttatagaggaaaagaggtagaccaggaataattgctcggactgaatcacgatatcttgctggcaaccctgcagaacagcaatatatgattatatatcagaaggttatttgatattgatcatcgtaaatagcagcatgaatttattctcggaacaatatgccaagtgatgattcagaagataaggtaagttggatcacataccaaaaagctgcctcttgagatcctcctgcatggtgtcattgttgcaaacaaagatatatccaccgagcacttcattccttggtagcatctcacttgttggcaatgttttgaatcgtttgtcaacagcagagttgctgctgttgttcccgctgctgttacttccattgctgttggcaccactgtttttgccattgacatctttgccatttggactatgcaaatatttgttgaccccaacattcatcttgaacgagttaacattgccattgcctcccttggggtacagctgattcatgttgtaggccatgccgcggaaaggattcttcatagctgcgtcattcatcctgatgtcgttcatcttaagatctagattcataaggccaagattgaggtggtccatcttgctctcatcttggtggtaggataccttatcccattgcttgacatcagggatggtgttcatccgcgcatagtcaagctcattcgtcctctccgccttggacttgttgatctcagccaacttcgatgtcatgagagaccactgacggtcctccactaccttcgactgcccacggaactcatccccgagatgccacaagttgtccatagctcagctcagtctctccaccttcagcaagaaagaaattacccagggccggatccaacttgggaacaaacaaactcaaactggtacttgtattaaggttaaggcgctgaaattaagaggagagcttcttccagatctagaagagaagctagggttaacgaacaaacgcaagcaaattccagaaaaaaagtaagagagatgaatcagaaagaaagaggatgtagatgctcaccaggatcccctcccctgctctgctcgcgagtcgccagatggagatcgccgcctactccccctcttctgttcagccgcgactcgtcttggggaggcgcaaggagcggaggagacgacgagacggggggagatttctcttttattttacgccaagggaaggaatggggagagttacagggaatatttaactacagtatttgccaagtctatctggatccgagaaaccgaatgaattcgaattttttattcgaaaatgtaaacgaatatgataatgctactatccgttcaaaacaaatttggaaaatttcaggaaacgaatttagaatttttttaactggaaatgaagtatttctcagttgattagctccatacttttctgctccaaatatttagatttatactacgtgccatagtactaatgcagttatagatgaatatagttcttttttcaaaaaagaataaagtgtacacctaattgtattattattaattaataaaaattagaagtatcgatttagggcttgtttggcacggctctagcttcaagacataaattataaatatcgatttattgtctaaaaaatatattaagctacatgtcttcattcattttttaagaagttcagcttaaggggtttttatattccgatatcgtattcgcttcatttttttattcgataatattcgattccgttttcgtatccatggttttcgattctaattccgatttcgaaatgaatatggaaaacggaaacaataaaagtggttttcctccgtttctaaagcgttttcatccttactcgagtactccaccttttatctcaatttttttactactttaaaactagctatttatttacgatgactgatgaccaacatatcagcagtactcagagaaaaaaaatccaacaaactaggttggggattgtgtcaagagcaaactccttagaccaccaataaccactaattgacactccacgcaccgccaccatcgctctttctccatgagccaccaacgttcctcctctccgcctttacatgcgcaaccacaccccctagtcactgagatgtcttttctcctccaccatcgtttatgcacgctattgtcatggtcgtcgttgaggtaaggggtgtcgggcttgtcgggacatgggaaggtaggagtcgacccgatgaagatcagagacgctagatcgggctcctccttgctggatttgacaattccctaactgtcgaaggaaagaagaaaaggcaaagagagttagtgtgcggaatggttgtagtgtcaccggatccgaagatggatagaatgggaaggtccaaattaaaatataaagttagatgttgtgtaaatgaaaagaatggttaaatggtgatataatatgaaaaattttaagaatatacagtacaaactgtaatttacctttttttctttagcacaattaacgatgagttatctattatccgatagtctcgtgatatgctaagcccactgcagttttatcatctctgcacagtatggttggatcggtgtacttagctattactaataatctcatgatatattgatacatgacgatataaacttctactaatacgggatggttaattctattaacacaggctcattaattatgataagatagaactgactaaaaaaggataaaaataataccatcaatagtctcatttcctcattgcatgatatatgatgactatctctcatcaatatgtatataattatattggtattttcctaattctttcatattgtttttttagtttttatatgttaatttggactaatattttttctcataattaaatagtaaacagatcgtttttccatatttctccattaaaatgtgaaatattgcattgtataatttgaaagttgtattataagtgtatgtaatttaacgtgtaagatatggacttatagtataatatttggtttttttctctaaaaatgttgcaccatactccctccatcctaaaaaataacgtagtctgcatgtaacacatcatagtactataaatctggacatacctttgtccagatttattgcattagaatatgtcacatatggtcttagattctttttttgggacggagggagtagtaaataggtagttaagtgaacaaccataattttatccatattttacaatatgtcactgagtttgtcaagttctaatatatcatttcattttgcttaactcacagtataatataccatcgccgttcggttagcctccgttaatattatataattttatcgtaataatcgaaatagccttgaacgaaaacttctaaattttgatcaaaaattccgaaatgtcgatcgatcgacgggtctgcgctatcaattatcccccgccgctgatgggaggagaatcgacgagcgaggaggaggaggagaccttggcagcttggctggctcccaccttgctcctgtcagcgagccagggagaggaaaggggtgaggtgtcctctcctcttttagttatagagagcggcggcgagatggggcctcgatttggatgttatttacgtggactgccactggtggtgtactaccatttgtttgtttgctctggttggtggtcggcttggatggatggatgggtgatggttgttgcttgaggttgagctgatgcccttcaatgatgccgaccaagtacacaaattataatataaaaatttatgatgcataaatttcaaattttgaattgatatgccatgcatgtggattagatcttgtgtagtaggagtattcattttggtcataaatatatatctctgcatccatgggctagcttagctatacatggatggttgatgttgatttgttcttttatttcagacaaatgagttagttgcagaattgctttgctccattttaattgttaggtaagctgtagatgcaatgcaaggtagggtgcataatacgccggaagcgaataatttgctgtgattaagagagtttcagcgtgtgcaaattataaagggcgtaattagcctccttggttttgccaacagatagtactcagggcatgcagacattgattttgctaatgacttttaaggcatcaggcatcaatcaaagcttgtggtactctgccggcacacgaaaattcttagctggagtgccaagcaaaagcaagatgcagtccttgatggaccaataggacatttcttaaacatcaattgtcatccctaatttctcttcaagtagtatactacaaactaacccagtacagttctgctcaatcgaatttcttaattaggcctgcatgcaggcacatttttgttcttgacaagacgatttaattaattagctggagtacatgagaagaacacaacgaactgtgttagccaagaaacgtcaactgctgggaactgaacttccgatcaagttggtgagacatccacggcttagaaaccacaagtcagaagttcagaaatcagaaacagttagttagctaggaaaagagagaaaggaacacataaaagcaagggcaaatcatctgtgttatccatcgatccaactccatcaaccacaacgatcatcgccccctgcttttccgatggatgacgcatgcgtgttgcttaattggtttgtgttttcgttgcatttcactgcatccacacacacttcagcctgctgatctctgcattctgcgtgatatcacattacacaatcgcattcaacccgcacaataactagaagatgcatccactctccaaacaaaataatggtggatttttttttattttgttttgttttttaaactccgtcctcgtttgaatgaatgaatataatataaatccaccggccaagctacacacgcatatagactgtatatcagctaaaaaattaagctcttttttttagatgcaaattgagctcattgggatcgaagaggccggtggttttctctcaccttgattaattaagctgtttttaatccagagcgggatgcatgtgtgcgtcgtgtttgggggggcagagaagctgcaagttggacgatcgagttgcttggaacagcgggagaacgagcgcgcggcaaacggccgcggacatattcgatttgtcaggaaatagcgacaaatatatcggcacatgaaattgttctgccgatcgatcgaactagtactaactgttcgtatacgttttgaatttcaaatcgattaacctcttgctgctcttggaatattcttggtcacttggttttgaatttcattatttcaaatcaaatgaattaatgaaagaatgaagtatcaagacacagattgcagtttttgcaataatattcagaaccatcaaccatgcaagcatatcgatcatgatgctgatcagtgatcacaggctaactaattattcctcttgttgctgttggtggcttcttaggatggtatacatagattagataggaacagtgcaagttgtagtagctgaagccattaatcaattagggttcatcacatgggaacaccatgtgcatgcatggatcatggatgcgcccagcttcagtggatgcgtcacatgatcaagcgaaggccgggggccctgaccgtggagaagccccagcaattgactaaaaggaaattttatggctggtcgaatgaacatgtgaagagcataattaaactgcatttaattaattacagtgcctttaagcctgcgacgacgatgagtgaacannnnnnnnnnnnnnnnnnnnngtacacgaggaaacaaggagaatccgatgtaggatgtgagtcccatcaggccatcactatcgctactgcagtactagtacatgttcgacgaatcgatcgtacgatcgattgaggatttgttattttaatcatcgcctttttggttgatgccttgttttcctaataattgatcagatctggttgatcgatctccgttcgaattgaaatcgatacatggagatgcacagcaaggagatcgatgcatgctgctagtaccaaaatgttcgagcctacaattatcgacgaattaaccatctctcacatcacagaaaccaaaatgttcagtgttgctcacgtcgtgaattaaaaaggccaggcgacgtgcgacgccacctgaatcgttgggagagccggccacagctatctccggacagctatagtgagcgcgtcgtcgtttgcacagctatagctgctgcctgcactgcacgcgggtaaggcaggtttcagctttcaggccggccgtccatctcggtgaaagcgcgggagcatatggaataaagttttcaaaagaagagaagagagcaaatggaataaacaaggcaggaacgcaaaaaagaaaaaaaaaagttaatttgatccatgccattgtaaatgtggctatttagaaaaataacattataattcgtatattcataaacgtgccactccaattttacgaaattaaaaccatgccactgctgtcacattttccatcatcctctttctttccgtcttcttccttccttctccagcccgtccgccgccgcccacgcctccgcgaggctctccggcgacgcaacgaagacacggacgcgacgggggcggcggcggcggcgcgcggcgcgtggcgcgacccggaggcgacggcgacggcgacggcacgggtcactcctccggccgccaccttctttccggtgagcacgcttcctttatccccctctcccctcccctttcaaatttagggttagggtttccttctcttctccctttcccgtcgtcgcacgcaccgtgccgtaggggccgcccgtctggtcgtgctccggcgccgacgccgacgccgaccgcatgttcagctctggatccggcggcggcatggccgggacacgggagggttcttggacgccggagaggagaggagaggagaggaggaggaggagagaagagggttcttggttcttggcccgtagccttcaaagtgtcggcaccctccatgtcggcttcagcagccggtgcagcccctccacgtcgctgatcttgttctccgccaggtgcagctccctcagcgctgtgctccccgacagccctgcgagataagattcagaaagtcatcatcgcatctctgcaagactcgccaaaaccctgatgaaattgagagtcatgtagatgtagttgcagttgcaggtttgcgaaatctgaaggaattcagagtcatgctgcagtacagaggagtttcttctttctttttctttccaaaattgcagggttcgaacttgattcttctcaggattgcaaaatctgaagaaattcagtcatgtagatatagttgcagacttgcagtgcagagattttttttatttgctggtaataaggtgtcaagaaagaatcaaccaggtgtttcaccatgtacaaagaattgtactgttatgcaaccgcagaaagccgctactagttcactgttatacacttgagtctgaaactttctgcattataatgttcattgcattagttcactggttttattttatgtatgtacaacaagaaatggattgttgcattagttcagttcaacatgttttcataagattatacttcctcaacatgatacttgtataaaacatgtttatcatagctattcaagcactaatatgtctagtgttaaatgagctgattgggtaattaattctgtacccatgttatattgtatttgatgatgagatccttctatttgattgaaaaacagcagctcctactttgatgctagctagctctagttctgggttttatgtaactctagctctagttccggatatataatcttggatgctgaatttgaatagtcagtgatgtgtataagttgtgcttgttttgtagattgcacacgcacccattagacttggagaagaccaacctcctccttcctgggaccttgtaccctctccttcctgggaccttgtaccctctccaagaggtactagatctatttattccctttgctttaagttgtttatctatattttgtgatgtaaatataaaaaataaaagaagtggtgtaatgtagaccaaaatttcttttcctttcaacatacggttaaatttgtataaaaaagcatagagaatatacaagttctcagatttttcagatttcttaattctgaacatgctcggcgctaactaataaaagatcatctttaactaaatttgacaactaaatttggtaagtgctactgccatgtaatctgctttttcatacatcctgtaagtgctactgccatgtaatctgctttttcatacatcctgtaagtgctactgccatcaattattgttgcactgtgcactctttaagaaaaaaagatccttattgctcttttcattttcccatcaatttttaaatatgcttcataacttggatcttcttaagattaattcccatagtttagtgattcttttgtgattatctttctagatcttttgttgatgtgctaagtgcaaaattgtaaataatttgtgtgctatctatagtactactatggatatgagagcaagatacctcgctagaaagaggagggaagaggaggacgatgatatgatgttgtttattttccctgcactacatttgttgagttatagtggagcaagggaaaagaagcgacaccatacatcaaagctaacaggtgatgagcgtgttcgggagttgcttgaagggcatgtaaaaaattgccgggtagcattcaggatggagccggaaatatttatatctttggccaattaccttagaactgaaaagttggtcgatgatactaggattaaagttgaagagaagctggcattcttcttatacatgcttagtcacaatgcttcatttgaggatttgcaagagaaatttgggcacagtggggatagcttttatcgtcacgtaaagcatttcttcaactcagttgtccctacgctcttgaagcggtttttgaagcctccaaatcctaatgaagttcattggaaaatagaaaaagatcctagattttatccctatttcaaggtt

SEQ ID NO: 15731 - DNA, 618 bp, Oryza sativa
gtgagatcaattattcagattaatttcggattatagctcttcatgtacagttttaaatattctttttgggtttattttgattgttcattgatcaggtgtgtggttcatgcattgccattttgatcgtcacgtggtgtgggggatggacactatgttcatcgtgaaggatggcaagacgccgcaggctcagatgctacctcgtcctccaaacatgccagagtgctaacgaccgtggttcaaggaaaatgcaaacacaagcaggcggaaatttgtttattttgttcattgatttagtggtttagtttattttatttccttgtttggctgaaaaggaagaaggcattttgtcatcttgtaattgttagtcatttcgttctatcatgtaagtttggaatttttgttattcaatttacgaatataactaaataatgttttttttcagtggatcgggtattacgacgtctttctttataaacacacacccttgctatcttggctattttaattcccagcgctatacattgtgttacactggattaatttttcacggttaagatgtccttcgcttattcttatacattggtggagaaatcgtttttactcctggtttgtaacccc

SEQ ID NO: 15732 - DNA, 467 bp, Oryza sativa
atcacaatgcatatgtgaggaggctagtgtcaacaagcggtagcaggacgaagtagtgcacgaccatagagatcatgccaatgttggagtccagcatcctagcgtccatctgtccctcggtccgtcgcagtatctcgtcaacggtgaagcccacgagcacatcctcctattgcgtcgcgggtgcgccatggtcgcggcgccaacaagggtttggagcatggtggattgggatctaggattggagagcgtggagtggagtggtggacaaggcctacctactccccgcctatcccacgtgacagccatcatcgtagccacctaccgaagtagttaatccagcttggtcgtgcagaatcgagcagtaccgacttgcagggcataaaagagagcccctcgacatgtcttggcgtaccctccccatcatcgcggatcctcctcccactcccttgtcgcggactacaacacac

SEQ ID NO: 15733 - DNA, 238 bp, Oryza sativa
acaatgggctgtgacgtgctagcctgggtcggcccaagtcccacctctggcttacgcaatgctgcctccctagtccgatgtccgatctcccctcggcctcggcctcccgtctcctcggctcctcgcccacttcgtccgccgcctgcgctgcgccgagacgccgacgatcccatcccgcgagcggcggggccggcctccatcccgtgaccgcgagcaggagcgccggcgcggggcacgt

SEQ ID NO: 15734 - DNA, 387 bp, Oryza sativa
aagtgcaaacttattgtctcggcacataattatgaaagtactccatcctgtgaggagcttgcagatcttgtggctagaatacaagcagttggatctgacatagtgaaaatcgcaacaacagctaatgacattgttgatgtgtcacgaatgttccaagtgatggtgcactgccaagtaagtgtcattttataaaatccaagaaatgctttcacttttctacatggaaacttgcatgtcacctatcttgtatagttgtcccagtacatcttgcctctagcccactactactgcatgccccctttagattctttttttttaaaaaaataaaggaagctatccagatccatgatgtttttgaattattgcacatgtcaaaactttgtgtaa

SEQ ID NO: 15735 - DNA, 706 bp, Oryza sativa
ttaaaaaacataggataggagcgagaaacccatgagttgatcttaaaaatgaagtttaggtgagtttatttacttaatgtagaagaggtaactaggatatgtcaaacattacctgtgaatttttcgctagccccaacagaggacagtcgcggagatatcatgcgagactgataggcacggctctccaccagcccaaacaatagagtgatcgctggaagatggtttgcaattttgcaaccattgcatgcatatgggcaaaaaattctgattccagctcagtggctatgtgaatcaagcagcgtccattatcttctctcattcaactaatagggtacaaaacttgggatggcagtccaccatcatattataattatatgatctacttcgtattctcaatctgccgagttccatcagttcacgcatcatcgacaccagtcatagggtcagcttccttgggctcctcatctccaccatcgttgccctcttcggccagggcatccttcatctgataatccaccttgaaatcgtagtctgcatccatgtcggtcagcacgctgaacttgtttgccttgcgcctcttcttctcggctttcctcttgcgaggatcaagtattccctctgctgtgtacagcttgtcattctgtgtgctcgcgctggccgtcttggctccttcacgctcatttgcatcggacatcgactcatcatg

SEQ ID NO: 15736 - DNA, 390 bp, Oryza sativa
tttcaatcacttcagttgttgttttttgaattttaaattgctcagattccttttttatatggttggcttggaatcattgaagtggtggaaattatagaaatcagtataaaaatgcttatattatgattcaatatttgaatcctacatatttttgtattttgaaatagaggtagtattgtactcctatatttgtacctgtcatgtcatgtacggtcactagcgaaggatgtgaaatgactaccgcttgggtttcttcggtctttgatagttccacggccacctttcctgttgagaatgaaataagaaggatgaaagatttacttaattagaattagagaatgaacccatcctggcacaaaaaagagaacaaagaatgaagattcattcact

SEQ ID NO: 15737 - DNA, 12689 bp, Oryza sativa
aaatgataggcatactttgtgccatattccctatttcccgtccatctccaataatcgaatcctccactccttttgtcagttccaagtattcaagtgctaggacctcccagaatttcatgtaatctgtaagaaagggcgacaatgaggttgtgccaaatgtcattgatccatcttcttgttgcagggcatcctgtaccatgtggtttttcctcttggagttgcactagaggttcggtgctaggcttttgaagctatggccgccaatctagttggattccaagaagtttgtttttgcctattaccgataaaaactctagtcaatatcgcgaacaattccttattgagttcatcatagggtgtttcagttttggcgccctccattcataccaaagccatctcagccgtaggctgtagcaatttttccaggttgggtacttcaagaccgccataacagatgggggaacatacctgaggccaaatttatcttgtattttccccatgcatctcataattaccggctcataggaatcatcttcttgcttcgtcaatttctcgaaggtatttctttggcggcttcagttgagtgtaaaattaaaggtgtttttgattattattctgtgatgaacaattgacattgaagattattggttttgatatttggaatttatttacgaagtggttttggagatgattggatttcataggtgatctacaggtactgctgggtgtggtccggtcagaccgggcaggtgttgccgatcagaccggcgtgtatcgcgcggtcagaccggtgcagcccgcagtctgaccggccgacgctgtgtcggtttcggtttcgggttgtttgtttggatatccatgattgtttatgtttatagcttctagatggatactatgtgtatgtaatactgttgtttgctactaatgagtcaagttggggatacgttggtctcggaatatggtttctttgtttgttctatgtgtaggtgactcgagatgccgggagagtatttgcggtgattgaccgggagtcggcttggggatgagacgatgttcgtggtggtcagatatcatgcgggatactaaggctagagttcactgcacgtggttggtgaagattccatatgacatacgatggaggtattgtgtgcgtatgggatgtggagtcgaatttggaaggagtccaaatttggtatgagtggttatgtaaagtttgtttcttgtacgagaaggtttcctatgaggattaggacttctagtatgagtttggttcgtggctttaggctgcctacctcatgtataaatagagagggagcgtgaggcttccctgtatcattttagagagcaattgagttgatagttgagttaggggtttgagtttagtcgagatttttgtaaggagtgctgttggtgcactttgtaaacacagagagaatcaataaagtcgtcatccactttaagagttctttgatttgtgtttcactgggtttcggcggtctaattggtggcacaccggcggtcagaccggcggcgtaagggcggtcagaccagcgttgacgacaggtgacaggagctgatctcggtggtcagaccagagatacaatctcggtcagaccgacggtaactaggcggtcagaccggcacatctacttcggtcggaccgcgatctgtcgaatttgagggtaacttttatttccgctaaaagttttggttttttagcataccaaccattcaccccctctgattagcttaattgttgtgtttcgatcatacattgagatggaactttggaaggtggcgcatgcactctgatggtggcttggtcttcgccgggtaattaattccatgttttttcgtacgtgctatatgtgttttgggtgtccaaaactatttcaagatttctaatgtttgtacgtttttcaaattatgttgtgccatataatgtgttccatttctttcaatcaaaacgcattgtcgataaattttgccactccatgcatgcatggatggtaagccaattttctttttccaagttcatgtcatggagtagtaaattctaaaaccagggacttgtggtcagttttgatggaatccaaagcgtagcatgcttaacatgccgtaaggtgatttatacaacattaattagttgcttccaacacgcataaagaaaatatattttatctcaagtacagctaccaatagcaacttcgacagaccactagtattaattaggtcggctatataatttgaccgggttaactcataatttactgtatacacgggagaatcctgccattagcagccgcacaacatttttaattcaatagaggtgctggtctgctggatatgccaaatagggcctataccagtataaaatcttgaagggtggaaatatggtaaatataacaatcatgcacgccgtacggatatgccaatttaataatttagtgcagctgtacgttctctacttgcaactgattatatatatacacaacaggtaacatagtccgcaaggcatttcaaaagcccctagagagtcaaacatacgtgtccaattatctaacaccctccattccaaaaatgtataagaattccactcttctagtttgtcctaaaatgtctgatttttctaaaaactcaaacattggttcacctctaaaagaaaaatgttttagcactaagacaaaaatgttttaaaatattaaaatggtgggactaagtcgaatcaaagattaaaacatttcattttgactgatgaaacatcaagctttaattgctaaaacattaacggatgtttaagaaccgaagacaaaagagttaatcccttgtgtacccatgaaaatttgcccaatctcttctataccttttaattttactcgaacccctctgtacccctaaattctcgctttgatcccttccatacccctcccgttaggttttcttcattttatagttatgtgtgattgcaaatgtctataatgccctttagatggaggagcaactgcaggtagattggaaaagaattggaatatgttgaccgcacagcatgtgtattttatgagactaataatgagtttaaaacttttattgtggtattggaaaaaaaaatgcaatccatcgaacaatttgttttgaaaaaaaaataatagggttggaaaatcaaagtgacatcagtttgctctgtaaaaaaaattggtacactcaacaggaatgtggacaaaggagaaaatctgtgaaacaaaataatctggatcaataagagcatcaagagcatcatagatcatcaatcaaaatagtagtaaccatacagagcacttcatatcaattttattttcatcatccatacagagcacttcatataaatttcatacaattttattttcatcatccatacagagcacttcatatcaatttcattttcatcatccatacagaacagctcatatgatgcacataccacaatttcatttccatacctaatagtgcaggaaccaaaccaactttccactccatacacaaatgttgcaaatgacagatcaaatatgtcaaacactttgtaaggcatcacaacagcaaacaacaatgaaaactgcaagaagaagaaatgaaaattgctgctactcctaccagtagggcggcgcagcgacgagagggtatcggactttggccgcacgacaggaggaaggtggccggcggtgcctgcgacagagggctatgggcggcagctgcgcgactggaaggcggtggccggcggcgcgccaccgcgcgacgggagggcggggaccagcgacgccctacctcgcgacaggagggcagcggccgacggcgcgcgcgacgggagggcgtgagccggcggcgccccaccgcgcgatgggagggcggcggccggcggcgccccaccgtgcaacgggagggtggcaggagggcgttggccggcagcgccccaccgcgcgacgggagggtggcggctggcgacgccccacctcgcgacgggatgacagcggccggcggcgcgcacgaccgggggggggggggtgggagccggcggcgccccaccgcgcgacgggaggacggcggccaccgcgcgattggagactggcggcgtgcagaggatggggggagaagagaaggagattggatctgtttacctagggttggctggcaggggcattttggtattttttgaaaatactgacaatgtaacacacaggtcacgctacagatcaaacggaaacctaacgggaggggtatggaggggaccaaagtgaaaatttgggggtacataggagatcgagtaaaattggagggtatagaagagattaggtaagttttcatgggtatacaagggattttctcaagacaaaaacatgaaacaacataaaagtagctagtgcggattttgacccaaccataaaacatcaagatacgttagctgaaacatcaaaaaatcacaaactttaccagtttagatatggcttctttctcctattcgatgaccaccggctcctttaatctcagctgcagatccatgccaagacgttgcaggacccttctactccacagcaacggatagccgttgctcccccagaggctttgtcaccttgtcattgtcgattttgtccctcaactacgtccgtccattgtctttctctagctccctagccttgatgaactacaacccatggccgtggcctgatacattcttggtggagtattgagagagaggggggttgatcacaacaatgcggtggaagagtcagagagagagagagaggagggaagagtggataaggatgcggaacggacggatgagagcaatgtccgatattttttttactcattggacgcgcgagccagagtgttttagatcttatgattattctaaaactaccagatttttactgggtttttttcctacttattaacttttgtactagttttttcctccaattactaccaccttgtgtattatgattattttccatttgctacatccttatttttttttaaaaaaaaagcataacatgccctttgtttggtagcatgacacctaagtgatttcagggaatcacacaatctagctattttcacagtaaatttcacaaactatcagatacatcgaccaaactaccacaaaactacatatctaacgtcttgtaccacgaaactagagatttagttcgaaatttctcacaaaactacaaattttcgatagagtataaaaaaagattagtaagtagaaaatttatcataaaactataggttaatgctaatttatcctaaaactacaacgtttatagctccaacataatatttgcacgagctagttaaactctagaatctgcatctttgtgataacttcaatgttaaatctgtatttttttgtgataactttaatataaaatatgtattattgtgatgcttggcattaaatatgtagttttgtgataattttaccactaaacccttatccttagttttatgatacatcgtctcagacatgcatgtagtattgaatggctggagcatctatcactactcttacctagcccaggaatgatggctacaagggttaacccgagggtggtatggttggagggatacgcccttataagttggttccgcccttactaaactagcaatgtggtattaaatatacatatacctctcttatgagccaaacatgctaaatcctagttggaccatgatgttactcttaccaccccccctcccggtcaaaggacccaattcctcgttggtccaacctacctacgtagtcacacaggcatatagtcaaatatctaggatcagcctcttaaccaaagttttaaatctccggctatagctgccgctatagccggagatagctgctgggaacggacggagctaagagatgcagtttttagcgctaagaatagcgggacgctaatagcgccatttagccggcaatagctgctaaactggccgtaatttagcgtagctaaattgtaaaacgcggccggtctggcccaagaggaaaccggcccaactagaccagagtcgagaggtgggtaaagtgctgcaaaccctagctcgtaagctcccagcagcacactatccattccaacttcgaagcgctcactctccagctgcaagaaaagtggaggcggccggcggcagcggcgcaaaggcgtccggcggcggcggtggcttcaagcggatcgaccaacgcaggcggctcgtggaggcgaccagcgccggctgctgcttcgagcgggcgtccaaccagcggcggcggctttgaaggcagctgagcagcggcgcaagtccgacgaggaggtccgtcagtgcaacgtctccgaagcactgaagcagcagcaccaaaggtgacggcatggcacaacaatccggtcaattctcacatcctcctctcttttttgcttgtatgttgcagatcttacaatatgtgaacaagttgtccatatttgttacctctaatttcagatacttgccttatgatgtagatcttactatatgtgaattattttctgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaagactagggcgacgaccacaggcgcttgacggcaggcacgagctagacaccaaagccttcatcttcaaggaactcctcatctgggcttgggaaaattaagcaagactgagtacaaccaccgtactcaacaagacacacccacaaatgcagaataaatgcaagggagtacaagggaattatgacataaagggttagggttgcagtaaacagcatttaaagacatttagttgctcaaggccattttgtaaacacgatcctagaactatccaatattattaatcaaggccgtgaacccacacgaacctgccttaacccaaggcctatgatgattcagaccgaactggcaacccgaccctgggtcccagctcgtcctaagccaacccaggccaaccattccacattttagttgttgagcaaattttaagaattagaacactgacttgggtacattgctcggcttgcccatatccgagggctcggctattcgaatagatttactctgatcagaggtgtacatctttacccacaagacacatcttcctcacgtgtaaccacgtgccacataccaccacggtatacagacgaaagacgtgacatagtttccaacccatcctagccttagacaagagtaccgacccaatcccgcctacggccggaacccccgggacaggtagacggaactgagcccctcgcagcagggcaccaaccctgtgctttttgacatctcgactaccgggccgtagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatggtgtccaaaggatatgagaatttcccaaagtctatagttataaaaccacctaatgttgcctaattaaattgcgaagcatctacctaaaattaaactagtggtgtcatgagtagagtgtccactagttggggttttgtttgatctagggtgaacaaggtaataatagtaacaatgacaataataatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcggctacacgaccaacggaaaagaaaaaggctttaacactaaataactccacataacagcagaaacaaagcacaaaaatgggttctttacatcttaaggagaaattagagacttgaacggtccaattccgagttcaaatggccaagatatggccatttgaagtttatatgctctttaaatggatatttacgaatttcttcatttaattttcaattaaaaaacggattattgcgtcagccgaggggcgggcgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagaggacgcgcacccgcgccccgatggtcgccgccggcgaccaacggcgcggcggagtggcgcccgagagagaggagggaagggggaaacgaaggacggtcctcggctcaccccgagacggcgaagacgacggaaacggcggccggagcggaggaagacggcggcgcggttcgggaagacgagggcgacggtgctccggcggtcggcgagcgaaacggagcggcggacggggtcgacggcgatgcggcgatgccgagggaggtggcgccgagccgggaggaagaccggagcgacggcggcggcgaaccgaaggtcgacggcgacggcggagagagaggagcacggcgctagcacgattccgacggcgagagcgagcggcgagcggcggaaacggaagagcggagctcgggcaacgaatatatagcaacgggagggggagagcgcggccggggaggaaggaaaccggccgcgaagatctcggccgccattgattgcgccggcgatgaatgcgggcacgattcgaacgaatccgagggagagagagagggaaaagagggggaatcgggagagggaaacgcggggaataatttccccctcttgattgcacgcggggcggacgggagcggcgggattcgcggcggcggcggcgctagggcacggacgcggcggcgggcgcggcgggaggagggcgatgacaggtgggccccacccgtcagcgagagtggcgggcgggcccgcctgtcagcggcgcgcgcgcgcgcggggagccgatgggccgaggggaaagagagagagagagggagggaatgggccgagccggcccaagaaggaagggggagggggaaaagacttcttttaggattttctttttataaacctttttaactttgttcatttcttttcaattattatttgtgctctgaaaattccactaaaatttatttaagcattttaggcttttaggaaatatacaaaaatcctccaagcctcatttgacttttatctttgcacattttaattgttgaaggctttcacattgaattttaattattcttttgcacaatttcgaggatagattttagagtcgatttgggacgcgacattttcttactccctgagatctctcgtttgcttgttttgcctgtttaggtggtaatgataatacgtgctatatcagtttgcattattttgatgcttaggcagctttgacgctagcattaatgtgggctaagtttgctttttgtataggtaatccgtccagtgctgcctctgtctcagtagaagctggaccaaaacaagctggtatcaactcagatgatcctgcatgggctcactgtttctgcccagacataaccaagaaacatcacctacggtgcaagtattgtgacaaggtctgcactgctggaattacaagaattaagtaccatcttgctggaattaaaggtttcaatactactaagtgtcagaaagttccaagtccagtgcagcaagagatgtttgatttgcttaccaagaagactagtgaaaaggaacagaaaaacaaagaaaaggaagtggccagagctgaagttgacatagaaaattcagattgtgaaagtggcagtgaaggttcagatcatggcaataatgttcttgtggtgaagccaaaggagacaacaggatctagtagctctagatctgtagcaggtggtcatactattgacaagtactacaagcctccttctatagaagaatctgccagtatgacacaaagagtaattaagctaagcaataaggttcaaacagcattgacaactcagaaaagagaagagaggaggaatagaacttgtgagtacatatgtcagtggttctatgaagctagtattccacacaacacagtaacccttcctagctttgctcatatgttagaggccattggacaatttggtagaagtctgaaagggcctagtccctatgagatgagtggatcgttcttacagaaaaggaaggaaaaggtgatggatggattcaaggagcacaaggaatcatgggagctcacaggttgttctatcatgacagatgcatggacagataggaagggtaggggagtgatgaatttagttgtgcatagtgctcatggggtactcttcttagattcagtggaatgctcaggtgacaggaaagatgacaaatatatctttgaacttgtggacaggtacatagaagagataggggaacaacatgttgtccaagtggtgactgataatgctagcgtcaacacaactgcagcaagtctattgacagcaaaaagaccatcaatattttggaatggatgtgctgctcattgcttggatctcatgctcgaggatattgggaagcttggaccagttgaggaaaccattgctaatgcaagacaagtgactgttttcttgtatgctcatactagggtgttggatttgatgagaaagtttcttaacagagacttggttcgctctggggttacacgatttgccacagcttatttgaatctaaaaagcttgttagacaacaaaaaagagttagtaagactatttaaatcagatgagatggagcaattgggttacttgaagcaggccaaggggaagaaagccagcaaagtgatcaaatctgaaaccttttggaaaaatgttgacattgcagttaattactttgagccattggctaacgtgttgagaagaatggacagcgatgtaccatcaatgggattcttccatggtttaatgcttgaggcgaagaaagaaatttctcagagattcgataatgataagagccgcttcatagaagtttggaatatcattgataaaagatgggacaacaagctcaagactccactacacctggctgggtactatttgaacccctactactacttcccaaataagcaagagatcgagagtgatggatcatttagagcaggtgtgatttcctgtattgacaagttggctgatgatgaagatatccaagacaaaataattgaagaactcaacttgtatcaagatcagcatgggagttttggacacgaaattgccgtaaggcagtgaaagaacaaaaatttcaatccaggttcagatctcaacatgtgaacttaattttattgctgaatatcatttttgttgtaatttgtgtaatgtttatgcagcaaaatggtggctgaaccatggcacaagcacaccaaatcttaggaagttggctgcaaggattttgagtttgacctgcagctcctcagcttgtgagaggaactggtcagtttttgaacaggtaaaaagaaatttgtgacctgtagctttatgtgcatgctgtctattttgaattataatgcttatttatggaatttagatctgacctgcagctttgtgttcactacttggcttataggttcatacaaagaagcgcaacaggctacttcatgaaaggatgcgagatctggtgtttgttaaatttaactccaagttaagaaataagagagagaacaagggtagagatcctatagagaaggagtggatgatgttgtggcagatggtgacaatgaattcattactggtgttgtgccttcatcaagtgaaatggatcaacaatgtgcaaaagagtcacagcagcacacaacaccacaagcaccagcaccagctaaaaggaaaaggcctgtgcacgctaagaagaggaaagtcagaagcctacagtctttgatgcgcaatgccccagtgcatcctgaagctccatcatccgactcagaagattgtgatgatggtattccaatgcagacttctgattctgataagtcaccctctccctctccctatgtctctgagaccgatgattgatgactagaagaaatgaagattgcaatattgcctcatattagtaatttagtatccactatccagaattcttgatgacctttgtgttgtactgttgtctttattctagaatgctgtacttttgtgaaactgatgtttcagtattctgttaaccacttagcctgtgatgtaatgtactcatatgaacctgtaatgtactcatttgaattggttatgtatcaattggtaatggttatgaagttatgccaagatcatgtcttttatttatttattt

SEQ ID NO: 15738 - DNA, 4013 bp, Oryza sativa
atgacaggtgggccccatccgtcagtgagagtgacgggcgggcccgcctgtcagcggcgcgcgcgcgcggggaggccgatgggccggggggagaaagagagagagagggagggaatgggccgagccggcccaagaaggaaggggggggaaaagaacttcttttagggttttctttttataaaaccttttcaactttgttcatttcttttcaattattatttgtgctctgaaaattccactaaaatttgtttaagcattttaggcttttaggaaatatacaaaaatcctccaagcctcatttgacttttatctttgcacattttaattgttgaaggctttcacattgaattttacttattcttttgcacaattttgaggatagattttagagtcgatttgggacgcgacaaacctaccccccttaaacggaatctcgaccccgagattcggaagaactggcgaagagatcgggatgggctgccttcagctcgtcttcgcgctcccaagtagcttcttcttcggcgtggttgctccactggaccttgcaaaaacggattacccggttcctggtcctgcgctccatggtgtccaggattttcactggcttctccacatacgtcaggtcttcgcgaacttcaatttgctctgagtcggcctgctcggatggcactcgaagacatttcttgagttgcgacacatggaacacatcatgcacgttacccaaggaggcgggcaactccagctggtaagcaacttctccgcgtcgagcgatgatacggaagggacccacataccgaggtgcgagcttcccttttgtctgaaacctgtgcacacctcgcaatggcgtgacccgaaggtacacaaagtcatccactgcgaattccagatcacggcgacggttatctgcataacttttctgccgagactgtgccacctttagattatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttggtagctgttattgtaggagaactcggcataggggagactcttatcccaagtcttcccgaaatctagtacacatgcgcggagcatatcttctaggatctgatttagacgctcggtctgtccatctgtctgcgggtgataggcggtgctaaaattcaatcgagtacccagctcttcttggagcttcttccaaaagtgagaggtgaattggcttcccctatcagatacgattttcttgggaatgccatggagactcacgatcctagcgaagtagagctccgctagtttgttccctccataggtggtcttcacaggaataaatcgagctaccttggttaatcgatccactattacccatatagaatcatacccaccttgggtttttggaaggccggtgatgaaatccatcccaatttcatcccatttccattccggcacttggagaggttggagaagtccggccggtcgttggtgttctgccttgacacgctggcacacatcacatagggccacaaactctgcaatttcccgcttcatgctgacccaccagtatttctccttcaagtctaagtacatcttggtactgcccgggtgaatggaataaggactttcatgagcttcctgaagtatcagctgtttaagttctctgctattctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttccaacgcggccaaaaatccgcgaccaactatgcttaggttcagggcttccatctgttgattaagctcgggtggaatgcctcggacattgagagtgttgcagtggctctttcgacttagagcgtcggcaaccacattggccttaccagggtgatagtgaattcccacatcataatccttgatgagttctaaccatctcctttgccgaagattcagatccgactgggtgaagatgtatttcaaactcttatgatcagtatatatttcacagcggttcccaatgagatagtgccgccagatttttagagcatgaaccaccgctgctaactccaagtcatgtgtagggtagttgccttcatgaggacgtagctggcgtgaggcataggctaccacatgaccgtcctgcatgagcacgcaccccaatccttggcgcgaagcatcacagtacaccatgaaatccttgcgagtatccggcaagattaacacgggcgaggaaaccagcttttctttgagagtttggaacgccttctcgcattgcgggctccacacaaacttctcttctttcttcaacaactgtgtcatgggtcgagcgattttggagaagttctcgatgaatctccgatagtatcctgccaaacccaagaaactgcgaatctgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgtttgtgagtatatcagaatgtcatcaatgaaaaccacaacgaacttatccaagtattccatgaacactttgttcatcaagttcatgaagaaggcaggagcattggttaagccgaacgacatcaccgtgaattcatacagtccatatcgcgtagtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacctcattgagagctctgtagtcgacgcacatcctcttcgtcttgtctttcttttctacaaaaatcacaggagcaccccatggggaagtactcggacgtatataccccttttctttcaactcttccaactgtttctttacttcggccagttcatttgctgccatacggtagggtcgcttgtgcagaggagtggttcctggagcaagatctatccggaactcaatctctcgcttgggcggcataccaggtagttcttccggaaacacgtctccgaactctctgactatggggatttctgacagacttatctgatgcagttctgaacttctgacagaggttggaggtgcaaagaaaacaactgggtgttctggccctcggtacagagtaacagtgcgtcttgcgcagtccactactccttggaattgtgccaaccaattcattccaagaatcacatccaagttctttgggtctagaagaatcaggtccgaaggaaaaggaatcccctgaatttctataggggacgggagggctataatactttgctgtcataaccccgccaggggtggtgatgagcagagggtttttaagcctttctacccccaactgatttttccccacgaatggcacagatataaacgagtgggaagctccagaagtcgaacaaaattgtagcagggatggaatgaacgaggaacgtaccaacgatgacgtctggagttgtcagcacgtcctcggccgtcacgtgattcacacgaccacgaatgacatccttcccaccgttgttggagcggggaggcgcttggccttgctgacgccttggcttcgggcatttatccgcaaagtgtccgggctcgaagcagttgaagcacagacgctgcggacctgaagcgtccctgcggccttgaacgggctgcaccgctggcgtaagaagacagggtgcacgagtcccttgctgattctgc

SEQ ID NO: 15739 - DNA, 4718 bp, Oryza sativa
tcttctctccctccgatccggtgttgcgccatcgtgacggagcagcggcagacggggctcctgccggcggaggaagaaacttaacggcggccgccttgtggaagaagccgaaccgccgccgaccggccccttcccgtggcctttcccgcattatgggggcccccaaagaaaccttaccgccgccgggggccttgcacttgatccgtgggaaaaaaagaaaaaaaagaaaagcttacttatgggttccattcctgtttctccccttccttgccatgttggcatgccacgtgggtaaaagtggtaaaataattaaaatggcatttcttaagaggggaaaaatgtgcaaacctaaaaggggcatttggataattgtccaatctaaaagtggcaaatagttaaatttcccatgtccgcctagaaaaatgtaaagggaaattttgctacaccgcgccagtggacaccgtgccgattaaaataataattttcggttgagaaggagacagaaatcgcgtgaaatattaaaaatgcccttgggcccacatgtcagctctccatctctctttctctctttctccctcctttctctcttctcccggtcatggcttgctcagcggcggcagcgatgcccggagcgcgcggcctaataggcggccgaggacgccatggccgcctcgtcgcaagaaccgagcagctcatcgacacccaaaaccaaatagaggcgcgtcgtcatcgccagcgtcatgcgcgcgcgccagcagccagcatcacggagacttgcagcttcgccaagctgtgcatggagtcgcagtcatcgttgccactgacagcgagggcggcagcggacacgagcgtgctggcgagcgcggcagtgcttctcgtgaagcagaacgtgacggcgacagcatcgtacctgtcctagctgcatggcgccaccgctgccgccggcggcggcgacctagatggcacgccgtacgacaacgcggacgacggcatggtcaggtatggcagggcggtggctgcacggcttgccggagctgctcgccgcgcgcaatggcgccgtcgaacgcctctgcaacgtcgccatggacatcaccaggctgcgccgacgccaacgttcttcctcttcctcgtcggcctcgagctcgacctggagccggcctcgcttcgccgcaccggccgcaccgccctcgcgaacgtggcgctggcgttggtcgcagcagcgttgttggcggcgacggcacacgccttgccgctggcgatggcgagggaggtggtggcgcgagaagcagtgcctcggccgccggtgccgagtaagccgtgcgcgctctgggcgtcgccgccctcgccgagcaagccgtgaccgagagaagattgaaaggagggataaagaaaaagagagatggatagttgacatgtgggcccaagggtatttttgacatttcacgcaatttctctcttcttctcaaccagaaatcattattttaatcggcgcggtatccactggctaattactatgtttatagaatatttttcctcaaaagtgagtttgggctgtgtgctagggctaaaaccacacatcagcagtgttcagtagcaaaatttaccaaatgtaaatgaccttaaaaatcgggcccctgcacccaccactgcttcacctcaccccactccctcacctctcagatcatatcccctcccctctctccctctctcccttacctctcaggcagcttttgtctatagagtatatattgtctataaattcccaaaaaaaatacttcaactatgacatttgtttcgtttaacagcattagtatatattgtccggaaaagaatattttttttgatcgatgatcttgtaaataggaattaaagttatgcactacgtactgtatgcgtcaatacctgattcaaaagagaaacaattaggcctagatcacatcctaaaattttttagcctgtcacatcgaacgtttaaacacttgcataaagtattaaaaataggctaaaaaataactaattgtataaattgcgactaatttgcgagatgattttttaagcgtaattgatctatgatttgacaatgtggtgctacagtaaatatttgctaatgatggattaattaggcttaataaattcgtttcgcggtttactgatggattctgtaattagtttttttattagtgcccgaataacccatacgataccctatataatatatgatgtacagctttacgcaccttataaacacccctttatgcagaaaagctaacgcaccatgagatgctctgcgcgaacggtttgaccgtttgatgccctttcccatttcgttatctcagtgtggcaaaaaatcaaagcatgaaagagatgttccaaagtactctgtgttgggctcttctaatttcagggcctgttctcccttgtaagttttttcatcctatcacatcaaatgtttatatacatacataaagtattaaatatagaaaaaactaattatacagattatgtgtaaaatctgtgtaaattataagacgaatcatttaagcctaacttctccttgctttggcaatgtggtgctacagtaaatatttgctaatgacggattaattaggcttaataaattcgtctcgcagtttacaggcggaatctataatttgttttgttattagactacgtttaatatttcaaatttgtttccgtatatctgatgtgacacggtaaaaatttttacccctagatctaaacacagcctcacatcctctcttccctcgtttttcgtgcgcacgcttcctaaactgctaaacggtgcactaatccatcgctccgttttccatgcgggaggtgagggtgcccatccctcacgtaagaacacagccctgaacaatagcgttgaaacatactctctccgtcctaaaatataataagttttaatttttagaattgttctaaaatataacaacttctccaccgacattcccttttcaaccaatcacaaccatacatcattcaattttcccacctacctctacatcttaaccaatcacaatcttccacaatttaattctaattgatttcttaataatcatgtccaactctataaccggacgggtgtagtataaaaaggattcagtgtctaataacgcaaagaataaacgttcatggggcccacaatttgcagcagcattctagactgaggctgtgtttagttcacgtcaaaattgaaaagtttgattgaaattgaaacgatgtgacgaaaaagttagaagtttatatgtgtaggaaagttttgatgtgatagaaaagttagaagtttaaagaaaaagttgggaactaaacaaggcttcggattctttacaaaactaacatcacctgacagcaatcattatgaagcatccaacaccaaccaaattcttcaatgtttgccaaggaactcttctaagacacgaagtttttttatttagaaaatgggtaaaaacctggccctctacgtctgaatggatgtacacaataaaaaccataataatttatcacaagttaatacatattcagatatacgtacacacatttaaaatattaaacgtagactaataccaaaccaattacatattccgcctaaaaaactgcgagacgaatttattaagtctaattaattcatcattagtaaatgtttattgtagcaccacattgtcaaatcatggcacaattaggcttaaaaaattcgtctcataatttacacgtaatctgtgttattagttcttttttcatatttaatatggcatgcatatgtcgaaacattcgatgtaatagggtgaaaaatttttatttgggaactaaacagggcctcagtacaaatctgaatatttagagtagaagagggttgaagctaatcagatgtacataaattgtaagtttccgatcgattccggtttcccaatagtagcctcaccatattcctttttgtttttgagaaaagaaaacgaattaatttccggtcccaaaactttctgaaaaaattccatccgacgtttacctttccaaaaacaggtctgaacaacagaaactttccgaactgttttgatatgtaatcaaaagttttcagtttgtatcatctaatgtattttaatagaattgttttcaatctcctttggcagaagttgactagttggaagactgtaggagtctcactcagcttttgatatttgaagctgaattttgtttttcgcccggttcatactcagatgtaaaatgtaaagctaacaaaacaagtctactttgcattgaccagagaggtaaaggtgttgcataatattgacatagtccaaagtcccaatggattttttcgtcaacctgacaaattgactgatagctaaaatatttacaagaatcaatagcacactctgtctgaattgacgtccaaatgaggtttataaaaaatttgtactgccactataaattggttgtctatatattggaaaattcatcgtttaccacaagtttcctcactcaatctcatccatatccctccaaatggcccaaaggttttagctttctctatactttttacgaagctaaagcttatcgtgcaagcatgtcacattatcacccaccagaaattactatttagcatattttaaattctatacaagcatgtcacatcatcacttctagcgattactattctagtcattttaaatcccatacaagtatgacacatcatttat

SEQ ID NO: 15740 - DNA, 509 bp, Oryza sativa
tatgctttgacatctattactagatttgatagtactcacagagaatgatgagtaaagaaaatagaaactaaacaaccaaaatactcaaactaagctctatggttcatgtttatggtatgatgggttcatcaaagataacagacatgaccaggtggacatgagaagcttcaaatttatctcctgaagtcaccatgatgaaaaatccacttcatatcaatttactaatatacagtgaaatagctacatctatttatgtaagtaggtgcatcaatgagggatgagcgatagtcatatgatcaaatagatcaaatgtctcgtcatgtcaactggtgttgaccatgtttcagttgaaaatcacaagcaattgaagttctaaaagacttgactcgttacatgtatgcaaatgaagcatgacagcaatgaggaacaatattaaatacactttttataatatgcaatctaatgctgcagccagcactcacaaatagcaccgacctattagtagctgt

SEQ ID NO: 15741 - DNA, 688 bp, Oryza sativa
cgtgacccgaaggtacacaaaatcatccactggaatttcagatcacggcgacggttatctgcataacttttctgccgagactgtgccacctttagattatcccgaatgattctgactttagcttcagcttctctcaggatatcagtcccgaacacttggctttctccaacttggtcccacaatagcggtgttcggcatttgcgcccgtacaacgcttcataaggtgccatttgtatgctggcttgatagctgttattgtaggagaactcggcataggggagactcttatcccaagtcttcccgaaatctagtacacatgcgcggagcagatcttctaggatctgatttagacgctcggtctgtccatctgtctgcgggtgataggcggtgctaaaattcaatcgagtacccagctcttcttggagcttcttccaaaagtgagaggtgaattggcttcccctatcagatacgattttcttgggaataccatggagactcacgatcctagcgaagtagagctccgctagtttgttccctccataagtggtcttcacaggaatgaatcgagctaccttggttaatcgatccacgactacccatatagaatcatatccaccttgggtttttggaaggccggtgatgaaatccatcccaatttctcccatttccattccggcacttggagagg

SEQ ID NO: 15742 - DNA, 774 bp, Oryza sativa
tccgatatctggatatccagttcataacaactgtcgtccatatatttcacataatatcgggctagaagcaatagaaaatgaagctaagacattgaagtttatacacttcttgcatagatagattttttttagacggaaggccagtggcccggcttttaattgaaagccaaaacggcagagttcagctggggttgccagcgtactgcatagatagatgccacctccagtcatcctaatcaagtaaaagtataatttgcatttgacaagatcacaagatagtcacaaaccttgtgcctacgatacctaatggactcgagcatgtgtatttgctttaacttaatctaactagccatgagttctcaagttatcttaaatgacaatagaagacgttgagcaagagtatagtttaattatgacaacatgttagatcgcttctatcttatcggaatgggttctgcaccacaaaacattgatccaagtaagatctcaactttgtagccttatttggttcttgagtagagaaattttatggtccttgaaaaggtatctcgatgtacctaaattttacactaaaaattttagcatctcgaggaacctagtagcatttccctattggttcttgtgattgttcatgtttggctatgttgattgttcctgcctaccttgtaccttgaaatgcgaccctcctattacctttggctttgctgtatcaattttgtcagtttggagctaactctctagttcaaaatttaggtgaaaccttcatattcttca

SEQ ID NO: 15743 - DNA, 665 bp, Oryza sativa
accacataaaaatcttaatcttaagtggcatcttaagcttccaaataatcttggttatctcaatatatccattattaattaaagctagatacatcgacctaacagaaaatattccattctgatgataattccatctaaagctatcagaggattgattcaattgaatatgtccaatagaagcacacaattcataccaatatgcaagattctgaccaactaatgatctcctaaaggaaacattgagtggaacacatctcataacattagtaatagtagaacttttccttcggacaatatagtataaagatggatatttgtctttaaagccaagattcctagccatttatcttcccagaaccttatttgtttcctattatttacaatccaagaactcatatctaagaaggtatctttgatcttcatgagacctgaccaaaaatgagaatcatcccgttttttattaactcgggttatattataaactgattgtaaagatactttcataaaaccggatcaccgacctgatcctatgtttccctatggtggctcacaccaacgatacctaaaaatgccaaaaatctgacactgaaacggacggccgagatgacacgtggaccgcccaactgagcatccacgcaaggccatgaccccataaatgacctccc

SEQ ID NO: 15744 - DNA, 358 bp, Oryza sativa
agagaaaaacgcctgttcaaagttgatgccacactgtcacgcatcacgggctccatctccatctccatctcctccaagtgaggaggaggcacacagtctttctgcccggcgggttaaccagcaacccgaatctggtgatctccggccgtccacacatgcaaaacgcatgcacggcaatattttacgccgagccaatcagcgtcggctacctcacaccatatggagccccccactcccccagggcccacggtgatgagagccgctagaatccaacgcacacgatgttttccattcaattcaaggccaccgtcgccgccgatctgaagccaaccgccgacccaccgcaagaggcccgccg

SEQ ID NO: 15745 - DNA, 3838 bp, Oryza sativa
cttctatcgaatagagaagcactcaagcttgttatttgatctgcctcactttttttcttgggctttttgacggacctcgtaaccaagaactccacgttcggccacaagagttgtgcagttgctgagggtgtccactgccaatttgctgtttaatactgtttttcacgaatatggtttacctacatacaaattcggggcacggatcggtcagattccaaattgtcacagataggctaatggatagcatatggcatatgcataaagtaaaaaaaaaaaagaagaaaaaagatgcaacttagatgcttggatcacccttcacacaatgtgctcgacaaccatttatcactgttaatggcataaaacaggatgcgactatgggttgaatatctgatggattaatcccattagacactcaacatgctacatttgtgaatgtcatttttttacggaaatttgagcggcctgttgcaacaagaaaaacaaagagtttcaattgcaatgatgacaacaaaacgttcttgacagaaacgaaccaacatctttctgtttggtcaactgatgaccaaaaagaaacatgagatggctaataaatacatttatgacgaatacaacactacacaaacaaaagttaaattcaatccacgcaccagaaaatagaaaaacaaaccagacttaacaaggtgcaaaagcatttgcatttggatttgttattactcttccatccaaaaaaacaaatttgacctacatgtctgtggagtgacacgcgatacaattatctatgccactaattttttagaacttctataattatcttggccacataaaagatgtcagataacacttccatcatacaacttctatttactagcttcaatacccaagtaaaagagtttcaaaagtaacagacttgtatgatcaatacatgtttccagcaaaaagaaagaaaaatacagatattgtcctcgatgcaacacaggacacagacatcttgactgcaagagaaaatcaaccttttgttgggccacaaataccccggtaagcaaaacaatggaagataatttgcaacaaaaaatatactagttattactgagaaaaactgatgcaatcatatggagaaaaataaaaaattctgcgacgggactaggtgcctcgacagcagcgaagcttgggaatgccctaacctgacaaggccgggacccgcctcgtcggcggcgaagacgtctccgtccctcagccgggctcgatggacgggtggagcactggattcggagatttggaagagagagaggaagaaccaagggtgagtagataacaagtgaatggatcggactcttcagctacagaaaggtgaactagtgaatagtgggctttgattctgcaggggaggtggtccgtggtccgtgggccgtgggccgtgcacgcggaaaggagggcccaccaccgtgccgtgcttatccaccaaaaaatcggttcaccccgtgtgcgtgcgcgttcctctcaccacggcgaacttccagcctctcccgccgcggcttccgcgccgtccgctcggcagtggcgccgccgcctcgccgcgcaatggcccccgccgtgctcctccgcctcgccccctcgcctccgtatccccagaacccgccgccccggcggcggagccccgcctcggcatgcggcgcctcgcgccgcgacttcgccatccacaccgccatcgcctccgcctccgccgcggttgcggtctccgttcgtccggcaccgccgccgccgccgacgaggaggcgccaccgggggagccttcccaaaataagaagggctcccctctgctgggcggcatcgcgaacaccaagtcgtggtcgcagtactacggcagcggcttctccatccgcgttcccccttccttcgacgacatcttggagcccgaggtctctcgtctcctcccaatgtccccttgcgcgttcggtttcctcaggcattgtagtcgcgcgaggccgcgagctcaacattttggttttaacctcggaattttatcgacaaatcaggagttcaacgtcgggatgacctactacggcgacaaggcgaagcccaggacatacgctgctcgcttcgcgtctccggacaggtaggtaagtaaggtcccgtttgacttatcgagctctctagcatttcgagatatgcgtaatgattataaattttacaatactattaatctcaaattcgcctacgaaaatagctctaggaagaaattgggtagaatttgtatcactaaatacattcagcgagctaagatgattaccctgttatttttctgtaatgcaggtctgaacttgtaagcgtggtaattaagccatcgaatcagctcaaaatcacattcctagaggtttgcacagcaactagttatttttctgttactatagtttgattgttttgtgttctccctcccgaatttttctgtatgtgcagcatttattttgtctaaaagaaaaataatggtagagcaccggttcgttttttttttagttggtcgtgatgcaagataatgtgatgatttgtataatctgatgttctcaactctttggaatgaccaacgacccatttcctaatcattaaagcggcttagctttgcacactagttagtagttactataaattgatttacaatattgtgcagttgtctcactgtgttatgcaaggtagtatgattgatggcactttattttattttatttttttgataaagagaggcaggatcctcctgttttcattaacgaaaacgaaatgatgacaagtttgatggtgctttatatgttgataatttaccatcctttgataaacacccctaaacaataataagaattatatagaaataaatatagtattgataacacatgtcaagtcccaattaattatatttataatgaacaatagtagcattgattcacagagaggcgacaaacattactttttttgctccaactgactagtagaaactggtactgcactagtaggtgcaggagtgttcataatgtttctttatatcaacaattctctgtaatcaaggcccaaagacatgttttttattttgaattattttatgttgcacccaatcagccaaaaaatttatgttctgacacaaacattggtttgtaggccaaagatataacagacctgggcactttaaaggaggcatcaaagatatttgtacctggtgattactgttatcttagacttcagagatgtactttgcttttaaaataagtttctaagatgaataaggacacggcatattcacagttttcacttatcaaaggaaattgctaactcttgatctagcttcttgtgtgggcgctgctgtatatatgatgtttcacctgaatgacctaacatctaaaacatcatgtttacaaattgaaggggcatcttatcttaacaatgttcttatgatgttggttaattttgcatcatttttaaaataaatgtccagcaaggaagtgcactattaactgctttcttaatgagttgcacaatgtactcacatgcttactacattctattttgaactgtttctttcacattgtacaactttgtcgttatctactgttgtcttcgtaaaactttgtatgatcaatattgatgcttggttaaaatattcaaagaaatataaacttgtatccattttttgtttccatcacttcaaaaaattatatgaggaaacatgaagcaaaaatattctgttagcatgtagtgctagcataatgtactcatttggaaatatctgacttagctcttccaatttgtttgtaaattcttttgtctcatttcataggtggcgcaaaattatactcag

SEQ ID NO: 15746 - DNA, 2081 bp, Oryza sativa
aaatgtgtgcacgtatacttaacaaaatttggctgtggaactagacactgccactgcgaaaattctgacaggacattgaaccaaaccgacccacccatggctttgtgtgtctgaacaggtttggaaccgaggaaaattagagaagagtggttccaatcaacccctacctttccctttttcctgaaccccgtttttatcttatccccactcatcaatctctctcctccacacgtgtaccgaatcgacagatcatgcgatgagctccagctcaagcgggcacggcagcggctgcaagctcgattttgaatcgaattcccgtatcgaaatcatcttgtttcgatctactagtaactcttttggcatgcatcgggcaagaaagacactgtagcaaccaagattggtactagctcctgccatagatggaggaggaaaccaaagaagacgcaaatgcatccatgggagggcatacgagcgtgattgcggagcttaccttcggttggatcggttcttggtgccgcctgagcctgagctgcagcgatccgccatgagcacacaagcaccagccacaatagctgccagcaactgcaacgccgcatctctctgactctctctctctctctctctctctctctctctcccctctgtcagctcgcgttcgtccaaaacaacaccgattgagagagcgagggagttgttaaatagctgtcctttgtacttggaacagagaatggctcaccagctgacacgagaacatggaaataggcgtacttcttcgttagtttgactttaagttgccaaactttgaccgacaatctgtactgggaaatctaattatttactatctacgtctcggaataattatatttcttgaagattagctgcacgtttactgcatgcatacaatccatacgtaaacttgattaaaataaagattatgagatggggatggaaagatgagaaactagaagagctgtgttcggcagcaagttttcccaactctctgaattgttccgctttcaaactgctaaatggtatattttttaaaaatgtttctatacaaaaattgattaaaacaatcatatgatccactttttttaaaaaaaagttattacttaattaatcacgtgctaatggactgctccgttttccgtgttatcctggttcccaaccggtcctaacaaactcagcctatatcttatctaattaatttgttactccctccgtcctaaaatataacaacttttagctctcgatatttgtcccaaaatataacaacttatcgaccaatattctctttccaaccaatcacaatccttcaccattcatttttcccacctatctccactactcaaccaatcacaaccctccatcattcacttctacctattttcttaattaccacatccaactttaaaaatgcttatattctaggacggatggaggtagtacttcactagaatataatttttctggcataaaatttgaatgccataaatataattatgttgggggaggtagtaccataatagttagtatataccatcattagatttttaaacgaatctactttattattacatttgcctcatgatatataagagttttttaggttgacacggttattaaaaatgtactttctccatcccaaaatataagtatttttagcatagtgccaagtcaaccatttttaactttgactattaatagcaataaaataaaaagatcaatcatgtaaaattgatgttactagatttatcattaatcaaactattataatatgcaactctttttatttaaaacattttatttttatagatatttttggtcaaagtagcatctcgaagactgtgacgaggtccaaaaatacttatattttgggatggagggagtaggagttatcttcatcctcacaatatagcagcttagcatacgatgggacatatgctagtattaggattcatcccatccaaactatagttttgattattggagtacattttaatggggaatgttgtgattggttaagcaatggaggtaattggacaaattgaatgatgggctattgtgattggctaggaata

SEQ ID NO: 15747 - DNA, 4011 bp, Oryza sativa
actctctccgtccgaaaatataacaacttttagcactttgtgtttatcccaaaatataacaacttctccaccaacattcccttcctaaccaatcacaatcctactttcacttttcccaactactttcacttctcaaccaatcataacccatttctatttaattctacctactttcttaataaccgtgtccaactctaaaaaaacttcatgtattctgggacggagggagtaaagtctttacgccgttaaaaagaagtaactaaaaaataacctcgctaatataaattagggagaaaagcattgttgttttatcatattcctgtttgttttactccttgtttatccttagctgcggacctcatctatggataggtaacatggataggtaatgttttacatagatcgccgtacgtgtcagagtgtatagatggccatgtgggccgcccggcacggcacggcccaggcccggccgtgcctgggccgaggcttgtcgggccggcacggcccgaccaacgcaccgggccgtgccgtgccagcccacgtgccgcactcacagcccaggcacggcccaacacgcctcgggccgtgccgggccggcccgaaggcacgatgggccatcgtgcttttcctcagaataagtctaaattttctccctcctattgggctgtgaattgtatagctaaaaaaagtctattttacctccctcttctttgtgctgtggtatataaatagctaaaataagtctatttaaggtccctattctttagacattgacatttatatgtctatttttagtccctatactttgtgtaccaggtctggcctgctagcccatcgtgccgggccgacccgaccgtgccgtgccagcccagcgtgctggtggggaggcccaggcacggcccgacggtcgggccgggccggcatgggcccgacccaagtcgggccgtgccgtgcttgggccgggccaaaaaggcgtgccgtgggccgggccttcgggcctcgggccttatggccaactatatcagagtgtgattggcgatgtgtcttttttttttctttcaacatgcatacccttccatgaaatgctaaaagtattttgtaattggctaactaaatccattaaaaaccgatttggtttggaactggtgcctggaatcagtagctagctagggtatctttttccctttaaatgacttaattcctatataatatcgttagagataatatgtgtttttctattcggtattttaattagatatcatcatgagggagattaatgttttatctcataacctcgagttttttttatattttctttgctaaatgactgtgtgcttggcaaagaccgatgatgtaaatcatttctattattaaaagaatatttactgtatcgattcagagagacaggtactcccttcatctacaaaattacatttttgacaccaagaccaagaaaaaattaaataaccttggatgttataaaattaagaagtgaatgcaagcatgtaaccaatgagtatttagatgactccttggttctaataaaatatttaatttatctcttcatttaagtcttgaatatataaagactataaataggaacaacttatttggaaaaactcaaatgtgaaataggtataacttttgtggatggaggtagtatattatatttgtcttttcagaaaccagagaaaaacaagactagtgcatgcataattttcgttatttacaataatgtaccttgagtagaaattatgtactatcttcatttaaagcctttaataatggacggagggtagatatcactggtggagaaaccatctttggttggtcgaccaaaatacacaatagtcccggtttcactaaaaaccgggactaaagatgatcttagtcccggttggtagctacagtgggcatatttgatctttagtcccggttggtaataccaaccgggatctttaatcctggttcgtatgttgtcaggggttgttaggccctcttgtgatctttagtcccggttgttaacaccaaccgggactaaaaatcctaactttagtcccggttgttaaacaaccggtaaaacaaaacctctatccaggcgcgcatgcaaagtctcctattaattccatccttatctcctcctctcccatctagccatctccatcttatcttcttctctcctctcctcctatccttctcttccttcttctctcaccccatctcctcctcccctctctcctccccctcctcccctcccttcccctccggcggggcggcgggatggaggccggccgcggcggccccgggcggggctacgggatggaggccgccgccggcagcccggcgcggggcggcgagatggaggcggcggcgggctgcgtcgggggtggcggcggccggttgcgtcgggcgggaggcggcggccggctgcgtcgggcgcggggcggcgagatggggcggctggcaccggttgagagggcggcggccggcgccgggcgggaggcggtggccggctgcgtcgggggcggccgacgccggtcaggaggcagcggcaggagaacttttttttctcttctctgtgctatctgatgaatgctaatgatgttgtagatgtgaactttctttttcctttctttgttctctgtgatgaatgctctctgtgatgagatgttgtagatctgaacaagtgtaaacaatatggatgatttgttgtttgattttattcattcaatctatgatttaggttttgttgttgattttattcattcgatccacgagcgaaagctaaacaacaataaaaaaggaaaaaggccaaccggatgaaaggaaaagaaaaaaaaaccaaaactttttagtccaaaatcgatctttagctccgattatttgaaccgggattaaagatttgcgatctttagtcccggattcgtagtcccggttagaaaacaaaggttacaaaccgggacaacaaagcatttctacactagtgtatatagctgaaaaacgacgttccaacatgcgataacattacaatgctgaaaatgggcacgttaacgtactttatcttcgcttctggaaagatagttaaagtcttaaaagacaaattaagcagtaggctaaaagacttgcattaatgcgaagagaaaataagtatattagaaaacgagagagatgaggacgtatggctaaaacgagaagaaaacaataaacgagtattacggaggctgtagattgctacttacccgtacggagcatgaggtgtgcaaaaggtgtcaattttttatgtgtgcgcgcaaatgcgcagccgcttacatggatcacgcacgtttcacatgtgtttttccagcactagcggctagccgcctacacgcgcaaagcagatcaaaaggttaggaagtccatcgattcagagtggtggagactagagaaagacaactcttctttcttcacatgcgcccatgttccctacttacggaagtactacctccatattttaattccatattatattttaatgtatgacgccattgatttttgtccaacgtttgactattcgtcttatttaaaaaatttatataattattatttattttattgtgacttgatttatcatcaaatgttctttaagcatgatataaatattttcatatttgcataaaatttttgaataaaacgaatggtccaatgttggtcgaaaggtcaacggtgtcatacattaaaatacggattaaaatacggagggagaggaaaagtacatgattagtactactgatccctcggttgaaagtgtatactactataatatctttgtgatttttatacgaaaggagattaaagccatgcatggaccaaaatgagaaagatcattggagataaatttaaaaataaatttattttattattaaagaaccactactacacataaggttttcccgtgcggtcgaacggattttcgcgtgcggagattcggcccgtctggagcagttcgtctgcgaaaatcgctatttatgcgtg

SEQ ID NO: 15748 - DNA, 8844 bp, Oryza sativa
gccgttgccatcgccgtggccagatccgccaccttcccgtcgtcgtcgccgtcgtcttcccatagtcgtcgttgccttcccgtcgccgtcaccacctttccgtcgtcgtcgccgtcgtcggaggcccgccgccgccgtcacgccgccggatccgtgcggggggtggccgccaccgccgtcgcgccgccggatccacgcagggggttgcctccgccgccggatccgcgctgggggcggccgctgccgccggatccccgcggggacggccgccgccgccggatccccgcgggcggcggctaccgtcacctactcccgccacgcgccgtcgccgcgggcagtcgccgtcgccgtcgacgttgccttcaccacgggcagctgccgtcgccgtcgctgcgggccgccgccctcgcctacatccgccgcgggaggagaggagagaggagagaggagtgaggagaggataggaggggcgctgaggagagataggagagagagcactgagagaataaaggagaggggtgggaccgaggcgtggaaaaaggaaatttttgaagtgggtacgaggaaaaggaggaatgattactttttgtgtgcggttgtctaaataggcccgcacggaaaaataggtttatttttctgtgtggttcatttagaaggaccgcacgggaaaatcgattttcccgtgcgggcgacggcccgacacccggtcccctatttttctgtgcggttccacttacgaaccgcatggaaataaaaggggaccgtgtccagaaaaatatcctctagtagtgaacttttcaagtagaagttctttttttctaaaaaggttatgttcaatgttttagaaatcttgatcatggtaaatgagaaactagcgctctctattaagctgaaaaaaacattgctgatacagaatggagataaagaaaattaaacgagagatgggcgagtagaagccgagggatatatagctatttcctccttttaaatgacgtaacttagtattgaattagacacacatattactatgaatacagagagactcatatccatattcgtataactagtttgtatctaatttaatattaggttgatatattttggaatgcaaagagaagtatttgaactgaggaactacgccacatcaattcagaatcagatggtgatctacgttgtaattgtttacacccaaatttagcacctaggattaaaataggaaatattgccaaaatttggaagtctaccggtttcctccgagtgggccggtctgaccgccgtgtgtggccggtctgaccggcaggtccgagtccgactctgtttcgtcgggtttcgaggtttccttgctcgggaaggcatgtttcgggtttcctttggtttctaccccgagttggacgtggaggagggcctgtagagggcaagaccaacccttatataagggacatggccggttcattgtaaaaaaccaatctacaatcaatcgaatcgttttttcatattgcttttagttttctcttagtttgtccatctttgtcggtttgcgccgtaaaccgtccgccgccgctgcgagagtgcgacatctctttgtaggtttgtcctgaaaaccttccgttttgcccacgagacgggtagctatctagaaatcagctccgctagccggtttaattatcaaaacccatctaggtttagctctttgctagatcgaggcggttggcgactctaggatcaccgcaaggcttaaggtgctgcgatcgtgcttgtcaacttgtcaaaaaagttgccaacacgatttttggcgactccgctggggaggagatccgttcatcgtcaactcaactttgacttcgccatgacgaagctgccatccaagacggaggtggagccatctaatgtgatgccggtcacattggatgacttcgaaggagaagatcgtaaagctatggaggagtacatcaacgagctcacacgggaggcgttgatgagagcaactactaggactcgtcaaggcgtgatcatcaagcccgggccacgtcccaaactcgctcccgacgtggtaagtaatgacaaggtatcacaatctatccaacaacaaattgcatctacaatagattcatctatggctaattttaaagatagattagatgtaatgtttaaggataaagttgatgggtttttaaggagtaggctcggttcttttatggatgattacacattaaaggataaagcctataccactgttgatcagcctcctatagatccaatgggtggtaaaaccgacggaacggcattcacggtcggtctgaccgggcctcacagccggtcagaccgcgacatagccgtcgatccgactggccagacggccggtcagaccgggcattaccccagcggttagaccggctctcaggccggtcctaccgcgcatcatgacgccggtcagaccgggccctaggccggtcagaccggcgcgattgtcccgattcaggctatagatccaatgactaatgctagttatttgtatcattttaaaacatttgatcctcctgtatctactgccaccactaatcctcaagttcccccacatattcctaatgcttataatgatgtttctaggggatatcctcccgatactaggcaaggccaatataatcatattgcgccacaaacgcaacctattaggccaccaaacccaccaccaaatccacaagggcctaatagcatggaggatatgattagtgatattatgaggaatagattcggaattgaaactaggaatcgtgctagagcttacaaaaagccatatcctgattattatgataatgtgacgtttccttgaaattatagagttcccgaatttgccaagtttagtggtgaggatggtaagaccacatgggagcatttaggtcaatttttggcgcaatgtggtgaggctaatagtgatacttttaaattgcgcttgttttctttatctttatccggtaatgcttttacatggtctacttctttaccggcaaattctattcatacttgggctcaattagaagaacaatttcatgattattcaatttcatgattatttctatactggggaaactgagcttaggttatgtgatttgacatcggttaagcaaaagtataatgaatctgtcattgattatattaagagatttagagatgttagaaaccgatgttatactttgaatataactgatagagatttggccggtcttgcttttaatggtttagttgctcctcttggagaaaaactagatggccaacaatttcttgatgttagtcaactcatgcaaagggctctggctcaagaaagccgggttaagaataataaaaaatttgctagaccatttgacaaaaagcctaatgttaatgtagttgattaccctgaggctagtgatagtaaggaggagggtgatcatgatatttatgttgccgaatggtcgtggactaataaaaataaaccttttgtttgttctaacctgatgccgactcctcgcaaagatcggcaaagtgaggttaaatatagttttgatgtggccaagtgtgataagatttttgattatcttttgcaagagaaacaaattagattacctaaaggccatgtcataccttctcaagaagagttgaaacgtcgagcatattgtaagtggcatgattctcattctcactctactaatgattgcaatgtgtttcgacgacaggttcaatcggccatagatgaaggtcgattgaagttcaccgatggctctaagatgaagcttgatcatgatccttttccggtgaatacaattaatttcaatgataagaaggtgttgattcggccagagcaagccaaatctactaagggaaaggaagttgtcattggtgaaccaagatccaagatgatggtgccaaagaagccagaggttggcctttggaaggagaataggagtggagcttcaacttctaaggcccctaggaagaccaaggtgacctttgatatgcttttggagaagtatgagaagtaaggtggtgagaaggttcgcaacaaagggaaaagaccaagatcacctcctagggagcgatttggtcattcaccaagacggtcgcattcgccttcatatcattatccacaagacatgtcatggggttcctatccaatgccgctgccgggttatccttatccttgcttcatgccatggggggcagcgccgccaatgtaccatcatatgcctccaatgtaattcaaccaggggtggggaggaccacagaggccaattcatgagcatttgtcttcaccaaataatagccgattttgtaagaatcgggctaatgaagaaaagagggaaggaaagcgcgtcaaggtggaggaaaggacttcggaagtgattactatcaaagtggggtcccatgatgtgcctataccttctggagatggagttggagagtccccaaacaaaaaatccgaagccggtgccagctcttcgcagtcggccggtgtcacgccctaaaaatcgcctaaattaataatgcatattttaatcatttttagaaattattttaaaagcctacaagttaaactctaataatctaggaaaattttcaacataaaattgagctagataaaattttattaaatactttgcttgttcctctattttctagatttttctgggaattatttgatccagggaagtatttttaataaatgaaacaacatttcacaaattattttaattaaaaaagtttcaaaaaccctcccctaagccgttgggccgaattcggcccaacattctctctccccgcgcgcgccaaagccggcgcacgccacgccatcctgccgccgtcccccctctctcttgcgggacaccgacatgtggggcccacatgtcggatccatccccaacctccagccggccagccggccaagccgagcccgagccgcccctttgcgccgccaaattcgtcgcacccggtcaccctcgagttcgattagttgaggggaaatactctcctccttatcctcttcctttccctaaagtctccgagaccaatttctcccggataaaccaaatcgagtccgtttaagtttatctctccaaaccaactcgaagatttttccagcttcgattcctctcggttggagtccgatctcttcaatccaagcctataaatagcatccccttggcgtcctctttcgtttgccccaactcctgagccctctcgtccctcgtagcgccgccgccgcgccgctatagtcgccgccgccgccggccgtcgtgcagccgcgtcgcgccgcttgccgccgccgccgttaggtgtgcacggcggagtgctagctcagcagccccctccccgccatcgccggacgccgtagcaccaccgccgccgtcgaccgagccgccgccgccgcgccatcccgccgccgatcacaatccgtcgtcgtcttttgttttggtgagcaccgttaagttcgtatcgttgccctctatgcgtaggtgccctctaatcgtccggccaaagaccctagcgccggcgaggtcgtcgcccgtgccgtggctgccgtcgatgacgtcatcatgacgtcataatccctctttttcagtttttttaatagatgaaatagattaaaacttcggaaaatcataactaattaaccgtagctccgattctagtggttcaagttgctaaatttttctaaaattgagatctacatgttaaaaatatccacatgtactgtttatgcttgtttttgtactgttttgttgatttagtctttttgctttagtttccgacgttccggaggagagcatttcagttgaggaaggttcagaggtttttgtggaagcccaaggcaagtcacacagatcccaaacaaccctttgagcatgttgaacccgtttaaagctattgttttatttcaacttatgcattattttcgaatgtcatcgggtggtgaaccttttttcgaataattaatggccgaagatgacttaattttcctatgggttataatttgattagcatgaaccttatatattggattggttcagctaaatgtcatatgtatgtttgcttagccatgcttagaaatattagctaactaaaggggattaaagatatattatattatattattattattaattgtggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttaccgtgccaaccacaagccagcatgggaaacgactttatcttttgtatagcatgattcattatagtgtgccagactgtgaagcggcgagaagtccgtgggggtcgctggggagtccattgcctctggttttgaggtggagattatgatccaggaacggtgcactatggtgagttgtgttgtgcgaggggtattgtcacagttcctttccaaggtatcgtggtggtactgaggcgcatggtgacatgttgtgggattgtgtcttgtgggtatagtggtacacctctgatcagagtaaaactattcgaatagccgtgcccgcggttatgggtgagttgagcaatgtttttcgtgattagtctcacactattcattaatggtaattgtgataattaatttgattcctggtttggaatggtatattcctggtatggaggtttgatttgtacaaccgggggttggttgtttagatgaggttgggcctatgcaacacgggagtgttgtatgttgtttatttaatattgattaattattcaactgttttactattctcttaaatatttatcaaatgctgtttacgcaaatgagatacattatgccatcctttgttatcctatgcacttgcatatttgctatgtggcttgttgagtatgtcatatgctcattcttgcaatattcattcatcagaggaggagtacttcagtgaaggtgatgatctggaggactaggcttggtccgggttaagttgcttgtggagtggagtcgccatagttgttccgtagtttgctttagtttatttttccgctgcgtagaatgttattctttgagaggaactatccacctctgtaataatttattatttgcgaatattaaatagctgtttatttgtactctattatcaatttgttattgcgtgcctcggctgattcctggacgagggtttaacacacatgtaagcgtttggaattttggatagaaattctgggcgtgacagccggtctgaccaggcctcctggccggtctaaccgcagccatgcggccggtctgaccgagccattaggccggtctgaccgccgaccagacagcggtccgaccgaggcttcaggccggtctgaccgtgtgcccaacgtcggtctgaccggtgcatctggccggtctgaccgggctccagcgccggtttgacaggaggattgcaaagggcgatttaagaacttcatcatcttcaaacaaagttaatagaggacattatttacctcctggaacagagccgaatcctaggtggatgcctaaggatttaacggctactcaaaagagaagattgcaacgtcttcgggcccaagagttaagagagaaaaaggccgaagaacacagggataaaaggttcaataaattgagaccaccaccgatttggaggcctaaatccatagagaaggcacgaccgattgatgtagaggagaaggaagaacaatcagttgctaaaagtgaatcatctccaaaagaagacatggataacaacatggtatgtatgttgcctatggagttttgtgctatggatgaagccgaggttgctcaattctcattaggtcctaaagacgcggtttttgagtagcccgatgaatcaaaccgtcacatgaagcctctctacctcaaaggccatgttgatgggaagccggtctctatgatgctagtggatggaggtgccgctgtgaacttgatgccgtactcgttattcaagaagttggggcgcgaggatgatgagttgaagaagagattctcaatggcttcaacggtaaaccaatgaaggcgaggggtatcttttcggcggggctcaccgtgggaaacaagacgctaccaaccgctttcttcattgtcgatgtgcaaggtaactacaatgttattttggccggttgtggaattcatgccaattgttgtgtgccttctaccttgcatcaatgttcaattcaatgggacggcgatgatgttgaaattgttcaagcggatacattggccgaggttgcaatggccgatgctacttttgagtggcgtcatgggaatatccaatgtttatcggagagggatctttctagctatgattttattagtatctccgttggcaaatttgtacctatctctgtaaagccggctagcgtagcacggctaagccatataaatttgtataatgagtaaagaggctagtttagaatggttacaaaaaagggtgcaagaatatcggtctacaaagaatgatattggagaaaccgttgaagattttaataaataaaaaaggtttgaccaaggtttacctcaaccgattccatggaaaaagttaacattagttaatggaattaaccaaggccgacttttggtaaccaaaacattaaaaccgattaataaggttaaaatattcgaggtacttaaaaagtatgttgattgttttgaatgggaggaccatgagacgccgggttttagccgtgagctcgttgagcatcggcttccaattaaaccgggttttaggccttataagcaaccacctcgtcattttaatcttttact

SEQ ID NO: 15749 - DNA, 509 bp, Oryza sativa
cggaaccctcaatgccatccaatccagtcgctggcacaaccaaacaaaacaaacaccccggaagcaaattcagaagcaagcaagcatgcgggaagccccccccccccccaacccaagacacgattcgaagagaagaagaagaaaccagcgcgtacgtgccgcaccttcgcagccgccgccggcggggaggggagggctccgcggaggcggcgcaagggcggcggcgagtcggagtcggggtcggagtcggagtcggtgcgaggcccaagccgaactaggtaaagagatttattggacggccaggatatgcacaggggcgttgatccgacggctcgaacgcctcgtcagggctaataatattgcctctcgcgagagagaagccaagccagttgagtcgaactgttgaggaatcgctcgctcgctcgctcgctcgccggcggcgcggacgaggagggggcgagatgttctccacatcgtgctggagcggaacatgcagctgcacccgcggc

SEQ ID NO: 15750 - DNA, 1384 bp, Oryza sativa
cggagggagcggctggccgggtcagccgatccggtcgtgccgaggtggctccgacgtggcgcctacgtggctgccacgcgggccggctggaggaagacgaaggcgccggcctcgaatggacggcgggcggcgacggtttctccgggacgccgtgcgacgacgaggggcgacggggcgtacaccgggatgacgagggagaacgagagggagcgagccaacggcttggattcgccggagggagtccgtcggcggcggattgcggcggcggcaaccggcggagagaaaagggggaaacggcgacgaggtcatgagggaccgattcccggcggtgagagcatctacgcggctacgggaacccaccccttgcgccggattaggaggaaacgcatcgagggaggccggcgacgagagacgcttccgagctcgggcggcgatggcggcgagcacacggcgagcgacggcagcagtcggggcgacgccagctagctactggggtactacacacgctactaaccgagtctaaggggaggagatggatcgaggagggagaatgggggaatgcactaccgagatgaggcggggcgctgtgacgagaggctgacggcatgggagcgatctctccggcctcgtgccggggaagaggaagaagagagcgcgcccggagtccccttcggtgtcctcgctcgtgccggctcctccgacacgcgcgacggcgaatggcgaccagagcatggaaggcggcgacaatgaagtggaggcgatgggacaaaacgagaggagaagggagagaagggcgcttgggctttataggatggcaacgtcggtttgggaaccgacctaggctgtcaagggagggagctagcgctcggcggtcgcggccaaagcggcgacaggggggaaatgacgccgacgggagagaaaagggaaaaaggaggagggaaaaggggcttgcccccttgccactttggggaagaagagagggcgacgcagcagagggggggagctctgcctctgtcccttggaagctagcgcgcggagtggcggggctgggttgtgacgacggcgatgacggcgggggtggtgtggagcggagcggcgacacggacggcaggcgcggacaggcacggcagaggctgacggcggcggcgaccaggcggtcggccaccacggcgcgcgcgcgcgcgggaagcaacgggcggcgcgacgatttgggcggcgtcggcgggaagcggcagcgagagtggagggcgctcggctcggcgcggctcacgcgcacgcgtgcgcagcgcacgggcagagcgggggagagggagagagagagagagagatggggagggagggggagatgggccgagaggaattcggcccatcgaacctaagggag

SEQ ID NO: 15751 - DNA, 684 bp, Oryza sativa
gggcccaaacccatagttttttaatactctatgtcggggcagcatcgatctactgagagtcgcagggagtgtggccaccggaggccctgttcattttctttttcagtggattgggtctaaccacgggaattttttatggggattcctaatgggtgagtctgtgccagcacgctcccccacgcaggttgctcgactaacggcgctcttagcactgtcaggattatggataccacatacctaatagtagttgactaaatctcggcaggacccaccacataccatgtcctatacggaagcaaccttcggatataagaggagttccggataaggaaagacaaccagagttctacatggaaacgacgaggactacttggattgtattcatattgggttccctagttcaacttggacaaggagatacctacgggtataaatacaagcccccctaggaggagaggggacacgagacaatcaacacccaacacaatcagcatagaagcctacatacgccaagacacgccgccggatatcgacttcagggataagcacggctagtaccctacggtgtctccggatactgtcaggagaaacgaaagcgccatctctgatctcgccgggcacggattcgaggagaaaggctaccctattgtcgactacgagtcagatcgtcagaccgccatgttg

SEQ ID NO: 15752 - DNA, 1128 bp, Oryza sativa
gatcgtaggggtggatccagcacgggggcggcgtgatcttgagcccccactactagcgtgaagactatgagattaccatatatagatgaaagggggactgtaattctatctagtttgctcagactctaatgctatttctttttgaatccgtcacttcatagcgcataagttcatattctgtgcaaacgtgagtacctcagttttggtgctcggaaacctgcagaagatgtagtcgccattaatgttagccaccataatttgaccaagaggattgattttaattatccgactcgtgtggacaatgtaaatgtcagcgctaagctagcctcacataactttagtggctagtgtcttcgggaaggcatgcaggcatgcacatgctgctgacccgccgtagtaagtcgagacgaggatgacggcgcggccgcccgagctgcgggagccggtggcgtagcactccaggccgccgtagccgtggacgacgtcgccggcctccccgcccgtgttctccgtcatgttcggcgggttctccaggcacgggtgcttctgcggcgacggcgccggcgagtacacttgccatctcccacggccgccgttattctccttggccaaggcgaggcgcccagcggcggcggccacgacggcggcgagggcgacgacgaggaggcagcggactagcatcctcgtgaatccggcggcggcgcgtcgcccgtggcgaattcagacgtgttcggtgatcggtgtgtgtgtgtgttaacgcttgagcccgttgattaatttgctgatgtgatccaggcactcgagatggagatatatataggtagcgggacggagggagctagcgagcggtgctgtgtgcacggaactccagaaccatagagcctgtttgatgtcattttcaaccataatatatttgtttcgcaaagttaaaaaacaatatctacgtttagtttattaccaaatttagtcaatacataagaaatcttgccattgccaaaattttagcattgacaaaacttgttaatgtttattttagttacaatctaaacatgcccatacatatatatttaacttttttttctattatgaagtcgcatcatttcggctatttttagcttttaatgattc

SEQ ID NO: 15753 - DNA, 1124 bp, Oryza sativa
cgtcccgtgctaatattttcattctaacgtatgagtagtgtataatttcggggaggaaagaatgcatgatttaatttctactttctagtaataggaaatctcagatgaagtcatgaaacctacatggttcatctagaacttgcgtggaattttaatcataagaaagttttggttttccatctccagttttcctctttctatgggggggggaaaaaaaaaaaaaccccagccccagccccaacccagctacgttatgtttgttccaattctcaccaaagcagcaaggtagtataaaacggcaatctttccgtgcaatgcaatgagctgaatgctttacacaagaatggaatttcggaacaagctctactaaggcctctagctcacctctcttcgcttccaatttcaaaaaccagcttcacaaaacccctccaaaatttatgtaattacctcccatctctccatactgccatatctaacgcaaagccccaaaagcacaagggctaaaatgcaaaaacaaatagcagtaaaattgtaaaaagcttggcagtacactaatcatgggtggccaggtctttccctttacaacccaaaatcaactcaaatcaaatctccactgcttaagagcttcaagcatcagcaaccttctcctcctcttcgcttggagaagcaagagcaggagagcagaagcagagtggagtttagctagcgagcgcaagccaccatgcgcgggccaccgcatgctgcggcggtgctcctcgtcgccgccgccgccctctgcctcggcggccgcgcggaggagctcgaggcgtcgtcgccggagttcaactacccggcggtgttcaacttcggcgactccaactccgacacgggagggcgcgtggccgccgggttcgagtccatcgcgcctccctacggctccaccttcttcggctccccctccggccggttctgcgacggccgcctcatcatcgacttcctcagtaagctcacctctcttgttctcacccatttccttgtagattcttcatgtgggtggcagtgcgtcgttcacattgcttgttgcaatcttattcccacatggtaaccgggggcatcggcgatgtggcttctgtatgcatttgatg

SEQ ID NO: 15754 - DNA, 13061 bp, Oryza sativa
atcatgagtaatctaagcataaaaaggggcagtcccaaatcctatgacataggacatcgtacgcaacttctggaacaaatcccttaacaaccaaacaagtactcaggcttgtaccccgcattttaaaaacaagtggaaaggaggaagttaaaacttttttccaattaatagcacaagtttttggattaattggaataaagttaaaaaatcaaagtaaaaggtaagtaaataaagtaaaccaagcttgcaagataagttgaaacagttgaaatcaaggtcacaaattttgtgcttttgaataactggttccaaaagaaataaaagaaagttataaaatcaacatgctaaatttattttattgcagcaagattaaataaaacaatgttgtaaaacttttgctggtaaatgagccattagtacagtaatagatgtacagtactaataacactggaataaatttcgaatgagaaccactaaaagagattatgaagtgcatgtgctattagtgtggtttaattaaaagagaaggggaggagaacagttctacttttccaatatttttagagggcttctatgggtaaccatttggcataacctagggtcaacttggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaagataagataaacggcgcagacgactccactccacaagcagcttgaccagggctacacctaatcctccacaccatctgcatcactgtagaactcctcctctgatgaatgattgcaaggtgagtatatgacatactcagcaagccacgcagcaaatatgcaagtgcacaggataacaaaggatggcatagtagggtttcatttgcataaacagcatttaataaaaccgttaagtaataaataaacaatattaaaccaatgctatacaacataccctgttgcataggcccaaccattccgaacaaccatcccggctgcacagttctaactccaaaccaggaatataccattccaaaccaggagctaatcaaattattgccagttatagcatcttttattatgatgagaagtgtgagactaatcacgaaggacattgttagacccgcctataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacgattaatgtttcacaaccgaaactcgtgaaccggtccttaattgtcatgagcacgactctcaaaaccatgtgctcacaacccactattatcaagttttagttggcaagtaattaattaaccaatcacgattgaccatcgtgaattatcattaagccatcattaaataatagtgagtcataagttatctcaataatgtgctaatgtttctaagcatggctaagcaatcatatctaatatctagctgaaccaatatataaagcccaactagtcaagttataataacccaaggtatcaaggaataaagtaatcaatgcaaacaggccataacaaaggaatagattcacaccacccagtgacgttcgaaaataaatgcacagttgaaataaatagagaatttaaatataggatcaacatgctcaaaggattgtttgggatctgtgtgacttgccttgctggccttggaactcctcaaattcttctcctgcgaaaacggactctccggaaacgtcggaatctaaacagaaaagagcaaaaacacaaaaacagcacataaacaagcatgaacagtacatgtggatatttttaacatgtaaatctcaattttagaaaaatttagagacttgaaccaactaaatccgagctaagatgaattagttatgaattttcaaagattaaaccggattaaagcatttatatggattttaattgaattatgacgcaataataaattatttttgaaaaggaaaaaggagttattgcgtcagcggctagggtttacggtggaccgggtgcacggcggcggctcacggaaacgaacggccgagatcgatcctatccaaaacggacggccgagatcgaacggtccatgaccgggccacggcggacggtcccgatgacgtcagcggtgacgtcatctccggcggcggctcgggagcacaagctcgccggcgaacgacggcgctacggcacaaacggagggcaccaggacgtagagggcgacgcggcgaactcaccggtgaccaaaacggcggcggaagatcaacggacggcgacggcgtcgaggaagaagcggcggcaaccttcggcttgatgacgacggcggtgctccggcgacctacggcgacggcgaaggggcggactaggacggcggcgacttagcgaccacgatggcgaccttcctgagcgacggctggagcggcggcgacgacggcggcgctaggctgcacgaggctagggcgctacagacgtcggcgagcgaaggcgagggtggcggcgggtagaggagacaccaggggtccttttataggggcaaggaggcggcggcgaaggcccacggcgaccggcgacacgaaggaaagtttagggttcggaggagagagaccgatccgaatcgacctcgaatccacggatttccaaacaatttagacgaagattccaaaagagaaaaggtagaggagatctcgggaaacatttcccctctattgatttcaccggagaaggaaagacgcggccgaatttggaaggagacggcggcacggctcggctagggttcgggcggcggcggccgaagaaagacgatggccctgacaggtgggacccacctgtcagcgggcggacgcgctcgcgcgggcggctgcggctgcggactgggccgacttgggccggggagagagagaaaaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggctccattttatattggaacttattaattaaaattagatcttctcttctaggcttttaaaataaattctaataattccaattaaacaacaatttatatattttggatttttagggtgtgacaaacctaccccccttaaacagaatctcatcctcgagattcggaagaactggcgaacagatgcggatgggctgacttcaattcatcttctcgttcccaagttgattcttcttctgagtgattactccattgaactttacaaaaacggataactcgatttcgggttcttccctcatcggtttccaaaatacggattggtttctcaacatatgtcagatccttttggatttctatctgttcataagctgcatcatcatgttcataagctgtgcctgttgagccaggacttgggcaagtgtgggattctctccattggtgttggtaatggtgttgttggggccattcccgttgctgggagtgagcaccatctggcatgggcaggagcacaagaagagaaaccggggaaaactacttaggacagagaattaatttaacttttattgatcttaagtgagtttcattattacaaaactgaagactctcacaccactaaactcaccaactacctaacactcgaaagcaaacaaacgcatgcacttacatcccaccactgatgtaaatcacatgcgagacacacacaaccaaacttaaaacaaacaaactaacacaacgatctaagacaacgacttgacaaggcattctagttcttccgagcatcggagttgattgaaggctcgttcggctcgtcttcatcatcttgagtagctccccaatcgacctttgaaggggtgcgcttcgattcttctccttcatcatcacttacattgacgaccggaggatccgctagggctggggtaacttctttctccaccacacggacctttggcgccaattggtagcgagggacaaatagagctctcttccttgcggtaagacgaatcctggccttctgctatggtgcttctcccttcaacgcggctagttccttctccaaacgatccactttgtcctctagcttgcaaatcttaccacgattccggtcttcacgatcttgagctgctaacacagtctccgcacgggtttcattcatagcccacagcatctcaaccaaatgctttgtggtagcatcattctcaattccttgagtctcaaggtagctgccacgaccacttccctatggttggcgaggatggtagcgatactcagtgtcggccaactgatcactatagcgatcgcggagctctcctatggcgatccttgccacctcctgacatgcatggatgtagtttcttcctccagcttcgaacatcactgaggggatatcttcactattactgttcaaggtgacgatcatgaggaatctgggcataaaaaggggcagtcccaaatcctatgacaaaggacatcgtacgcaactcctggacaaattcctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaattaaagtaaaccaagcttgcaagataagttgaaacagttggaaacaaggttacaaattttgtacttttgaataacaggtttaaaaagaaatgaaagaaagttataaaatcaacatgctaaatttattttattgcagcaagattaaataaaacaatattgtaaaacttttgctggtaaaataagccattagtacagtaatagatgtacagtactaataacactgaaataaattttgaatgagaaccattaaaagggattatgaagtgcatgtgccattagtttggtttaattaaaagagaaagagaggagaacagttctacttttccaatatttttttagagggcttctatgggtaaccatttggcataacctagggtcaaggaggctctgataccaacttgtcatgcccggaatttctatccaaaattccaaacgcttacatgtgtgtgaaccctcgtccaggaatcagccgaggcacacaataacaaattgataatagagtacaattattactctagttaataagcgaataaaatgtcattacagaggtagatagttcctctcaatcaataaagatctaagcagcggaaaaaaaaataaacggcgcagacggctccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgaaaaaacaaggcatggactccccagcgacccccgtgggcttatctccgccacttctcagtctggtgccccgcaatgaaccatgttatacaaaaagtaaagccgttgcccacgctggcttgtggttggcacggttaatgtttcacaaccgaaactcgtgaaccggtccttaattgccatgagcacgtctctcaaaaccatgtgctcacaacccaccattatctggttttagttgccatattaattaattaaccaatcacgattgaccatcgtgagctatcattaagccatcattaaataataatgagtcataagttatcccaatagtgtgctaatgtttctaagcatggctaagcaatcacatctaatatctagctgaaccaatatatagagctcaactagtcaagttataattacccaaggtatcaaggaataaagtaatcaagtacaaaagggccataacaaagaataggttaattccacccaatgacattcgaaaatagatgcaatagttgaatagaaacaatagctttaaataggattaacatgctcaaagggttgtttgggatctgtgtgacttgccttgctggccgtggaactcttcaaattcttctcctgcgaaaacggactctccggaaacgtcggaatctaatcagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaatatttaatcggattaaaacacttatattgattttaattgaattatgacgcaataatgaattatttttgaaaaggaaaagagatttattgcgtcagcggctagggtttgcggtcgaccgggcgcacggcaacggttcacgggaacagacggctgagatcgatccatccaaaacggacggccgagatcgatcgggtctacggcggctcacggcggacggtcccgatgacgtcagcggtgacgtcaccaccggcagcagctcgggtggcgcatgctcgccggcgaatgacggcgcttcggcacgaacggagggcaccaacgggtagagggcgacgcggcgaactcaccggcgaccaaagaagcggcggaaaagcaacggacggcaccggcggcgagatcgaagcggcggagaagatcgggtcgacggcggcgacggtgctccggcggtctacagcgacggcgaaggggcggacgaggacggcggcgacttggcgaccacgatggcgatctccccgagcgacggcgacgactggaacggcggcggcgcacggctgaagcgacggcgacgacggcggcgctaggtcacacgacgctagggctctacggacgacgagaggcgaaggcgagggtggcggcgggtagaggagacaccggggatccttttaaaggggctaggaggcggcggcgaaggcccacggcgaccggcgacgcgaaggaaacttcgggttcgggagagagagaggaatccgattcgatctcaaatccatcgatttccaaaccgaaatagatgatgattcctaaagggaaaagatagaggagatcccgaagattgtttcccctcaatagatttcaccggagaaggaaaggggcggccgaatttggaaggcgacggcggcggcgcggcgctagggtttcgggcggcagcggccggaggttgacgacgacctgacaggcgggccccacctgtcagcgagcgagggcgcgcgcgagggcggctgcggctggactgggccgacttgggccaaggaggagagagagcggttttgggccgactttcagcccaaagccaaaagaggattttaaaaacctttttcaatttaaattatccatgaaatgcaattccatttattaaaaatacttccttagctcaaataaatcccagaaaaaatctagtaattatagaattaagcaaagtatttaataaaattttatctggccccattttatattggaatttattaattaaaattagatcttcttttctaggctttttaaaataaattctaataattccaattaaacaacaatttatatattttaggatttttagggtgtgacatggagtgagacataaaatatgtttcatttagatgaaaccttgttttcatgacagtttgtttcttgcatgtatatattacttgtggaaaaaaaataaaaccatgtaatatatgagctactttaatcatcaattaaatgtcatgttgcttatgtgtcaaccttttggaaacataaaaataatgcatcccattaggaatggccttcctagtagatttttattttggattgccctcgattttacaatattactgttggcaacttttttgacaagttgacaagcacgatcgcagcaccttaagccttgcggtgatcctagagtcgccaaccacctcgatctagcaaagagctaaacctagatgggttttgataattaaaccggctagcggagccgatttctaaatagctacccgtctcgtgggcaaaacggaaggttttcaggacaaacctacaaagagatgtcgcactctcgcagcggcggcggacggtttacggcgcaaaccgacaaagatggacaaactaagagaaaactaaaagcaatatgaaaaaacgattcgattgattgattgtagattggttttttacaatgaaccggccatgtcccttatgtaggggttggtcttgccctctacaggccctcctccacgtccaactcggggtagaaaccaaaggaaacccgaaacatgccttcccgagcaaggaaacctcgaaacccgacgaaacagagtcggactcggacttgccggtcagaccagccacacaacgccagtctgaccggccctcaaccggcagtctgaccgcccaacacacggcggtcagaccggcccactcggaggaaaccggtagacttccaaattttggcaatatttcctattttaatcctaggtgccaaatttgggtgtaaacacatgcccccctgcctttttgatgaacaacgtgaatctaaaagcatagaacatgtttttggtcttaggaagataactcaattaccggccgtagtacctcctaagtgtcttgccaaatgctcgggaagtatttcttcaagtatttcccgttgattgctcgctgaaaacgctccccttgaagtgtctccaaaaagtatgcgctccctcgaacaatgtcgcacactcgataaggaccctcccaactaggagaccacataccgaactccttggatcgagtacccaaaggcaaaattgtcttccaaaccaagtctccaacttgaaacaattttgctttcaccctcttgttgtacgccttggccaccctcttcttctctttctctatctcttccaatgccttcaagctgtcgcgtcccaaatcgactctaaaattcatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaatgaacaaagttgaaaaggttttataaaaagaaaaccctaaaagaagttcttttccccccccttccttcttgggccggctcggcccattccctccctctctctctctttccccccccggcccatcggcctccccgcgcgcgcgcgccgctgacaggcgggcccgcccgccactctcgctgacgggtggggcccacctgtcatcttcctcctcccgccgcgtccgtcgccgcccgtgccctagcgccgccgccgccgccgaatccgccgcatcccgccttccccgcgcgccttaatgaggggggaattattccccgcgtttccctctcccgattccccctcttttccctctctctctccctcggattcgctcggatttaatcccgcgaagttcgccggcgcatctatggcggccgagatctccgcgagcggtttcctctctccccggccgcgctctccccctcccgttgctatatattcgttgcccgagctccgctcttccgtttccgccgctcaccgctcgctctcgccgtcggaatcgtgctagcgccgtgctcctctctctccgccgtcgccgtcgaccttcggttcgccgccgccgtcgctccggtcttcctcccggctcggcgccacctccctcggcatcgccgcatcgccgtcgacctcgtccgcgcctccgtttcgctcgccgaccgccggagcaccgtcgccctcgtcatcccgagccgcgccgccgtcttcctccgctccgtccgccgtttccgccgccttcgccgtctcggggtgagccgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccaggccaccgtggaccgagcggctgacgcgtgggccccacttcccgtggacccggtccgcgcgcccgcccctaggctgacgcaataatccgtttattaattgaaaattaaatgaagaaattcgtaaatatccatttaaagagcatataaacttaaaatggccatatctttgccattttgaactcgtaattggaccgttcaagtctctaatttctccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttattattattaccttgttcaccctagatcaaacaaaaccccaactagtggacactctactcacgacaccactagtttaattctaggtagatgcttcgcaatttaattaggtaacattaggaggttttacaactttagactttgggaatgctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatattgtgtagttctaagatcgtgtttacaaaatagccctgagtaactaaatgtctttaaatgctgtttactgcaaccctaaccctttatgttataattcccttgtactcccttgcatttattctgcattcgtgggtgtgtcttgttgagtacggtggttgtactcagtcttgcttaattttcccaagcccagatgaggagttcctggaagatgaaggcttcggtgtctagctcgtgcctgccgtcaagcgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacacaagcgcttgtcgatgacttcatcaaggttgtctcccatcaacatgttgtaatcttcacttgacaaatcatcttgcttgatataacgaagagaaccaagatttacctccaccagtaaaacggcttcttgaccataaaccaactcaaaaggagtgactttagtggcaccatgtttggatatcctatgcgtccacaatgcttcagaaagcacctcatgccacctctttaggtattcctcaatcttcttctttaccaacttcaacaatgtcttattactcgactcggcttgtccattagcctccgtatgagtcatattcttcaaaggcatggcttcggcccacttggtgaagtaatccgtagcaactagcacgaacctatgcccctttgatgacaaaggataaatttgaccaataaaatccaaagcccatcctcggaacggctatggtttgattatagggttcaacacggcggcgggcgccaattgaacattgccgaaccatttacaagcctcgcatcctctataatatttgaagcaatcatcaatcatcttcggccaatagaaccccgctcttctaagc

SEQ ID NO: 15755 - DNA, 1801 bp, Oryza sativa
tagttttaggatcgtgttacaacatagcttgagcgactaaatgtctttaatgctggtttactggaaccctaaccgtttatgtcataattcccttgtactccatggcatttattatgcatttgtgggtgtgtcttgttgagaacggtggttgtactcagtcttgcttaattttcccaagcccagatgaggagttccttgaagatgaaggctttggtgtctagctcgtgcctgccgtcaagcgcctgtggtcgtcgccctagtcttccgctgtttttcgttgtctttgtgtgctgggccgttgttgctcgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatcctttgttatttgtgaaaacccgctattctctctctgtcttgctgcttcatttatcgtcaaaatctgatcttttaaaatgttgcttttcttttgtttttgtttgtagatggccggcagcgttacccgtcgtggtttggacatgactggcttcgtcttggagttgcggggcatgtgcgtggttttgggatatccacatggagtggattaccaggccaggccgctcccggagcaggagggtgaggatgcagagcctcacgctggatgggaggtcactgcagtgatcctctccggctctcccgagcggacttcgctggcagtcaccgcgggtggagactccttccccgccgcttgccagaacgccgctctcctcgccatcggcactcttcaccagcgctacccggacgagttgcagcactcgccctaccgctaccaccctcgtcgcggaggagcccgcgacctcgccaccttccgagacgccagctcggaggatgacgctaccgtcgtgcatctggcacgcatggtggaggcgtacgacgcggctcgtatcgacttccatcagatggtgcgtcgtggcatggtggagaacaacatgaagatcctggagctgcgtcaggagaatctgcagctcaagaaggacctcgatgcgttggaggcgcagctgcatcagctcaagatcgcccagggagagggcagccgccccaagcgtcgccgcgtctgccgcagccagaagatcaccgcccgcaagagcacctccaggcctgagcttgtccgtcagtccttggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacaccggtgtgtggtgcaactatgtcggagcctgtcttattttgtttgcctaagcaacttgaactttaatgaaccaatttaatagcagtgataaatttaagaataatagtagtcgtgggtggttagttttaatcgtcagctctccttctctgtttgctggttctgtgtggggttttcagatggtgacgaccaggagaaatgttaacaccggtgaaggcaaccaacccgagggcagcaaccccaacccccaaggcaacccacctccaccaccaccaccagacaccaacgccattctca

SEQ ID NO: 15756 - DNA, 733 bp, Oryza sativa
ttcacaagcagtaggcaaacaaaactacgctaggaatcacctcacatccgcccatgaccgtgggcacggctgttcgaacagtttaataacctctgcagagggggtacactttacccacacgacattactaacccgaatcacccagcccgtgcagaacggccacgtctggtgacataaaggttttcatgacaaggcatttcgagagcagacacagggttgccatatgccgacgagaggggtcccagaccaacaacaggttaggtcccagaccatactgtgccaggaagcccgggggttctctccgacaccaccccgttgaatccacatgtctgtcagcatcaaggctcccccgcttagcaatttactcagccaggggtgtcccattccacccatgtggtcgcacttgtcttatgatcggatgaaattccaaggaaacggtccttaagtgcaagagcgggaaaccgtacacccggtacgttccccggtccgcgattttggaaattcatttagttcgcaagcaccgacccaggtgtcgggttttccaagtcttttgtaaaacccaagttttacccaagatgtttctcagattttaagtttgaaggcgaccgtcgatactcgtgcagagtgcacgattaccgaggcacaactaggtggttacaagggaacatgatataacaattagcaatagaaggatcagatgcaacaagttaggtaggcccaccggtctgccttg

SEQ ID NO: 15757 - DNA, 748 bp, Oryza sativa
atgttgctgttcctatctgcttgctcaaggatgctaaagttgatatatcggagaaatgtttagtagcaggcttaagccatgccaaattcaatcgttattcgttagtactacacaagtaaataacgacgtcaaagagggaggtacatgaaattctttatctacctacaaagtaaaaaaccacatgagagagacaagtgtgtgaattcatatctatcatacaaagagatctaggttgcatttcttcatatagatcctgtctcatcctgggtagttgtaacgcaaactttccaacgaatcaaaccagagcacggctcgatctggctgatgcatgtgtgacatcgaatccccggaaacaaagacgatcgtttttactactgttctatctcttcatctagtttaattaatgccctgtatattcgatcgtgcatccatgtatcagtgggctcagttaaacaaagcagacgcaggcatgcaggagatgaaaacgagcaacgcaccctcgtgctgcccgaaagacagtgtactctccacactggcatgactcatttctacgggtgaaaacagagcggattcagacgaataatggtcataccatatcctaaaccaggattcaaagtgggtgcggataggatacggatgcgcatgcggagcggattatttcggatgtcggaaatagtgcggaatcagttcgaaaaaaattaaattatcggatattacatgtgtatacaatcaatacaatattaagtta

SEQ ID NO: 15758 - DNA, 361 bp, Oryza sativa
acccgacggtggcgttcaagacggcgctgtggctgtggatgaccgcgcggtcgccgagccagccgtcgccgcacgccgtcgtcacggggcagtggactccgactcccgcggacagcgcggccgaccgcgcgccaggctacgggctcaccacgaacatcctcaccggcgggctccagtgcgccggcggcaacggcggcgccgaccgggtcgcgttctacaagcgctactgcgacgtgctcggcgtcggctacgggcccaacctggactgcctcggccaggcgccgttcgacggcgacatcatgtcggcgtctgcggcgaagtagacgtgtgcgccgccgtgccggccccgatcgatcgaata

SEQ ID NO: 15759 - DNA, 631 bp, Oryza sativa
ttctagccgtcgtatccttgtgcctcgccgcgtcccttgccggagaagcaagatggggcctgccggagaaaaacgccgcatccattggatccatctgaaagcaacaacagagacgaggaacattgagtttgccactgttgccaggtttgccaggtccaccaggtataagtgtatagcttgaatgcttgagcatgatttttttacatgtacagatgaatgtggaacgcctgagccttgatgtgtttgagcacgattttctgttgatgtgcaagcatgattttagtagatgtacaacttttaagccttgagtattttttagacataccacagttaaatatgggatgataccccaggtcactgtttcccacgtgaattttacatctgaacaatattgggagattaccgttccgacggttccgtttccgatatactgacgttaccgatatcgttaccgtttccgagtataccgttccgattccattttcgagaaaataaaatgaaaatggaaatggtagagggtttttccgaccgtttccgaccgttttcatccctacgtgtaatatttttgtcaaattcaatgtaaaatggttgtaaaaatactttaaaaaaaacaacataagtacactaacat

SEQ ID NO: 15760 - DNA, 746 bp, Oryza sativa
gtccgcgggcgtggtacgccttgccgggcgcgcacggccagcgcgcgttgggcacgcagaagtctgacgtcgcgcccttcacctccttgtagcagtagccccacgagtagggcccacctgcagggacacatgcgcactcgtgcataagacatgtgtacgtacacgtgagttccaacgtgacaagtaaacgttactacgttaccagaggtcgcgtgggaagtctgggccaggaacgcggcgacctcacgcttgcgggtgtcggcgtcgcccgtgcaggcgaaggccgggaacgcgccggccgcggcgacgaaggcgcggtaggcgtagaacccgcgggcggggcacgccgcgtcgtcgcggtggggcagcatgcgctcgaactggtccgacgtcacgacggacgccacgccggcgcggccgccgcccggcgccgtgagcagcaccgcggcgacgtcgtcgtcgccgccgtcgcgggagacgcggcactggctctgacagccgcctttgcagtagtcgtcggtgagaccgcaccacccccacttgttgcagcagagcctgttggggcaccgggcgccgccggcctgcctgccgcactgctcggcgcgcgccgtcgccgcggcgtaggcgagggccagcacggccagcgccagggccttcatggccacctgcaggtttgcagcccttgctgcgatcatggcaagatgcttatttcttcaacaaaatcttgcttttcagtggtgtgttgg

SEQ ID NO: 15761 - DNA, 424 bp, Oryza sativa
gttgtcacctaccgttttgccatcacattttgagacacgctgtagttccccttgatcttccaaaatttccatcatagcccaggaagaaataacctagtgtcgaggactcctacgctgtagtccttttcatgtcattttcgatggacagcatgaggagaaaaaaagaggaacctttcgtgataacccaataaagagaagagcgagcacaacgggagattcttcccccaagttgagtgaagcgtacatggtcattagtacatatggcataagtgtgggggcgagcaccaagcagggaccaatacgtgttcaataattgggcgaagacaatgtataaagacgatttgcatcagaccaccctatgcagcacgcacagcaaaacctttttcctccttttagcacaagaaactcaagaaattgtttttcc

SEQ ID NO: 15762 - DNA, 472 bp, Oryza sativa
aggatccggcaccggagccggagcctgacggcgccgtcaacaaccccgtctcccccaccgccgccgaggtgctggaccacgaggcggacggggaagattcctccggagattcgtcggagcgcaaggcaccctccacggaagatgacgccgtcgctgacggacgtaagtacaatcaccccccccccccgctaattaatcctcctacgcgcatattaattacatgtgcctcataggccatagcttttccaaccatcgttgcttcctattttcggcatcggcattttttttcttgctaaatccgtcatcgtttccgttagttcatccgtagaatggatctccagttttggcccgcttcagttggatctggtcgtttgctgtggatttctctgcaagttttgtcctctaatctcctattttttggggttaaaagaaaaaagtgattaatttagactttcaaacgatgcctttctac

SEQ ID NO: 15763 - DNA, 711 bp, Oryza sativa
aactttattagtgatggaatcttatttatttactttgcaggagatacgtacaggagatatattcctcagtcggattacttttcgcggggactttacacgtttgacataggctaaaatgaccttgctggtgaattctactggaaaacagaggaccaagttgctgcatccattccgactattttgttggaattcgaaactgggctgaaggtttgtatacacagtattttcattcttaagcttttgcagtgcatggaacctttttttttttcttcaatggtcttcagtagtttgtagaatatggttttcagtcttcaaaaaataatctgtttgccttggccaaaaaataatcagtttgccatttttccatactggtccaactatgtactgtttgattgggaaaggacctactctaaacgttttccttctttttcagaaattatatgagcaaggtgccaggaaattctggattcacaacacaggtcctcttggctgcttacctcaaaacgtagcttttttcggcaaagaccgatcccagctggatgaacttcgttgtgtagcaaagcataatcgtgttgcaaagcttttcaacttacagctgcatgcactttgcacaaagttaagaggtgaattcgctggggctagtatcacttatgttgacatctacaccatcaagtacagcctgatcgctaattattcgcgctatggtatgca

SEQ ID NO: 15764 - DNA, 1562 bp, Oryza sativa
gtttatgctgttttgtgtattggaaatttggttgcaatggcgtgggttggattgtgattgggtggatgggattctggagccggataaggcgaggggcaagcgtgaacagccatgtctggtcgccatactacaagggcagaactgcacaagggtttctgcctccaggacggtcgctctgctccctcttactcttctctaaccagacgtatatttgtccttttatattgctagtaaattacccatggcataggataaaaaaataaacctctttgccgtgtttttagtagtagttatgtttatttttccggatttgctataaaccttttttcggatcagctgtatggcaaaacattggttcaatacccaaatccattaccgcatacaattccaccgatacaaatttgatggactataacatctggcatatctcttctctatctctatctctactattataaaaattaaatatgtttttaccgatactttgttacgtcatccatgtatgagtcaacttttaagttcgttcgcttttagaaatacaaatctgtatttgagtcgggttttaaattcgttcggttttgaaaatacagaaggagatgtataagaactttctttaaaaaaactcacatgctaacttgagatgatcggactcataattatagctcatgattttctagaaaaatatatatctaaacgaatactacagtgaattttaccttaactaaaccgtaaaataataataataagattaaaataatcttcacccgttgcaacgtacagatatttttttctagttaataataaatgcaactactcccttcgtttcacaatgtaagtcattctaacattttccacattcatattgattttaataaatctagacatatatatctatatagattcattaacatcaatatgaatgtggtaaatgctagaatgacttacagtgttaaacggaggaagtatataagaaggtaaactcctgcgtattgacttagattggaatatgccgtgttggtgttgcattaaatcagccttttttatacatagtcatacagaagtacagagtatatatactgtgtacatcattcttaaaaggttaattgcatgttctaatattgtacatcatagtagtaggtcttgtccctctaaaatgtatcaactaaatctacaggatccatggagcccaactcatggcctccctgagggaagcactcactatttaggaccgctagtttccgaaggtccagcacgctccaccatagcatcataaagctgtcggccgttctgtgttgcaacacgccaacaccaaatcaaattccatatgatacaacaacaaagttagtaaaattagtggacttacaaaaatcacagggaagaaatgaatttgcccttcgggttttgtttgggtctccttgaaataaaccaagataggaaattgtggccaccacagttcccaattcacaaatgttgagtacctgtgggtgcattcaattatcaggcattactactgttaccatgatcaaagcgatttatcgagcaagatagcccgacctttggcg

SEQ ID NO: 15765 - DNA, 26500 bp, Oryza sativa
  unsure (1)..(26500): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaaataattaaaacacagttggctcaattagctactttagtacctgcaaatgagtctgggtggattccggggcaacccgaaccctccgttgaaaatgttaaggcgatcacaatgaggggaggtaagtccactcatgatccgccaaatcctaaccctgcagggactagcagtatcacccaggaagcatcatctggtaacaaggctgatgaataagtttagctagagaagacagtgtcgcaagaatactgtgacacacgactgttgctattccctcaaagaagcaggaaactgtcactagacgagcagcttgctcattttgttgaggtgattcaaaagatccatatcaatgtgccattgttggatgccatgcaattgccaacatacgcacattatcttaaggatattctcaacaacaaaaggccgctgccaacaactgaggtggtcaaactgacggagcagtgcagcaacgctatactccacaagctcctagaaaagaagaaggatccggggtgtcccacgatcacttgctcgatcgggacatagaaattcgaccaagctctctacgaccttggagcaagcgtaagcgtcgtgcccaaagacgtcttcgacaagctcaacttcacgatgttggcaccaacaccaaagcgcctgtagttggccgactcgtcagttcgttatccggctaggatagtggaggatgtactggtcaagattcgagatttcttcatcccgatcgactttgtggtgcttgacatggacactgaaaaggaaacactgctcatcttggggcgtccattccttagcaccgcaaacgccaacattgatgtgggaacgggaagcattcgtttccgtataaacgggaaggaagaaaaatttgagtttcaactaaggaccgaacaatgctccatggtccaaatcaaatatgggccaaacccgcaaaacattcaagtggtcgaagtggagctacccaagacgaacagcttggtgaagttcatgcagaacttcctggagaaggaaaaagttaatcccaggaaccgttattggaagatgccggtaaaatccaatatactggccaagaagctagagatgccggctcaaaggaagccgtcgctcgcaccaaaaccgattaaggtgtggcaagtaaagcaaaagacgcccgctccatcacctccggagacgggtggaaaatccgcaaactaaactgaagggaggtgtcacgcccagaaatttaacccaaatttccagactattttgcgtattaaatccctgtccaggaccagccagggtacacaaaacgacaagtaatatacagttccaaacataaataaagcgtaaaatacttacagaagaggcacttagtcctcacaccgaaacgaaagcagcagtagcggaaaaaggcgatcctagcggggcttcaactcctctccacaggcaaaactcaactggggtctgagccttggtcctctaacttcatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggtggttgtaaaacattttattgagcaaaacagtaaaactgttgagtaattaaagtaacattaaatctccactgatcaaagcaacaccacgttgaacaggcccaaccaacccacctgaactacagtgcattgagtcgatttattaaggtgggactaatcacggtgaatttggtcgaccgcccataaccacgggcacggctattcgaatagttttactctgatcagaggtctacaactgtacccacaagacacagccccacgacacgtttccatgcgccgacatgccaccacgacataccggaaagaggccgtgacaggaccctttgcataaccccctctaaccaagcacaccacacctcaggtttcacccccactcctcgcaaggcagcgggcagtcccctctcgtgtctaggtgaatccggaagccacataggccgtcgcagggcctatcaaaactccatcacgcccacccttgcctggatgcgttagctagaggaaagctacaatacaagcccaatgttgacaaaagacagataacaagtaaacatggcacaagcaagcaaataggtaatacccggatcccatgtaattagcaaaacatgcatatttatttgcaaatggtaagacatttgtaaattggaatcaacatgctcaagggggaatgtgtgacttgccttgcttcttcaaaacaatcttctgaactcttttcctcgcgaccgcggacttctgaaacgacggaatctactcgctggcacgcaaaatgaggaaaaactctaataaacaccaagcaaacagtacataaaaagtaaacaaacatgtagagctcaattttagatggattttgcaagttgaatggcccaatttggagtccgaatgaattagatatgaaatttagaagttttgagccattttaatggatttctagaattaattccaatttatgacgcatttattatttattttccaaaggaaaaggcaaagccgctgacgtcatcaaggggaaggggcggcgccggcaagcgggctccaccggtcagcgacacaagggcgccggtccaccgtggaccgggatcaccgaggcggtccaccgacggtccacgggaaccgacggctcggatcggcccaaagccgatcgggcggcgacgagacggcgtagccgggacacgggcatggcacaaagccgacccggttgagcgacggcgcacggcggcacgcggccagacgaccgccggcgacggcggcgcgtcgcggcagcgggcacacggagcggcggaggaggggaaaaaggaggaggcggagggagagctcaccgagggttgcggcggcgagacgaccacagggaggtgaccggcgatggaaaggatggcagcggccggcacgggaggcgatgggaacggtgttccgacgacgcccgaccacaacggaggctcggccgagggccggcaagacttggggaagatattggagcggttagggagggaagagccggcacggagcgaccaaaaacgacggccgacgcggcgatacggagtggagcttaccttgactttggaaaagcggctcacgtggggttctggacagagtggagcggcagccagggtgctgtggagcgtggcgacgctgcgcggtgacggctagagcgggagaggcagcggctggaggcggtatagttcaggcggctcgggtggacagtggaggtggaatttcggtggtagattggggaaaagagatgtagaacggggtggagctcaggccggcgatgccgacggtggcgacggcacggcacggcggtggttgaagcggcgagaagcggcggctggagccggcggcagcggcggagaaaggtggtgcgcgtggctgtggcgcttcgaaggtggagaggggaaatggagcggtggacggggtgcgcacggcggctgcggtgccggggagggcgacggcgcagtgcggggtgaacgggagcggtggcgcggtgcggctggagttcgccggggagcggcggcgcgtggactccagggaggatgtggtttcgtgcacggggaagctcggggaggaggaggaaacggaagaggagagcacgagggtgctttatataaggctcggggatggagatcgtggctgggagaggcgggaacagccggcgaagtgtggcgccgacgtggggtggtggaggagttaaccggcgccgattttcacggggagagtgggggaaaaggtggaggaggtggtagggaaccgattttactcggtttgggagcgagggtgccagcgggaaggcgccggattcgacgggacgtgggcggcaaccgtcggccatggcggcttcggcctgggaagccggaggtaggaggagggcctgacaggtggggtcgccgggcccacctgtcggggagggagagagggaggagaacctagggggttatttacactttgcgcgaggggaaggggaaacgggccgacgacccaagagaggagaggggaggccggccgaggaagagagagaggggcgcgggccgcgggagagaaagggggattgggccgggagcagcccaaaagggagagaggaggtttttaatttgtttttcattttatttaattggttaaatgaactttgtgctattcaaattgtttctcgagctccgaaaattcgcgggaaatttcagagagtattttagggcacaaagaatattacaaaatattctcggctaatgatttttaaaggaaattttaaattccctcaataatgcactttattaaattgctttaacttttatttaatttctagaaaatacattatttaatgatttttaatcccgaacgaaaatcggggcgttacaaatctacccctccttacaggaatctcgtcccgagattctgggatggctagaaagaaggctggttgcggggtggtctgactgatctgacaaatctgcacactgcactgttccttcctgttacaaactgactgatatcattggattggaccctggaattctgacaccccacaagaccgattaactaaccaaacctgtatgagtgatctggctagattcagttctacggtcctgttgcttcccaaaactgaattgattggttctacttgaactgacgcagactaggactacggatactcacaaaacttacttatcttgggctgaactgtcaatactagcaatttgataacctgacaactcaccaagctggctggaagagggtgaaacttgcatctggcatttgtaactcattgaccctatgtccgcttgaactggtcctgactcgaacggcaagtaattccaggaaaacctgcctgacctgtctttcgtctgaactgcaactctccttgatgtttcttctctaagctgaactattgacctggcctcacgagtgtaccttagaattgaacctatcgagttgagattggggtaactctgctagcaccttgcaacttgctccttcaagtacttcccaaattgttgcactaggttgaaccttcaagggaaacggcgacgaggcgagccaaaactcatctctgcgacctaccccccttacagagagtagtcatacttttgcctaactgggaacctttgaactgttgtccgtaaaaaaaaacaccaacacttctcgaatttacagagagccctgactttgaaaactgaaaacttcgtcgatctatcaaaatggagcaatgacgaggcactttcatcccggcaagacttggaacttaacccttagctgatgataggaaattccacataaaagtgactctcacttagctcatgaacataatgacccttgactaactttccaatcagttctaactgctggtaagactatcctgcttctagcgtggttctagtaacacatgcctgaatggatggtgtagttgacattctttgaaacataccctgatcacttaacagatcaaacttgaaaggtccttctcatggtatgacatcatacttaggttatcctttgctgactcttcctggattgatgaactgttggccctgcagctatgttcccagaaatactgcaatctgaacgactgccggaaactgactttgatgttgccgatagtttctgctctttgatcataaccacttcgctttcatatcttcggtaaagatgatccgttgaaaagggattctcggccatataccctactgactacacatttctggacttgactctgtatacttctaacccatgtatggaacaatttctttttcaacttctgagaaacattgaaatgattcctggaacttatactggttgccttgaactaaggaaatacatactgaattcatgctcgcaccactagggtgtaactgtcgcttaccattccctaacggtttccaaggctagagagttcccaagattctttatataatgtcactttcaaatattccatccctcttttcatttgagtaccactgatactgcctttaaagagatctcatcacgtcaagtgttgagtgtctaaccattttcactccgtttgttaaccattcctctattggctagcaaacaggttttggagctcaacaaaattgcgatgagttagaagagaaactcttagtttcttgtggcactgacagatacacatattaaattgcttctgcatgctcaagatgaaccataaaaggagaggaactggctgactcatattttattcaacatttctttttcattacatggctgccataaacatatatataccaggagaagtactacaaaattaaacattggtagactgatgctgattagaactgcccttttcacgactgaacttgaaaagtagaagtcttgtctagaactgctattgcttccattattcaaacctgactgacttgtttctttagttcctactaacagaagttgcatcggaaacattgctctgggcattgatcttcgaagagggaatggcaatcctcttgacagctgtagcaggtggggtcttcttgctcatgagattaccaagtggtgatttgccgatgggcctccggattggagcaatacgaggtgcattgctaggattgtcagttgccggatgacttggtgctgccgatacttgctgcgggtactgacaaaggagcgttctgcctttttgtagctgtagcaagctgttgttctcctggcattgctcaccctgctggcgttggtgttgtaggcttgaaacgattgccggtgaacaatgcggcctttgacggtgcccttgacaactatccgttgaggcggaggttgcaccttcagctgtcgtttggtgttgaggatagtgctggtgacttgtgagcaatgacgaactgcctttgttgctcttggaaaaggacaatcactgaaacaatgtcctggcttacgacaattgagacaaaaccgacttgcttggtcctgaggtgcaggcttctagttatgcacattgacagctgaaactggaacaagtagtgacttatgaacatccttggtgacgttgcttcttccatggttggtttccactggagctggagttggaggaagagcagaagggttgtgactgttgttgtcgactgccattggttgacgaatgggttgcacggttgtcccttgttctttcttggtcttagctatgaccgcgttcaactgacagtccttaggcacatgatctgttccttcacacaagaaacatgtgaccttcctcaaagggcatgcatctgagtaatgggtgtattcaccacaacggcatgtggggaggcataaactagcagtgtgtccgactatcccacatctagtacatgctttgaactccaatcctctttccatgaaactgttaagggtcgcatcatcatcgtcatcatcatcatcatcatcatcatcgtcgtcgtcagcagagaaccgctctcctgattcatcatcttcgggtctgggcggaccgtactttatgagatgccgggttagctgacgcgctcctcggaaggtatttcttcctctctgacgcttgggtatccttgctacatcttcaggagtaaattctgaactggtgatgaacatggtcctgccattatccatcttccattttactgtcctgttcgctccagagttgggctgcaaagtaccatccttctagtcggtagactgacttggagcttggttacttcctgggcactacttcttgtatttttcaggtgacctggcgaacatcttccatggacagttccttacataatgaccttgctcaccacagtcataacaggtagcacttattttcctttggtccgacggtgagttggctgaagttatcttcggggatctggacaacattttgacaggggtcttaggtgccgatattgggaactcctgactctgactctgattcaggttccgggttggcacctggacttgcatttgtggctggtggccttgacgcggctcctgacattgccgttgcatctgctgcatctggtatatctggtaccgacgtcgcatctgtcgcaacaattcttccactgtctgagtctgattagccatgactttggattgaggctgatcttcgaaaggttgacatgggaagctcatagagttgtgctgagttgatccatgaaactgttgagatcctgatccgatgaaattgtccctcatgctgaccaattgctgcgggcacaagagagagagggggagatgagaggggttactagagatgaggtactagaccacttgcctactgatctgttgtgagtagacttttattgttcaagttgcttaagcaaacaacctagtatggtcgcatccccaccaatgatgcaaaccatgcccctacacacaagcaaacaacacacgatctagaagctaatgaaactactcttccgggaaggattgggtttagggtaaattccgggaaaacttcacttgaccttcgcggaacgacgactctgaactgatcttctcgctcctttctgcacgaagcttgaggcttgacttccgaacaggcatgaagctgacggcttgtcctccaggttttacaactaacagaattggagggacagggaggagaattttgtaaaaaccgtttcacaaagaaatgctgaagggcaggaggagacattttgcaaatagggttttcggaaaacttgtccttagggtttgaccatttggctcacaccctgaagttcttctcccaagcctaaattgaatttataaatggtctccagaaaataccggtgcaaaagcaagagagaaaccctaaaggaattaatgcaaataataatcggaactggcatgtgggatttttcctgagttctacatgtcaaaatacgctaacaagatttttagtggaattttcagagctctagaaataattttaaccaattaaaaatgagcacaagcaatatttatttccctggaaattcttttccttctttttctttctttttccctcgttttcttttcggaatgggccgccggcccattctctcctctctccccttcccgctgggccggcctaaggctgaggcccagctgagccggccgcctccctcctctatcccgaggtcgccgacaggtggagcccacctgtcgggtcctcccctaacctccagccgacgccgccgcgccctgcaaccgccgccgcgcccttgctcccgcgtcttccgggccacgtcggccgcgcctgcgcgtgcgcccgcgtctcccgcgcccactccctctctctcctgcccgcactcgcgctcgagacggtcgggatttgattttcgaatcccgcctctctctcctctcccactccctccacgttggccagcgattcccgcttctcccggccacgtccggaccgctcctcccctatttaagcaccaccgccatcccctttctctttttccccatttcgctgagtcctcccatgctctctatcaccctagcgccgtcgccctcctctccgccgccgccgccgctgctctggtcgccactagccgccgcgccgagccgtgccatcgacgccgtcgcatttgccgttgtgcgggccatcctgtccacccctccatcggaatccgccgccggaatccactcctcgccgtgcgccggtgtgcaccgccatggccgccgtcttcggtcggcgctctcgctctctcgcgttttcctctctccctctaacccctctcttcttgctcgctaggtggttccacagaccgtccgccgttcactgtcatctcccggtcgtttctcatcgccattcgccgtcgccccgtgctgggcgaaccacggtgagcatctccccgtcgtctttcccctctccctcttagcgccgctgccttgccgttcggagttgcgccgccgtcgctcgccgtgcgccgccgctcgtcgtcggtagccgccgctccccgccgtcggccgctcgccgccttgcgtcgccgtcgcgtcgcgccgtgccgccgcgcgccacggccgccgggtcggcttgaaccgcccgtgcgcgccggctgcgtgccgcctcctccgccgtccgatccactcgggtggatcggggctgtccgttcgtccgcccgcgtggctgccgcgtggccgccgagtcggcaccacgtggtgcgccgcccctttcccggtccgtggacccgatccaccatggaccagcacccgcagccactgccatgtggggcccgcatgtcggcgccgcccctctctctcccagggtttatttattgcgcaataaatcagttaaggatttttttgtttatagtaaaaacactgtgaatcttctaaaattcatatctaattcatccgagctccgtttaagcccattcaagtcttagtaaatcaagaaaaatgcgtagaatccattaaaaatggttttgttctctgtttcagtagtcatatagtctgtttgtattgtttactttgtatgtcgcttagattccggctctcccgacgctccggtatactttgagatagtcgccgaggtttccccagcagcagagcaaggcaagtcatgcttgtcacttgaacatgttgatcctatattgcaaatgttctattgttttccttcaaatattgctttgttttacaatgataccatgggatgtttacctactgttatagccatgctatttttaccatgctcctttgttagcttgggatataacatgactagatattgggctagggattgcttagccatgcttagttcaactagcacacaatgggggcaatcacattaatgtttggacttcaggttctagtgttgatgttggtttggtgccaccgctccggtgttggtaaattaaaattaactaaatggtgggctgtgggtgcatggttttgttggtcgcgcccatgacacttaaggaccggttcgcgggaaaccctggaagaatacctcgtacttaccacaagccagcgtgggcaactggttggcttgtagtgtagctttcctctagctgacgcatccaggcaagggtgagcgtgatggagtttggatgggccctgcgacggcctatgtggcttttggattcacctaggcacgagaggggactgcccgctgccttgcaaggagtgggggtaaaacctgaggtgtagtgtgcttggttagagggggttatgcaaagggtcctgtcacggtctctatccggtatgtcgtggtggcatgtcggcgcatggaaacgtgtcgtggggctgtgtcttgtgggtacagttgtacacctctgatcagagtaaaactattcgaatagtcgtgctcgcggttatgggcggtcaaccagattcaccgtgattagattcaccctagcctagtctaatggaattgaatagtctaggtggatggttgggcctgttgcaacgtggtgtagcgttggacagtggatggttaatattgattaattattacaactgttttacagctttcaactactgttataaacgctcgctttatgcaaatgaaccaccctagctatcctttgattataccctgcatcataccccctattccggtatgacttgctgagtacagtgggtagtactcagtcttgatttattttccccaaaaccccagagtttgagtgcgtgtcagatggtggtttttccgaggagtaggcttcgtccatgccgtcgaagatgcctgtggagtggtgttcccactgcagtccaagtcaaggcttagctccagttatctattttaattttccgctgcatttatgtaagacttttataatgtttgtaagacgtggatctgtatgtcaactttgtcgtttgtgtaccccggctggtcctggacggggattttaatgcacattctgcttggaattctattcgggaatttctgggcgtgacaagtatggtcttgcacatcggacccaaaatgacgcgacctttgccaacaggtaaattggtatgtatccgcatatttatttccatcaatttgaatttttgcatcaatgcatatttgaatttcaaaatttgcatctagaattgaattttgaggaaagtacttcaaatgaattttccagagcaagccaaaataaaattttcaacgaaaattcgctgtgccacgaccacactgaccgttggaatcctacggccgaatgtggggccgattgaaccggccaggcaatggtcacatgccatttttggcagggtaacggctaatggggcccacaagtcggttttgattgttgtggctactctatataagccaatcggccgggagagagaactccaccccatttcaactcattttcattccttgtacaagctttgctctcaaaattcattcaagctttgctagtttgcctcaaattcaagcatttagttgcatacacaaaagttgcttggtggagctaaccggcgggtgaaactcttgttaatctaacgcctgccgggttagtccattcttgttcctttgtgcaaaatgaggaggcgactatttgtctgttcaagaagggacccggctctccatcaagtcgtcatgacgagtctagcgcttgtttatccgccgacgtctcgatggaggatgctgatgttccgcaacgtctcttgagcgacgccaacctcgaacttgtcagtgattttgaaagacaagcctacttaatgccgaaagaccgggattatgctcacacgcaggtatataattcggagctactgaaaaaaataggtatggatactgactttcgtgctatttggaaagctgttggatggcagagatttgctgtggtagatgagcctgctcctcatttgcttactttgcaatttttgtgcactttgaaagaaatagaatatggaatttcctttcactatttccataatgaatatacactttcatggaaaggattaaatatacttcttggttttcacgattcctgtaaaatcgatcttcggaaaagaatttctgcgttgtagaaaaacagattttgggaagacatttctggtgctccaatttgcaagaaacctaggatgaatgatatccataatcctacacttaggcttatgcacaaatggattgctatgactttgttttctagaggtgatcttagacctactagagaggatggattgattatcatgtttgccatggttaggaagattaaaattgctcctgtgaaatgtatgataaggcaatggttagagagtataagatttactgctcctgttgagtacacttccttgattactcgcatagcaaagggactaggggttattaccaatgaccaaattgcttatatttcaaccgcttgtccctgtgttgatgagagttatctagtgcaagggcatattcttaaacatggagtagatggatctttgatataccatttccccggttctacaaatgaaatcccgttgcctaacgcgggataacatttgtaccgctttcatgaactaatctttcccctgcagaccatagaagaatctcgtgtaggtggaacatacagggagacacgcaactgttagtgatatgccctagaggcaatcatagagatgattgtatcacatactatgtttacatatttatccgacactgttccttgaaatagataactccttattggttaatgaatatgtgattctttcatgagactctttatgttgtttgttactatttctaaaggatccctgatcaaatatcatatatggaacaaatatgtttatatgatcagcacatgtattaattgatgatcatgtctcatggatcatggtatagagataccaaattaataatgtggatacatgttggtgaacatgttgttggatagatccaacatgagacactgtaagagccatatgtgttgtgtcatcagtgatctcattgagtgttggtgttgaatccttagacctgagattatgatggttctcaacatgtgtagtagcttacttagggactgctaaacgctactccgtaattgggtagttataaaagtagtttttgggtatgctatgaaacacgtagtgggatatgaataatcaagatgggatttgcccctcctatggagagatatctctgggcccctcgatgttgtagattatggaagtgcatggccatgccaaaggtgattgaggagtcaatcacaagttatataatctatcaacaggttcgagtgaatgattgagctattagaggatggcacatatctagccttgagcttaatcgatatcgtgaggcaaaggggttcatgcaagtatacactagaggttcagccgatatgatctttatgtatgcccggtgggtcaatacgttctgctaggggccgctgttgacgcgtggatcgaaaagaagttttcgggttatagccgagtatatatgaacctacagggtcgcacggttaatgggccggaataaggggattagataaagatccaatatgagcttaattcgaatagggatccgaataggagtcctaccggccttggaggcccgagtgatggatcctatatattcgtgaggggtgtgactggcggaggcattgcatcacgtgagaaacccaagccgttacttccctccccgagcaaaaccctagtcgcgcgcgggtgctagcacatctgtggtggcgttccgtccctgtacgtgtggataccggtagtggcgccgctagtttgcggtgctgattggcgtgggagtacggcgaggagaacgcacgaggaggagaaggtcgagccggtgcgatcgactacttcctctacatcgacgcgcgctacttcgcgagagttccttcgacttctcagcatcttcttccactgcacagcgcgttgagtggtaatgatctatgatctaatacttgcatggttcccggtttacgcgatagaaatttttgatttatgctatcgtagcctacgcgtatcccaacagcaacatggcaaggaatgaacgagaaggttcaacatcctcaacacccgtacagatgtatgaggctggttgggagccaactagggatgcgcccagatggacctaagctccatgccatagcattggagtctcgagccagtgagagccgatggcgggcgcctcatgacatacagtagggaggctggaacaatcagtcccctagatcaagtggtatgcctccatctcccggtgaatggcactaaagttcctctcattgggacttgagtgaaatcactaggagaatggatactcttgatatgcagatgggagagatcaaacacaaccttgaggaacacatagcacggacgcaagaatggcaacagagggctgatccgatgtccactggaactgcacgccaatgagaaaaacgagccaatgagattgactcggtttcggcataatttgattacgccgttaaggttttcacatggcgaattgtagatgagatctagcgggaccgccgtgtgcgttgccccttagatttcgcttggggttttttatatctatcttactttattgttgttgtatatttgatatgacatggtacgatagattcccatagaaaaattaagtgtaatttatgctcttccaataattgcacctattacggttgtgatcataagtgatgggtttgccatagcaaagtgtcactttttatcatgataaaataggatagatgtcagacatctatatgcggagacaaggttatcaaaacagttttggaccttggggcataggttgggttggacatggagatgtcaccccaacagcacaagagtcacatatgatgtgattagcaaggtgttgcttacctattttgatagttgtctagctgtgatgccaaagctcactagacactaataaaatgaggatcttgactcactatgttactagagggaattttgtttcacaatacatagtgggagtatcttttgttaaattgtttaatgaaaggttaaatgtaaacatggtgctgattttacatatatttctattgtagatcatggcagctcctgcaccatccaattttaacttgcggtctattcttgagaaagagaagttgactggaacaaactttatggattggtattgcaacctgagaattgttcttagacaagagcacaaagagtttgtgcttacacagccttttccagctgacttgcccaacaatgctccggctgctcaacgtagggagcatgaaaggcgatgcaatgaataccttgatataagctgtctcatgcttgctactatgtcccctgagcttcaaaggcaatatgaggcattggatgctcatacgataatcacgtgttaacaaccaaattaggtaatatcagcgttgggagagaagattagatcgaagaaaagtcagaagcggagatcgagtttgaaaacagagcaggaatcggctggaatccaaatcggctacgataagatcggctgggtctgagtcgggctaggtaagccgatgtagcagatcccgacaatatgacttgtacgcgacatcgggttcaagttaatgtacttcaagatgattgccacgcacggatagagtcctgggaaggaaattgtatctattaattaggatatcttatgtaaattccttatagataaatgtgggcaaaagtctgccgcaaagacttatggtatcttagagtttgttagagataatagtcgtgtctggtatgggcatatcttgtaattctcgggtataaatagaccccgagccctatgtaattaacaacacacacgttcaatacaatttcggcgcatcgctacccttttttttagttttgtttcgatgagttcttgctttcgggttgagctgcatcggttttgatcttcaacaagaggtaaaacgtgttatgacgacttgcgttcccaggattagtgcttccatctttatgatactctaatctcatttatgtaattcgtcaagttatcgtatatcttacataatctctagcaatatcgccacctaatctattatcggctaacatatgtatacaaaaagcatccgattaggttagatcttgatgttgatctagattatatgagatatctaccattctatgaaacttctagcggcttgattgtctagatatcgttcttcttttcatacttaatgctgtatcagttgagtttgacctattaagtcgtgcttagaatatcaatctctagcctgccttctagttgcagctgatcgtatctgctttaactatatttgttctatatgcttcattgacatgttaaatctgccctttatatcaagatattgctgtgtctgagtatattaggctcttgttcgataaattattcttgctttaatatcctgatatagagtagtatcggagtattagccgatacatgctagatctatctgatcggctacgctataaacatatatagtcctgttattgatatatatttcgatctaagtgatttatactatctcggcatgatgaccgatctatcccaatcacttgattttaagtatacatcgatataaagagtatatatcgttaatatctacagccgatcgagtagatttagttcttctttacttattcatgactgccgatcgatacacagatgacatcggctcaaagataaatgatatgtcatcggcatctagccaatcggctatcatttatagatttaaccacggtttctttgcttccatttcttgttgattacaggatcaaatcagctggcacgctaacacatccgaaggcgagctttggacctgcattggagttaagcagatctcccaggccacgtgttttctgtcaacacgcttttggcaggcccggtgggacctataagaagtcagacgacagttcttcctcatggccgaaaaacaaccacaaccaccatccaccccaggctctgttaagaaaaagatgttgaagttaggattgactgacgtcaatgaagaaaacgtcatgccaatcgaccccgagaaattcacgcccgagcagaagaaaaaatttgaagcaatgttgcagcaagcacgggatctgttcttaaactcatttatacagacccgcaaggagacacttgttcagaaatacaaaataaaggtgattgctgatgatcctaggaccagctctctttgggatggagatgggaaacaagctccaggcggctcggctcagccgagtactaaaggtgctaccgacggctccccaagcgatcaaggcgacaattctcaaggagttcatggcgtccaaggtgatggtgctcaggagccacaaggaggaaatcttaaccagaatagtgaactagcacaagattttttcaataacttccaagatcgggttgattacgctgtgcatcatgctttgatcaatcagtccggggtattagtcaatacattgtccaccatgatgaagacaatagccgatggttcgatagttgagcatcaggctgcaggcccaatttacttgcaaggaggtgtcttcccaaattatctatctttgatcaccgatgctcagccatctgttcaagcagttccctctgttgcacccacgactcagccgacggcgccagcgtcgactcctttgcctgctacactagctatgtcaccaggacaaccggtgaaccctcggttgttaacaagggaacaaccacaacatggcgggcaggctacgaatcagctaacctaagaccaagttactgccatgtttctgccacctccacctattgttgatccagtacagcagcagccgattcagcaggcacccccaatccagccgtttatacaaccaacccaacagcaggtagtacaacaggctcagcaaacaccaccaaggcagcagcccctgtagccgatccaacagactccgttgaggcagcagatcgttcagccgattcagcatccggggttagtaaatacatcggccgggttcgcagtacctggtggccgatgtctaagatgatggtcaatggtggggccgcggtaaaaatttgatgccttatgctacgttcaggaagttgggtaggagcgccgaggatctcatcaagacaaatatggtgctcaaagactttggtggtaatccatcggaaaccaaaggtgttctaaatgtggagctgacagtcggcagtaagtcctaccacgttttttgtcatcgatgggaagggttcgtacagcttgttgcttggaagggattggattcacgccaattgttgcattccttcgactatgcatcaatgcttgattcaatggcaaggcgacaagatagagatcgtgccagctgacaggtcagttaatgttgccagtgccgatttagccctttgggagatggatggccttgattgtttatctggaaaagtctgggatggagattttctaaaagtatctgattctgatatacagccaatcgaggatggagaaaccaagctgttactttgagggcgtcgtggagggttcaaatgtctacgccaaggatacggatgacaagcaaggtcaaggtttcatgtcggccgatgagttggaagaaatagacgtaggtccaggtgatcggcaaaggccgacatttattagcaagaatttgtctccagagtttagaaccaagctgatagagctcttaaaagagtttagagattgcttcgcttgggagtattatgagatgcctggactcagccgatcgattgttgaacattggctacctatcaagccaggggttagaccatgctagcaacctccgaggagatgtaaagccgatatgcttgaacctgttaaagctgagatcaaacggttgtatgatgccggttttattcgtccctgccaatatgctgaatgggtttctagcatagttccagttattaaaaagaatggcaaggtcagggtgtgcattgattttcgagatctgaataaagctataccaaaggacgaatatccaatgccagtgaccgatcagctggttgatgccgcgtcagggaacaaaattttgagttttatggatgggaacgcaggatataatcagatctttatggctgaggaagatatccataagacggcttttagatgccctggtgcaatcggcttatgtgaatgggtcgtcatgacttttggcttgaagagtgccggagcaacatatcaaagggccatgaattatatatatcatgatttaatcggctggctggttgaagtttatattgatgatgtggttgtcaaatctaaagaagtggaggatcacatatccgatttaaggaaagttttcgagagaaccaggaaatatggcttgaagatgaatccaacaaaatgtgcttttggtgtgtcggccggccagttttttggatttcttgttcatgaaagggggatcgaggtaacccaaaggagcgttaatgcgatcaagaagattcagcctccggaaaataagatagagctacaagagatgatcggcaagataaattttgttagaaggtttatttctaatttgtctggaaggttggaaccttttacacccttattgaggttgaaagccgatcagcaatttacttggggggcagagcagcaaaaggctttggataatattaaagagtatctcagctctcgtcctgttttgattcctccacagaaaggaataccgtttaggttatatttatcggctggtgagaagtcaatcggctcggttttgattcaagaaattaagatataaggtgttaaagtatacactgttggataatgagctttattatcggacgattgatggagtattgcttaagtgcttgaatgccgatcaggctaggttgcaatcggcgaagttcatgagggaatctgtggtactcatcaatcagctcataagatgaagtggttgcttcggcgtgcagggtacttttggccgacaatgctggaggattgtttaagatattataagggatgtcaagattgtcagaagtttggagcaattcagcaagtgccggcgtcggctatgaatcctattattaagctttggtcattcagaggttgtggaattgatatgatcggtatgataaacccaccatcgagtaaaggacataaatttatattggtggcaactgattacttcaccaagtgggtagaggcgattcctttaaagaaagttgattctgaggatgctattcaatttgttcaagagcatataatctaccgatttggtcttcctcaaactattactaccgatcagggttcaatcttcgtgtccgatgagtttgttcagtttgctgatagcgtgggtatcaaattgttgaattcttcaccttattatgcacaagctaatgggcaagccgaggcgtctaataaaagtttgataaaattgattaagctgaaaatttctgattatcctcggcaatggcatactcggttggccgaagcgttgtggtcttataggatggcttgttatggatcaattcatgttcctccttacaaacttgtttatgggcatgaggctgttttgccatgggaggttagaatcggctctcgacggacggagttacaaaatgatttaatagccgatgagtattacaaccttatggccgatgagagggaggatctggctcagtcgcgattacgagtctttgcaaaggttatgtgttcatggtgtaatcggttgtggtttgccgatgtacaatggccgatattgttatatcgcccttagttgttttataattttatcaatgctcttgacattgtaaaactaggggggcacatatatatcaaaatgcagtgcaaaatttcaaagtcaaaattttttgagcaaacttcaaagtcatattaatcggcacaaaggattgttaaggcagtaaagtatcagaatgtcttagccaattacaaaagtttctaagtcctattacacaagggttattgagataagtatcgctggatagccgatatagccttctgcctaatctgttctacttcctctatggcttgggaatcttgagcatcggttctagggataactttcagagacttggtcagatcagcaacatgcttgatagccgatttgagtcttgatttctgttcttcaatagactttgggagatcggctaactttttgtgctccatatccagctcggcattgcattcttcgagttgtgctaagaggtcaatcttgcgagccttgagccgatcgatgttagacttgattgggcctttagaaagttgatcaagcttggacttctcttcatgcacaagttgtcgattagcttggatagtagcttcaatgtccttgcgctctcgcagttcggccagtcttaacttggctttctctagtttgaattgatgttgctcaaggtaaacggctagggtaaggatatcggctaactcatctgggattagagcctgaatctcatgtagccaagctctgattgagccacaatcaactaccaagctatctagtgatgatgcttctagctgatccaagatacttcctagagttttcttcacatcatcagataaaggggctaaagctttgcttgtggtatcttcttctccttcatcaaggtagtctccaatgtcgaaagagaaaagatcggctaagacctgcagcaatgatttagaagcagttagaggttaaacaggcatagccgatctgaatgcttgttgagacaaagaaaaacttactgggatagcaggagcagctggtggttctttctgctcaacgtgatgactccccacagctgaaggagtctggtcacttgatgattgctgtacaggaggagaaggaggagggggaggctgaaaacaaacaagtgttagacaaaatcggttgaaaattaactaatgagagttaaaactatcttaccggtggggatggcttagatgttgttacagccgatttcttcttcaccgcggtcttctttttctgcaattataagacctgggagtgaccggctataagacaaaatagttatgaaaggaattaaagtaagttgcttactcttgaaaagtggactggagcagaaggagttggaggggtttgcttgggcgaagccgatggtgttttttcagtatcgcttacttcggctgcagcctgatcaatttcgtcttcgattatctcttcatccagcacttgttcaatggatgggtctagggtaggcaggtcatcggctggtttggttttctttgtcttcttcttcttacttggggctgcgatgtttacagccgacgacctggttttcctctttttaccggcatcggctggttctctgataagcccttgaagaagagctgaggtcttgggggcatcatagccaataaccggaggagttagcccatctccgttagggattaaacctggagcatattggatatccttaccactgttgctttgacggggaggagaggattctattgtctgcaaatcaaaaggaggattagttgagattaatcggccaaacagctatttaaatctagtggagttaaagacttacttgagggacaacatctgggaagaggtctgtcatatacattgaagctggttggtggaatagatgcagcttccattcaccccaccatctgtcaaagtttttgcttctgaacattgccagttctatgttgtcaatactgcccagagggggtccttgaaggttgagtagcctccatcatcaaggtcgatgaaatttctcctcagcattggatcttgtcggcaaagaataaaccgattgggagttggcccattccaagttgtctagctgagctcattggatgatagaattcataagaagcttggatgtttcttccttgatgaatgccaatgggaaggatgcatgggctgattgcagctgagaaaatttccctggatgattggtatacttcatggttgatgtcttcgaatctgaagtccaatgggtgttcaagttctgcagaatcttcataaagaaaccaaactcgagcatctttttgaaagccttcatagaagctgcagaaccaatctttgagcagttcagccgatagttttgccccagcattagttggcatagaagcgtattctccgtatgatgtgcatctccgatgagtacgctcttctccatcatctcctacaatcggctctagccttgggaattcagcttctgatacggatggccgattgacaaccttcataactatcaggtttaaccaggtttgtagcagccaccagagtccacttgctccaactactgagctgatggctatcttagccgatgcattgttcaacatttggtatagatagccgaggaggattttgcccaagggaaattgtctctttgtttctagagcttcagctagaaattgccagttggttgtggggccgcaacttgatccacagaaaagaaatttttctagccacattaacaaaaaggccacatgttcccgaggggtgaccgagccctgacccatatatgccgctacatagcctgaccaacctcctatgcttttggtcttgaagtcatattggttctttgtgttcaagctcatagggttggccgacgaggtgacatccagacccgtgatcatgatgatatctatgagagttggggtcatcggcccttgattgaacaaaaaggcattaatggtgtttgaccagaaataggaagcagctgccatcaggggttcatctttggccgagtttgctataataaggtcaagtgcttggccgattccaatttcatcccagtaaaccctcttgctggctgatacacgtttgaaccatgtagtccaactcttttctggtggaactttctctagagacggccaggacttgaaagtattcttccagtgacctagatctggattggttaatctaaaggggatcctgttggtttcaccaatgatgaactcggtggggtcaggattgccgactgggccgagaaagtagtggttttcatgcgataggctgggaatcgcaactaggttggagtggtgctacaaatccaaagcgatccagaggaagagagcaatttgagatgtgagaaattcgatctgctgctaaagaaggggagttagccgatgagaacttacctcggcatattcggctgatggcgcaccagatgggctggcggaagacgacattgctacgggcggaaatctcgtcgaaggggaagtcgcctggaaatcgcctttgcgccggaggagtcgccggaggagagagagaagaggtttcgcttgagctgtgaaaacggaggtcacggtgtgagattctcgagggtaacggttagtatttaaagcgctggaataacggtcaaaagcggcggggtgcgaaatctactcgaagtcggtacacggcaaatccggaatattatgaaatatcccggacttgggggggcatgtgttaacaaccaaatttggtaatatcagcgtgggagagaagattagatcgaagcaaagtcggaagcggagatcaagtttgaaaatagagcaggaatcggttggaatccagattgtccacgataagatcggctgggtctgagttgggctaggtaagccgatgtagccaatcccgacaatatgacttgtacgcgacattgggttcaagttaacgtacttcaagatgattgccacgcacggatagagtcctgggaaggcaattgtatctattaattaggatatcttatgtaaattctttatagataaatgtgggcaaaagtctgccacaaagacttatggtatcttagagtttgttagagatcatagtcgtgtctgatatgggcatatcttgtaattctcgggtatacatagaccccgagccctatgtaattaacaacacacacgttcaatacaatttcggcgcatcgccacccttttgttttagttttgtttcgacgagttcttgctttcgggttgagctgcatcggtttcgatcttcaacaagaggtaaaacttgttatgacgacttgcgttcccaggattagtgcttccatctttatgatactctaatctcgtttatgtaattcgtcaagttatcatatatcttacataatctctagcaatatcgcgacctaatctattatcggctaacatctgtatacagaaagcagccgattaggttagatcttgatgttgatctagattatatgagatatctaccattctatgaaacttctagcggcttgattgtctagatatcgttcttctttttatacttaatgctgtatcagttgagtttgacctatttagtagtgcttagaatatcaatctctagcctgccttctagttgccgattagaatagcatcggagttgcagccgatcgtatctgatttaactatatttgttctatatgcttcattgacatgttaaatcttccctttatatcaagatattgctgtgtctgagtatattagactcttgttcgataaattattcttgctttaatatcctgatatagagtagtatcggagtattagtcgatacatgctagatctatctgat

SEQ ID NO: 15766 - DNA, 3552 bp, Oryza sativa
ggcacgctaacacatccgaaggcgagctttgggcctgcactggagttaagcagatctctcaggccacgtgttttctgtcaacatcacgggactacgtaacatgtttgaggaccaagcaagagctgagaggtttaatacctcaaagtccttgtttgcgtgcaggcttgcagaaggtaatccagtgagcccacatgagatcaaaatgattggttacaccgagagtctggataagcttggctttccccttagccgagagttggctactgatttgattctccagtcgctccctcctagctttgagccgttcataatgaatttcaacatgaacaacctgaacagaaccttggctgaagtgcatgggatgctaaagactgccgaggaaagcattaagaaaaactccaaccatgtgatggttatgcataagcgcaaacccaacaacaagaagagtggtcaaaagagaaagctaaactctgatgagatcacgagtactagcacgcacaaagatggcttacctcccaggttcacacagatccaccatcgccctggtctaaaacattttccactagatcattactacacaatgcaacacatgccaccaagaagatagcacacagccacacagtttatataaaaaaacagtgataagtagatcattagtcaatattatatttttctttgtaaaagtgtgagcagggctaagcaaatcaactgccctgagccaataccccatgtttgactctcatacaatctaggtgacaaataatcaaggataatcaacaataattcaaggcatggaataattaacaagtaggtcataactacccacacgataatttatgaaacaaatcatgcatataatttaaaacaagataattttgcaagttaggatcaacatgttcaagggtacacttgcctttacccatgggatcttcggactgaaccttcacctgcaacagcaacatcctcggcaacggcgtctacacgatcgcaaaaaggagaaaataaataaaaaaagaaaaggcagaaaaataacaacaaatgaaataaccaattaaatcaggaggtaaagctcaattttagaagaatttaggaaaaagaatgggccatatcggagtttggatggaagagatgtgaccttcggaagattgaattattcggaaaccgtgaataaagaaagagaaatatttataaaatattctctgaagttaaggaaacaaaggaattatttttggtggactgacgggcgtggtccacctgtcattgggatgatcaacggttaattggttacaaggatcagagttgtggactgattatatggaggctgagatttatttgtgaaaatcgatgacttggattggtattgggttttagtggaccggcttgtcctggacgtgtgtgacatgatgcctcgcagcgtggacgtcaacggcatggtgatggcaaaactccggattgaagtgggtgaaagaagcaagagcataccgggagaagatgatggcaggctcatgaaagagagcggtgatgctgattagtgaagatatgattgacaaaagattgaattggaagaatggaaaataagaaatattttccggcatttgtggattttattagaatcattttcgtggctaaaggatggggttcactgattgatgggagtgagatagcgaacatgccatgccagtctccgagacaatgacagaggtgacggtgtgacgtggttgccgacctaaggcagcgagaggacagcagctgtgttggccctctggagtggacgatatgatgacgacgacatggtcactggtagttcggtagcaatgggagcatagaaacaatgcgacggcatctcagcatctgggaataaaaattaaaggggtaccggtgctgggatgaagaagagacaccaggttcatggtataggatgacgacgttggacgtaggaggggaggaatattgtagagacagcactggggaagtagaggggcgaaaacggaggcgatgcttatgcaacaactattgcttgagctcgaggttgttatgaacgccaggaacaagccacgagagaagatagagcagagcagggtgtatgcactgattgtgctcctgctggcatggactactccggtgaagaaaacagtgatggcggtgcagtaatttcggaatggaaccgtgatgaccacaacagacatgtggtaggaacaccatatcgtttaacagtgaggcggtggcaccggcagacaatagcaacttgacgagagactgtgccggagacaggtgaagacgatggaagcggaggataagagcagcggtgctgctagggccttggagattaccgacctcagcgacattcataggaacgtgatggcgacaatgtggttcagctcgggttccattgcgacagcgaccatcgtggtgcgcaaacagatcagtgatgaccaacggccgcctttacgatcacaagagagaggtggcagcaataatggaagattgaattaatagaagatagaaaggaatattctctcgtgttttcaggttgattggaattattttgtgtaccaactggtatggttcatatgtcatctaaagagagagattaacagtggtgcacgcacatgcacgctgtgggcatggtggccgaggcaaagcagcagtacgacatcttttggacatgtgcgaatgaaaagaaaagaagataagggctctgttaaatacatataaaggaggaaggttgacaggggctgctttcgtgatggacgaaacaacatatagcgctatcaccgggtgataaaaatggaaggaaataatggaggaggaacatcaagagctcacctgtagatgtggtctcaacaagatgaagacatggtagcagcggcttaggttccaaggatggcgatgacttctttgcttgtaggtggcgttaatggtgacagaagttggtttggaaggggatgacgaaggagcagcgttggttcactgatgatggccagggccggccctgacgggggtcgagcagtgcggctgcactgggccccccaaacccaggggcccctcccaagatgccgaagagtaggcctactctgctgccgcgtatgatgatcaatccgtctagccctaacgattagcgacgtgctgatgccgacgttctcaattccctagccatccgcgagattagcagatcaatcttcttcttgtccctggcaggcgacggcaaaaagcaggcgtccacatgcggacagcctcgccgccggctgctccccgcgcgaaaacggcagccggcaacctcctctacggttccgctagcttcaaccgttacagcagttctgcacttctacacgcctactacctgtctgccgatggcgcctgcaggtgaggtgagttccctgctggattaattcagatgtgggaactgaaaatatcatgcgaaaaaatctattaagcctacaacttgtagtctgtaggtggactagacaggcctgcatgcagtgcagtctcatcctgctagctgttgcaagcacacgccggctagccgaagaattgtaattagtaagtgttgtt

SEQ ID NO: 15767 - DNA, 1028 bp, Oryza sativa
ttaatttccggatgttttatttttcaaaataaaaactatggagttcctcatttgatataaattcctaccagagccaaaaatattccatattgattaaaccatatatattttggttacttataattccattgaactttgtcaaattcttgtgacttgtgaacatacttctcatgatctatgatcaagatcatacatccacatatatgcacatgctaaactcctacactgcgagctagcaattatccattccatttccatactaccaccaaaaataaattcgccatgcttttatgcgctttcttctcctaaaaagaaaatcctttctgaaaaaaaagagagaaaagaaggaggaaaaggcggttatgaaaataaagttatgctctctcaagaatgagcatgatattgaaaaaaaaaaagagagagaataatgtagccatgccctctccttatttataaaagaaggattttaggagtaagcacaaaggagaagcgttttgatgcagcaacgggggttcccgatctttcgatgagaggaggataaacttcgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttttgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgaaacaaggcccaagcccaagtttctgatgtaaaaaactattttcgtcattctgagcagccttggtcaaagt

SEQ ID NO: 15768 - DNA, 50012 bp, Oryza sativa
  unsure (1)..(50012): unsure at all n locations
ctgttaattaagttcatgagctcgagctctagtcattggtccttgctgtgcaataggcgtggatgtatcgttggaaaggatgtcctcatcatcctccccttcttgcatttgagtcgtcctcgactctaactcatcttcttctcccaaatatggctttaaatctgcaatgttaaacgtggggctaaccccaaaatcggcaggtagctcaagcttgtatgcattgtcattaatcttttgtagcactttgaaaggaccatcagctctaggtagcaacttagattttctcaaattagggaacctatcctttctcaaatgcaaccaaaccaaatcaccaggttcaaaagcaacatgtttctttcctttgctcccagcaagtttatatttaatattcatgcgctctatgttctccttagtggtctcatgcagttttaacatcaattcagcgcgatattttgcatcaaagttcactctctctgaagttgggtggggcaaaagatcaattggagcacggggtagaaggccataaacaatctcaaaagggcacttcttagtagtagaatgttgtgaacgattataagcaaactcaacatgaggcaaacattcttcccacattttaatattctttttcaaaacagccctaagcattgtagataatgttctattcaccacctcagtttgtccatcagtttgggggtgacatgtagtagaaaataaaaatttagtccccaacttagcccacaaggttctccaaaaatgactaaggaattttgtatcgcgatcagaaactatggtgtttggcactccatgcaagcgaacaatctcacgaaagaacaaatcagcaacatgtgtagcatcatcactcttatgacaaggtatgaaatgcgccatcttagaaaatctatctacaacaacaaagatactgtccctccccttctttgttctaggcagccctaaaacaaagtccatagaaatatcctcccaaggcacactaggaacaggcaaaggcatatacaaaccatgagggttaaggcgtgacttagctttttggcatgttgtgcagcgagcaacgaacctctccacgtctctcctcatcttaggccaaaagaaatgatcagcaaggatatcctccgtcttcttcacaccaaagtgtcccatcagccctccaccatgcgcttcctgcaataatagcatacgcacggagctagctggaatgcataacttattagctctaaacacaaacccattggtgagaacgaatttgttccaagtccttccctccttgcaattcaacaacacatttttaaaatcatcatcgtgcgcatattgctcttttattgtttctaagccaaaaattttgaagtcaagttgggatagcattgcgtaacgtctagacaaagcatcagcaatgacattttcttttcccttcttatgtttgatgacatatggaaaagattcaataaattcaacccatttagcatgcctacggttaagttttgcttgacttcgaatgtgtttcaaagattcatgatcagagtgtataacaaattctttgggccataaataatgctgccatgtttccaatgttcgcactagagcaaacaattccttatcataagtagaataattcaaactaggcccactcaatttctcgctgaaatatgctacaggtttgccttcttgtaacaacacaccacccaatccaatcccactagcatcacattcatgctcaaaagttttgttgaaatcaggaagttggagtaaaggagcgtgtgttaacttatctttcaaagtgtcgaatgcattcctttgtgctgcagcccaagtgaatgtgacatttctcttggtaagctcatgtaatggggctgcaatggtgctaaaatccttcacaaagcggcggtagaacccagcaagtcctagaaagcttctcacttgtgtgatcgttgttggaaccggccagttatgtatggcttcaaccttggcttgatctacttcaattccctgcggagtcacaacatagctaagaaaagagactcgatctgtgcaaaatgtgcacttctcaaggttaccaaataaacgtgcatctcgtagagcatcaaaaacagcacgcaaatgaccatgatgatcctctattgatctgctatatatgagaatgtcatcaaaatataccaccacaaatctgccaatgaaagcacgtaaaacttcattcattaatctcatgaaagtactgggtgcattagtgagaccaaagggcatgactaaccactcatataggccgaatttagttttaaaagctgttttccattcatctcctaacttcatgcgaatctggtggtaaccactacgcaaatcaattttagagaacacaagtgaaccactcaattcatcaagcatatcatctagcctagggataggatgacgatatctgattgtgatgttgttaattgctctacaatccacacacatgcgccatgagccatctttcttaggaactaaaagcacggggacagaacaaggactaagagactcacgtacataccccttgtcgagtaactcttgcacttgacgctgaatctcctttgtttcctccgggttggtcctgtatggcgcacggtttggcagagaggccccaggaatgaggtcaatttggtgctcaatccctcgaattggtggcagccccggtggaacctcctttgggaaaatatcagcatactcctgcaaaaggttagtgaccggaggaggcaaagaaataggagtatcctcaattggaaataaggtttctttgcaaaccaaagcatagcaaacaacagtgtcagtgtcaacttcatccaaatctgattttgttgcaatgaaacaagatcccttcagcttaatctcatttttattattttgaacagagttggtgggtttcttcttatgcttctcaagttcattagccgcaataagatgctcactcctagtatgctcctgatttttttgtttgctagctctagcaagttcatcctttaaaataacttcaggagacataggatgtaacacaagtttttttccattatgcacaaaggagtattgattggatttgccaaagtgtaaagaatctttatcaaactgccatggcctacctaataacatagaacatgcttgcataggcacaacatcacagttgattgaatcatgataagaaccaatggcaaaatgtactcttaccaatcgtgttacctttaccttgccgctgctattaagccattgaatatagtagggctgtggatgtggctgtgtgctcaatgcaagtttctccaccatttcagcactagccaaattattgcagcttcctccatctatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccccaatgtgttcctcatcttggtggggcgcgtcaccttcccgtgcattgttagttgcaagcaaagcataggtttctccatctaaatcactagcggaggagtacccaccatcagctctcacgatcattacacgagtgcttgggcagtccttgcgcacgtgaccatagcccttgcagcgtaagcactgaatatctcttgtccttcctgatgaagctactgatgatgaggtcttggaaggtgtagcagcaacccctcttgttggttcactcgggcatggtgtagagtttgttgtagagggacgcagcttgttgcttgaggacgatggtgctgctgctcgagttgacggtgcagcagcgttagaagatgtccaagagctagcacgacctgcagaaatgttagtcctgaagctagctcttcgtccctgtacttccctttcagctttacaagcaagatgaaacaaatgattaattgaattatattctttgtaggttagaatgtcctgaatttctcggttcagcccacccatgaatctagccataccagcatcatcattttctaccaatccacaacgaagcattcctgtttgcaaagcttgataatactcctctacagatttgtttccctgtctaagttgttgcaatttgtgcagcaaatcacgtgcatgatatgaaggaacaaatctagctcgcatgactcttttcattgcatcccaggtttggggagtgttatttggattggaacgaacaaattcactccaccaaatggatgcaaaatcagtgaactcactagtagcagccctaacacatttattctcaggaaaatcatggcaagcaaatttctgatcaatggctaactcccaagtaagatatgcatcagggtcatattttccatcaaagcaaggaatggtaaacttgatcttgcctaaagaatcatcattatcacgtacctcccgccgtggtggagcgcccaagccatggcgctgccggcgctgttgtctttgtggacgaccaagtacctcctcatcatgctcagtgtcagcaacgtactccagttcttcccttgctgcgatgctgctattagcatcatggccattgtggttgcgcctagccgatccatcatgaccatcttggcccattctctccaacgtattcaagatacctgcaagagaagtgttcacagccacaagggacctctccaatgaggaaagcttggagttggtgtcaatttgagcagcctccaattgaccaaggcgatcattggcgaccctaacatcctcatcaaggccttcagcatgctccctcacttggcgctcaaaatgttgtatgatgcccctcgtacgtggtgaatgttgagggtgctcccccgatcctcctgtcatggttaatgggaagaaacaattcacaagaaatatgtcctatcaactattggagctaggtgttgtccatctccacttctaccaaacttgtgcaaacgagttcttacatgttcttactttgttatgtaaaaggcgttggcaaacagcaagaacagcaacaacggttagtagtactggagccgacaacaaacacgatcctgtgatatagtagataaaaatttgtggagctataggtggctgcaagtaatatcaaggtacagctagaaccacattaatcaaagcaagttgaataatcattcaacgatggtattgtgctggtcctaggcaaaaccctttagagacgcgagcctagtcacaagcgtagccactcaaaatagcacgaaaataacacaaacacaacagcaacaacaacaacttcctctcttcccttcctttttttttttccttctcttcacttctgattttttttctttctttttttttggttttctttctttttttttttgtacagcaagctcaaagcttcagccaacaagtcaaaacaagccttagcaaaataaccttttctcaaacattttcgaaatttcacaagcttcagccaacaaatcaaaacaagaagtaatgatgggttggttggctagttacatgattcagccaacaagtcaaaagtgagagcacttaaatgctttcttgggaagggctgattcacttcaaaaagttgcaaaagggttggctgttggtggaggcagcaataaatgcatttgggggtggctgatgtggtgatgagggtgctgctggttgtggtggacgaaatttggtggggttggaggtggatttcgtggtgaatatggtggtgatggtggcagcgggatgaagataaaagaagtgatggtggaagtgtttgcggtgacgaattcgtgggcagaactcgaaactctaaaggactaaactactagaaccagcaactcaaccaatcgatgcaatcgaaaactcagcaagcaaagactaagtagaacagcaaaggctcaacatgttttggtgatttcgggtctgacctattttagtggtttttcttttgggctgtaggtaaaaacaaagaagtgataaaatctctcaccgagcaacttgagctctgataccacttgatgcagcaacgggggttcccgatctttcgatgagaggaggataaacttcgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgaaacaaggcccaagcccaagtttctgatgtaaagaactattttcgtcattctgagcagcctgggtcaaagttgatggtgaggccacacatagctgaaagtagacgacgagatctttccaacaagtactcatttgccccgtttgccctccggagtgaagagcattgacttcatcaaatcagcgctgctagtgctgcttgcgatttggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgcaataggcgtggttgtatcgttggaagggatgtcctcatcacgttttttctttattttaaacatttcatttccaccatatatcacacacacacacacacactttacacgatcttgatcttgagtatatttagtcatctattttagtctatgtttttgacttagtaataaatgtgaatgcaagtatgccatgtttgatccctaccaaactacacatatcaaccttagagtaggaatcaaaaaggcaaaatggtgaggaattcattttgatacacttggagagaccgagtgaatcatttgaggaacttggatttcttttacaaaaatcatttgaaaacttccggaataaaagttgaatgaagattgggtgattagtactctaattgttgttctgtctttcaaccgcttaaggcaagaagagacaatgtctcgtgggaatcaggggtaagggtaagccaccgtgccaaagattatttgatttaagagagagtacatatgccttgaacctatacatttgagatatacagcatagtagcaactcatgatcaacagccaagtctttgtttcctttcatcctttactcgtgacgagcaaaggttcaagcttagggggttttgttgacggtcgttagcgatcagtttcgaccgtcaatactaccaaaataaaggagaactagttatgcttacaatgcatatttgtgttagaataataagtattccactagtactgggattgctaacctcttgcagagaatgaacataagagcatccctagcagctcatctatatttcatcccccaaatgcccatatggattatcatccaaaaagattcctcatccatatcccttccaactccaacacatcatctatactatatcatccatatcccatcatcctatattttagtaatatcttccaactaaccttacatttatattttaagggatatattttgaacaacttaattttaacgttgtatttatcaccataatattttgaaacgaataaactttaacagatatatttttattgggtgactgaagcatttaaaatgataacccaacaaattaacattactacattttctcccctcatttaatcgctagggaactgctagtactacttcctcactgcttgttctctaccatctccgattctccgctagtactacttctctttgcaggcagtggctgcgcagaggagttggcgagaggcggcggcggcggctgtgcagccaaggggcggtggcggacgagctggcgagaggcggcggcggccaggcaagtgaggggcggcggcggccgagcgggcgacgggcggtgaggatgcacgcggtggccgcggagcccggcggccaggcaggcgagggccgcggatggctggggaggaagtagccggcggtgggcaagcaagggacggaggaggccggcggcggccgccatatcgcgatggcggcaggtgaagcgagcgaaggagcagcggcgcggcgcggagtcctgatggggcggcgcagacggcggggcctccactccggcgaacaccaacggcagacccggtatgtccatcctctctatgtccatctggatggtggcgcgagttcgtcgagctgagcagttggggggatagcgtgaggagagagaaacgccaaatttggcatggagagcgctcggtttggatgacatctaaagatggcgtgtgtgatggagactctgttggatcttggtttttcacctccatacgctaaaattgagatggatgcccgatggaagatctgctgggcatgctctaaaatggagaattggcatcaaaacaggcgatcaatcaatcagacgatgtcgagaaccagacttatcaatgaatgggccaagaattcagaaatgacatgatcaattgggtcaaaattcacaagtctacatatgggagcaagagaggaggccgccagccaaaacctgggcttgttgggccagccaatggttcagtcgaactagggggctcggccgaacccttctcagcatcatccgatctagggctttgcctggacggtgtggattagcccccaatgatggttggagggtatttccgaccattccaacggtcacaactatcattgggaaggtataaaaggagctctcatcctccatttcaacacacacctcaagcaagctctctcatactctcttaagcttagtttagtattctcaagctagtggagtaggaatagaacagaagtctgagtccggaagtattcggaagagttcggatatggctctagcagctctcctttcttcttttgtaagacttgtactttatttacaatattcttctttatacaactttggtattgtaatattttccgagtatatgaataccaactttactttatatccgagttatgttgattttactgctagcttatctgggagatgccatggtacaggtataatgtttgcttatgcaattactctatgtcatgacgatgatattagagtactatctggtagtttacacgtggtgtctagattactgggtatcattatttggggttatatgctgtggaagagaggtgggccactgatggtgacagctcagtacgggtattcctccgcgtgtgtatatagtcctaagttaatttcctggggagggtactcctccgtatttagcccctgttatatggtcatgacaggttgtcgtaagaaactcgtcagtcatgggtggcttctcgaagcaccaggagggcatcggaaagaggatattagctagttaatcttatagttaggatgtatgtacaatatgtatattagaagtataggaatatattatttttctattttctttccactttgctcagataatttaatatgagaatgagtagtcttatgcttgtgtgtcactttatcctctgcttatattaacccctgcttagactatagttattacaagtaatatataaattattagtacggttctctctactataatcttcccacgggattaaacaaacgtgatacccttggaatactctcgggtgaaatgttacaatggtatatccgtgcacttgtggatgaaatctgtaaccataatataccaggagtatttctgcgccattgctggaaattatatttctagtaatgttgttaagaaataccaacatcgatccaaacaccaccttagtcatactctaatttgcattttattaatgtatgtactgcaatatcgttaagaaataccaacatcgatccaaacaccaccgtgtctcggctcagcgcctagctggctcggcacacatgccctcagccccccacaggctcggctgctcacgagggattgtttggcccagcgaaaacatgcgattgtacaggcaaaatggcaagcacgcgttaatatctaatagtgctacgtggtccaatcgaaacccggcaaaattgccggcttaagataagttgactggattttgttaatcctagtgtgaacacatgttaagctacctaggacttgtgtaaggctgtggtcggaatcacccgctcccacgatgcacagtgcgcacggaaaacagagcggttaattagcgcatgattaattatgtattagctaatttttttaaaaaaaatggatcaatatgatttttaagcaactttcgtatagaaactttttgcaaaaaatacactgtttagcagtttgaaaagcatgcacgcgaaatacgatggaggggggttggaacccagggttccaaacagatacggccttggatatgtatgcgatgttgcttgtactctactttgtcattacctcgcaagtcattgtcactttcattttcaacactcacatgaccgatctgtgattcggtcttaggtgacaaagatagctcattttcatttgtaatacaatccgaaccgtcattcagtttggctatattttcaacgatgctattgtctaagctagcaacacaatccgaacgatcacttggtttggctattccatcattatttaaactagtaacacaatccaaaccgtcgcttggttcggctatattgattgttgcattattatccaagttagtaaaacaatctgagccaacctttggttcggctatacttgttatggtcttgttgcataaattattagcacaatccgaaccgtcgcttgattcggctatacatgttactgcattatcattgtgaataacatgtgtatgtggaataacatgactaatagtactaacatgaggcaaataacaattaaaatcagtgctattagttgtgggacaaaattctggaagaggttccaaggcgtagatctgatcggctatggatagcccggtctgaccggccaagcacccgatctgaccagtagtcaatgatgcggtcagaccgaccacaggaggcacaatctggccgagatagggcacggtttgaccggctatggtgggtgcggtctgatcggcgtcatgcgcggtttgaccgtcggctacgctttttatataaccgattcccgaggaatcggctgtgtaaatgccagtcgatccatccataatactatagatatgttgtatagatgcaaaactagaagtagcattagatttttgataactggctatctgagagccaattttcttaatagactcattaaagaaagttttacaagcatcttctaacatatcataattttttcaatataagtgctaacagatgcatctatataacgataaatatgttttcgaatggcaagagatggatcgggcgaattggagattaccttaaatttgagaggaggaccagacttgagaaccacaccttgatgggtcctgatgcatgatttcatcaacctctcttgtgtaatcaccttgatccactccttcatgacttgacgttgctcctcatcaagatcctccctgatgaggacatcctccactattacccgctggcaaagacgacaaagtcgggcggcgactgtgtgagactctgaataatcccaccttaaaagggagagccgcccttcccctattggactagtcttttagggagatcgggccttttcccgagtgggtgtgcctaagaactattggggtccggacaaccttaatttgttgggcctcggccgaccccacctgggccggattgttatcactcccatgtgaccttgtcgatctcgttcccgctcatcatagttgatgaagaaatttctcgattaatttcggccatatagctcataaccaaaatattttgaccgaatagattaatatactgtctttgatttccttcgtatactttgatgtgtaacaaatttgaccaaaattgatttcctcgagggtcaaccgatcaaataatatatgcacagtactagatcggctagaattgattttcaggttttctgattgtgcgcagcaacagacgtaattttgtgtagctctagcgaaatttggaactttttacagccgatgtgagtcggctctgattttcttttctcggtaacaaaccaattcagttttgcctaatctgggtagatcagctctggtagcctgatcttttttaaagaaaatttttggaatacgtatgcacagtatattgaattggattgagtttcaaactttctctgtgcacagcaaggactagcacgatcgatcagatcggtcggctgttgcttgtttcctgtgcctgtggccgtgtgtattgctgtattgccgccgaaacagatgtgttcggcgaggatgacacgatggtagccggtaaaaacaaaataaaatagtagattgatttcggccgcacggccgaaacagtcgtctcgacaaaacaacggataaattgcaaattcggctattttaaagccgaatagatttcttccccgacggagtcgtcaaaaaacgtgttggtgattttttgtgacaagtcaacaagcacgatcgcagcacctaaacgccttgcggtgaaaacggctaaaccagctagtggagccgatttaaagatcaaaatcagcctttaggccgatttagatcgatacgaggataactactcgtcttgtgggtagaacgaaaggttttcaagacaaacctacaaagaggtgtcgcactctcgcagtggcggcggacgatttacggcgcaaatcgacaaagatagactaaaactagggtagagtagaaaacatggctaaaattaaaaagaaaaaacgatttaagtagattatgtgtttggggggattataattgaaccagtcttatctcttaaataggggttggtcttgacctctataggccctcatccaagtccaactcgggatacaaactaaagaaaacccgaagcatgccttttcaagcaaggaaacccgagacccgacgaaaacagactcgggctcggaccctgacggtctgaccagccacatacctacggtcagaccagagttcaggccgcggtcagactgcccacacacatacatgcggtctgaccagccctgtgaaggaaacccgtcactttccaaactttgacaactttcccctatttcgttcataggtgccaattttgggtgtaaacacacctgcggtctgacttttcaaacttcggcaattttcccctatttcgtccataggtgccaaatttgtgaaggaaacccgtcacttttcaaacttcggcaattttcccctatttcgtccataggtgtcaaatttgggtgtaaacacacgggtctagtttccctgatctttcggtgagttgatgataactacgatttgctcatccggtgagttgatggtaactacgatttgggacaaacgttgatgatccgactacaaccagtaacagccctccctccagaaccacatagctagcccatccgacgggcgggcccacttacactttcgtcctcgcttcataaaagggttaacccgggagtgacatggttgcagagaagaggccttataagttggttccaaccttgctagactagcaaggtggtactaaacatgcacacagctctcatgggacacaggtcaaatcctaattgggccaggatgtcacatacaccctcccttaaaggacccaacgtccccgttggcctaacttagccatgtagccacataggcatataaggcaaatgtccaagaacacagcccctcctacgtgcgtgcagtgccggcaccatatgccatgccatgtgcctcacacagagcccacatgcactatatgctcgcacactgatccatagcccatccgacgggtggacccacttacacataccactccatttacacattcgccatcgcttcgtgtaaaagggttaacccgagagtggcatggttggagggaagagtccttataagttggtttcaatcttgctacactagcaaggtggtactaaacatgcacacagctctcatgggccacacaggccaaatcctaattggaccaggatgtcacacaaccgtacaagacgttgttgtgttgcgccttatcgattgatacacctctccatgtctttgtttatcttactgatggagatcaaccttattcctacaagcaaaacgaaggacacaagcaagaacaagatgaatgcaatccgaattgcaaagaatacacacgatgaattggggttctggagacaagtacttaggtagtctatgcgacacacgtaactacaaggtaaagttgcaatggctatactttaatgtaaacaaaacccgagaaaccctaaaggggtacctagctatttaaggaggtgtgaggatgaccaaagagactgttggtatttcttaacgacattactagaaatataattcccagcaatggcgcaaaaatacttctagtatattacggttacagagttcatccataggctcacagatataccattgtagcatttcacccgagagtattccaagggtatcgtatttattttatcccgtgggaagatcatgtagagagaactggactcataatttatatatcacttgtgataatcatattctaagcaggagttaagataatccaagggtagagtgaaacacaagcattaactactcattctcataatatatcatctaagctaagtgggaagaaaagagaaagaaaatctattcctatacttctaatatacatagtatacatacattctagttaactgatatactagctaataccctctattcgatgccctcctggtacatcgagaagctacccttgactgccgagttccttacgacagcccgtcatgaccatacaaccggggctaaatacggaggaataccctccccagggaattaacttaggattatatacaggcgcagaggaatacccgtactgagctgtcaccatcagcagcccacctctcatctacaatatataaccccaaataatgatatcccgtaatctagacatcacgtctaaactaccagatactactctaatatcatcgtcatgacataaagtaattacataagcaaacactatacccgcaccaaagcatcttccagataagctagccgtatattcagtataacatgtaaagtaggtactcatatactcggaaagtatttcaataccataaatgtatttagaagagtattctagtaaaagtacaaagcttataaaagagaaaagaaaagctactagagccatatctgaactcttccgaaggcttccgggcacctgatttctactctattcctattccaccagctagatactactaaactaaacttgagagaaatgagagagctattgcttgagttgtgtgagtgaagtgagaaggtgagctccttaaataggcaggtaatgacggttatggcggttggaaaggtcggtaataccctccaaccgtcatagggaaggaatccacaccgtccatccaaaccctgcatccagcggcttcacggcaggttcggccgaacccaatggttcggccgaaccatgggctggcccaacccagcccatcttcggcttgcggcctcctttgtttttctccttcgtagacttgtgaattttggcccaggttgtcatgttaattctgagttcttggcccattcatacataagtctggttctcgacatcgtccgattgatttatcgtctaagttgatgtcgattctcctccactttattgttattctctgcaaaagtttagtagacctaatactagtggaatattattattctaacatatttatgcattgaaagcatcactagttctcctctattttggtaatattgacggtcgaaacctatcaataacgaccgtcaacaaaaccccccaagcttgaacctttgcttgtcccgagtgaaggatgaatggaaacaaagtcttggttgttgatcaggagttgctactatgctgcatatctcaaagatacaggtgcaaggtatgtgtactctctctcaaattaaataatctttggcacggtggcatacccttacccttgattcccatgagacactgcttttccttgccttgagcgattgaaagataatagtaattagagcaccaatcacccaatctttattcaactcttattccggaagttttcaaatgattttgcaaaagaaagccaagttcctcaaataattcactcagtctctccaagtgtatcaaaatgaattcctcaccaattgttgccttttttattcctactctaaggttttaatatgtagagctaggtagggatcaaacaaggcatagttgcattcacatttattactaagtcaaaaacatagactaaagcagataactaaacatactcaagatcaagatagtgcaaaaatgtgtgtggtatatggtggaaatgatatatgaaggaaaataaagaaaaagcttctcctttgtgcttaccttcttctcccaaaaatccttcttttattgattaggagagggcatgattacattttttttttcaacatcatgctcatgcttgatggagcataacatttttttttcataatcatgcatttccctcctttttttttcaaaaggatttttttaggaggagaaagcacatgaaagcatggagaatttattttggtggtaatatggaaatgtaatggaatattgcttagctcccagtgtaggagtttggcatgtgcatatatgtggatgtatgattttgatcatagagcatgagaagtatctatacaagtcacaagagtttgatagagttcaatggaatgacaagtaaccaaaatgtatatgatttaatcatgatagcacatttttggctctgttaggaatttatatcaaatgaggaactttcaattttatcattttgaaaaacaaaacatccggaattcaagtcaaactagtatcataatcatagcaactcatatttactatctcatatctcgcaacaacctagacttagatcagcaagtgcagctcatttacctcaggttcccggataattgttggctacttttatttgacctttgagagagcacttaccaagaacccatatataagagatataaaacagagcaactattcatcatttctacaaagaaaactagcttgtcttacctagcatgactcaaacctatcctatctttttgtatttttttattttgcaaatttttatgttgttttcaagttttataagatgcaattggaaagcaaatatgtaattggaaagggaaaatatgcaatgtgatacaagttacctcagtggggggaagagatgaccccccccaagcttggctttcactcaaggtccttgataaggattgaacccctgaaagcggaactacgcttgaaggtcatcgtgctattgctgcatcatgttgttgaagttggcgaactgcgcatcagcagattgttgccatccttgcgtttgtgctagtgcaagggtgtccattctccaagtgatttcacccaagtccgaacgagaggaacttgagcgccattcacttggagatggaggcacaccacttgatctggaaggttgattgtccccccactagatgtcatgaggcgcatgccaccggtcctcactggcacttgcccaggttgagactccgatactgtgacgtcgagcttgggtccatccgggtgcatccccagttggctcccaacctgcctcatacatctgcacggtgttgaggatgatgaacattctagttcatttcttgtcatgttgcgcgtctccctgtatgctccacctacacgagattcttctatggtctgcaggggaatggttagttcacggcagttgtacaaatgatacaccacatttggcaacgggatttcatttgtacacccgaggaaaaagtaaatcaaagatccatctactccatgtttcagaatatgcccttgcactggataagcctcattaatacacggacgagcggctgagataaaagcaatttggtcgctaacgacccctagcccttttgctatccgagtattcagagaagtgcactcaacaggagcagagaactttatactttctaaccattgccttatcatacatttcacaggagcaattttgatctttctaaccatggcaaacatgataatcaattcatctcccataatgggcctcatatcacctctaggaaactgagtcatagcaatccatttgtgcatgagcctaagtgtaggattatggatatcattcattctaggtttcttgcaaattggagcaccggaaatatcttcccgaaacctatttttctcgaacccagaaattcctttctggagatcgattttacaggaatcgtgaaaaccaagaagtgtacttaagcctttccatgtaagtgtaaactcttcacggaaaaaatgaaaggaaattccatcttctatttctttcaaagtgcaaagaatttgcaaagtaagcagacaagaaccaggctcatctaccacatcaaatctctgccaaccaacagcttccaaatagtacgaaattcagcatccatacctatctttttttagcagctccggtgagtattctcgcgtgtgagcatacttccggtcgctcagcatgtagtaggcttgtctctcccgatcactgacaaggtcgaggtcggtgtcgttcaggagtcatcgcggagcttcggcgtcttccatcgagacatctgttgatgaatgagtactagactcgtcatggcgacttgatgaagagccagaccccttgaacagacgtgacagtcgcctcctcattctgcacaatggagcaagaacggactaactcggcgggggttaggactgacaagaatttcacccgccggttagtttcaccaaagcaacttgtatatatgcaactaagtgtttgaatttgagggaaactatcaaagcttgaatgaacttgagagcaaactttggagagggaatgaaaatgtgttgaaatggggtggaattccctctctcggctggttggcttaagtagtgcacccagaatggtcaaaaccgacctatggggcccactagccgttgccttaaagaaggaggcagccgaccgttggcctagctggttcggccaaacccacggtgggcccaaccggacccactttcagccaatgggttccaacggtcagtgtggtcatggcacagtgaattttcactgaaaattttattttggtttgctctgaaaaattcatttgaacaatttcctcaaaattcaaaaatcctaaatgcaactttgaaattcaaacatgtgatgatgcaaaaattcaaattgttgaaaacaaatatgcggatacataccaatttacctgttggcgaaggtcgcatcatttaaagtccgacgtgcaagactgtacctccatctagttcagtttgcggattttctatcgtctccggaggtgatggagcgggcgtctttggcttctccctccacaccttctttggttttggtgcggacggcggcttcttctgagccagctgctctagcttcttggcccgtatgggtggttttaccagcgttcctgggcatcgttgtttccttctccaggaaattctgcatgaatttcagcaggctgtccgttttgggtggctctacttcgacctcttgaatattctgtgggttcggcccgtactttattctgaccatggagcattgttccgtcctcggttgaaactcaaacttctcttccttgctgttgatgtggaaacggatactccccattcccacgtcaatgttggctcctacggtgctaaggaaagggcgcccaggatgagcggtgtctcttttcccgtgtccgtgtccagcactacgaagccaaccgggatgaagaaatcccgtatcttgactggcacatcctccgctatccctacagggtaacggactgacgaattagccagttgaaggtgcattggtgttggtgcccataccgtgaagttgagcttgtcgaagacatcttttggcatgacactgacattggctccaaggtcgcacaaggcctggtcgaactgttgtgccccgatcgagcaggtgatcgtaggacaccccggatcttccttcttcttcgggagcttgtggagtattatgttgctgcattgttccgtcagcttgaccacctccgttgggagcggtctcttgttgttgagtttgtccttgagataacgggcgtatgttggcatttgtatggtgtccaacaacggcacgttgatgtggatcttctggattacttcaacaaaacgagcgaattactcgtccacagacggtttcctactccgttcagagaacggcagcaaccgtgtgtcccagtactcttgcggcactgtcttttctggcggaacttacttatcagccgagtcattagatggcacttctttttctttttctttttcccccttttcttttcgaatgggccgctagcccattctactccccatccccctccccgctgggctggccgaaggccaaggcctagcagccggccgcatcctccctcctcccttcgggtcgccgataggtggggcccacctgtcgggcccgtctcccacctccagccggcgccgccgcatcccgcaaccgccgccccgctcactccgcgtctcccgggccacgtcgcccacctcgccgcccgcgcccgccttccccgcgcccactccctctctcacccgcccgtgcccacgctcgagacggccgggattcaattttagaattccgcctctctctcctcccaacctctccccactccgccggcgaaatcgcggtctctccggccacgatcgaccctcgtgagtctatataaagcacccccgttccctcctctctctttttcgttttgcaatcgcctgctcccgtgcactccaccgccctagcgtcgtcgccctcgtttccgccgccgacgccaccgctccggccgccgctagccatcgctagcggctgcgccgagccacgccgtcgacgccgtcgcattcatcgtcgtgcgggccaccccgtccacccctctcccgtcggattccgccgccggaacccactccgcaccgtgcgccggtgagccccgccatggccgccgccttcggccggcgtcctcaccctcttccatcttcctctctctctctctctctctctctctgtctatcccctttcatcgtgttcgttaagtggttccggagctcgtcccgttgccgtcatcgcagggactaaggatgccaactgagctagctgggtttctatcattttattaaagctcagctgattttgaaaagcagaagcaaagccatctaacttgacatttatgttttctaggaccttgtcattggccgcaagctttttgcttaacgcatcggtggttttagcttgcgcaaaaacaagatccttcaaggagggctggttagaaaaattatcgttgttgttacctccttgataatatgggcatggttggttccacccctgacctccttgtggatgatacccgttgttgttgttgcccatgtacatcgcctcctcatgggttcccgggcagtcattcccagaatgacctgtgttgccgcagacctcacatgtggcgtgagagtccaaggctttgacggtgccttgtggccatttctcgtggtcgtccaatcgcttcatgaggaggtccagcttagcagcaagtaactccgtctccttgacggtgtgcatgcctcgctgactggtctagagtcgttcctcgctccaacccatattggagaccatcttctctattagatcaacggctccttgaaccgttttagagaagaacgctcctccagctgccgcgtccaggtgatcgtgggacatcggggtgagtccattataaaagttttgcaggatcaaccagtcgtccatctcaagatgaggacaggcagctacgtactcttgcagtcgttcccatgcttccggaatagactcatcccttgtctgctggaaacttgaaatccttccacgaagggcattggttttgcccatcgggaagaatttcgagaggaatgtcgtagagcatttgtcccaggtattgacagcagcaaggttggcatagaaccactgcttcgctctcccgagaaggagaacggaaacagtcgcagcctgacggcgtcgggactgacacccttgatggtgtacgtgctacagatctctaggaactgttgcagatgagcattggcatcctcatcaggcttgccacagaacgggctagcctgcgccatcgtgatgaggctggacttcaagtcgaaatccacgtcccctatgttgacctacggcccaatggccacattgtcagcagagggagcagcgaactcgcggaaagtcttgttagctatagtcttgaaggtcggtggtgctggtacggctggtttctctgtcggtagagttttctgcagggctgcgactcgcggcctaacgctccggaagaaagcttctggattttctttgaagttttctggcagtttgaaaccagtcatgcactaccctgttttcacaacaaaagtgaaaacaaccaaggttagcctgcaaaggaaaatgattatacagaggcaaatataaattattagttaaaatagtctctattatgaatcttccctggcaacggcgctagaaatgcttgttactatttcttaacgacgttactagaaatataattcccagcaatggcgcagaaatacttctggtatattatggttacaaagttcatccgcaagcgcacggatataccattgtagcatttcacccgagagttttctaagggtatcgtatttattttatcccgtgggaagatcatgtagagagaacttgactaataatttatatattacttgtgataatcatattctaagtagggattaagataatccaagggtagagtgacacacaagcattaacttctcattctcataatataatatctaagctaagtgggaagaaaagagaaagaaaatctattcctatacttctaatatacatagtatacatacattctagttaaccgatatactatctaataccctctatctgatgccctcctagtactttgtcacaccctgaagttcttttccccaagcctaaattgaatttgtaattgatctcgagaaaataccggtgtaaaagaaagagtgaaaccataataaattaatgcaaataataatcggaattggcatatggaatttttcttgagttctacatgtcgaaatgtgctaataagatttttagtggaattttcagagctctagaaataattttaaccaattaaaattgagcacaagcaatgtttaatccctggaaattcatttctttctttttctttttcttttttcccccttttcttttcgaatgggccgccggcccattctccttcccctccccctccccgctgggccggccgaaggccaaggcccagcagccggccgcctcctccctcctcccttcaggtcgccgacaggtgggacccacctgtcgggcctgtctcccacctccagccggcaccgccgcatcccgcaaccgccgccccgttcgctcccgcgtctcccgggccacatcgcccacgtcgccgcccgcgcccgccttccctgcgcccactccatctctctcccgcccgcgcccgcgctcgagacggcctggattcaatttttgaatcccgcctctctctcctccccacctctccccactccgccggcgaaatcgcggtcaccccggccacgatcgaccctcgtgagtctatataaagcacccccgttccctcctctctctttttcgttttgcaatcgcccgctctcgtgcactccaccgccctagcgccgtcgcaatcgtttccgccgccgccgccaccactctggccgccgctagccgtcgctagccgctgcgccgagccacgccgtcgacgccatcgcattcgccatcgtgcgggccaccccgtccacccctctcccatcggattccgccaccggaacccactccgcactgtgcgccggtgagccctgccatggccgccgccttcggccggcgtcctcgccctcttccatttccctctctctctctctctctctctaacccctttcatcgtgttcgctaggtggttccggagctcgtctcgttgccgtcatcgccctccgtcgctcgccatcgtcaatcgccgtggtgagacacctcctccagccgcttagccgccgctaccgccgtccgtgtcaccgcgacgccgctgccctccgccgccggccggtcgccgccgctgcgtcgagccgcaccgccgcgtgccatgggcgtcgggccagcttgagccgtgcccgcgagccgcctcccccgtccgatcgaccgggcggtagatcggggcccatccaatcccggcaccggcgtggctgacaccgtggccgccacgtgtgcgccacgtcggcgccacgtgtgcaccacgtggtgcgccacccctttcccggtccgtggacccagtccaccgtggaccaccacccgagtcactgccatgtggggcccgcatatcggcgccgccccctctctctccccgggaatttaattattgcgcaataaatcaattaaggatttttctgtttatagtgaaaacacagtgaatcttctaaaattcatatctaattcatccgagctccgtttaagcccatttaagtctcagtaaatcaagaaaaatgcatagaatccattaaaaatggttttgttctctgtttcagtagtcttatagcctgtttgtattgtttgctttgtatgtcgcatagattctggctctcccgacactccggtgtactttgaaatagtcaccgaggttcctccagcagcagagcaaggcaagtcatgcttgtcacttgaacatgttgatcctatattgcaaatgctctatcgttttcctttaaatactgcattgttttataatattactatgggatttttacctactgttacagccatgctatttttgtaccatgctcctttgttagattgggatataacatgactagatattggactagggattgcttagccatgcttagttcaactagcacacaatgggggaattacattaatgcatagatatcagattcttgaaatgatgttggttaatgccaccgctccggtgttggttaattaaaatatattaaatggtgggtgcatggttttgatggtcgcgcccatggcatttaaggaccggttcggggatgccctagaagaacttatcatacttacaacaagcaaacgtgggcaacggctgggcttgtagtgtagctttcctctggttgatgcatccaggcaagggttggcgtgatggagcggggcgggccctgcgacggcctatgtcgcttccggattcacctaggcacaagaggggactgcccgttgcccgctggggactggggtgacacatgaggtgtggtgtgcttggctagagggggttatgcgaagggtcctgtcacggcctctatccggtatgtcatggtggcatgtcggtgcacggaaacgtgtcggggggctgtgtcttgtgggtacagttgtacacctctgatcagagtaaaactattcaatagccgtgcccgcggttacgggcggtcaaccagattcaccgtgatttgactcaccctagcttagtataatggaattgattagttctggtggatggttgggcctgttgcaacgtggggtagcgttgaacagtggatggttaatattgatgaattattaaaactgttttactgctttcaactaccgtctttaaatgctcgctttatgttctttgccattggatttgttccgggaaaattgggatttgttcctgtggttcaagggaaaaatcttggtcgctcgtttaagtgggatttctcaaatcagatcagactaggattttagtaacattatttgagatttatttgacagtcagtcgggatttgataggaggaatgcattaggtcctaactcgggaagatgggttgcaagttatttatgctcttattgttattattagtatgtatctaatttctcattattttatcgctatgtaagtccgtcttatttattcgctctcatgcaaaaatgatctatgcagaaaattatgctctcatttgttcattttaattgagtcctttactgctttatttaaattggatttgagcatgcattgatcctacccctttgtcttctctagatggccgaccacccatccaaccatcacggagaaggcatggatgattttgtggctgagttggctcgcatgaccttggtggtgggctaccccaacgcaccggagtactcgaccgttccaccgctcagtggcgagcttccccaccgtgttcgtctggaggttcatggctttgtgggcacctgcctcgctaacatggtggttaaggcatctggaggcaccgcagatcacgcctgtcaggaggcagcatacctgatgatggccaggcttcgtgatcaccacagctacatcttctgcaacacggcgtaccgcttcgaccctcgccgagcaagtggcgatgatgtcagcacctttcgcccgacggccggcgagaacgacaccaccttcggccacatgtgtgccgtgatgatgggaatggacaggatgcactctgacctgcacaaggcgtccaaggccttgaatgatgggaagcttgtgaggatcatagctctgaaggatgagatagcgcgtctgaagaaggagaatgctcaactgaagggtctccccgctcccggaggagtccggatccgcaccacgcctcgcaagtcaacgactgcacccgtgcgcattcagcttgcgcccaggaacccacctcctcccgcagctcctccagcacctcccgcagttcccgcagcgcccgtagctccagctccagccccagctcctgttccagcgtcagctcccacgtccgctctctcctgcgctcccgcgtcagccgccaggggtccagccagtggcaacggagtttgtgtgtttaggtttgttcgcttgtgggtcagtcgacggttgacatcatgtgcctatgatgtggctgtcttaataaggatttctttgctattttaagtgttttaattcagatcagaacaattgcagtttaaattcatatataataaagcttagttcctgagcatctgtttttcttcttttccatcccttccgtctgctctcccttcagatggtcaacaccaggaatggcagtcgtgcagcaggtgagggcagcaacgacgaagaacgcaccgacggtggatatcccaacagcgcctctggcaacgtccgccacagctccccgagaatccgactcttgcacaagtgatggcccatcagactcagatgatggcggccatgatgcagcagatgcagcagcagcaccagcagatgcaccagaggatgcagtagcaagctgagcagcagcagcggcagtttggtccccctccccctcagtccaagctgccggagtttctacgcgtcaggccacccaccatctctagcaccaccaaccccatggaggcgaatgactagctcattgccatagaaaagaagctcaatcttctgcagtgcaataatcaggagaaggtcgccttcgccacacaccagctccagggtcccgcatcagcttggtgggacaatcacatggctacccgttcgccaggtacggaggtcacttgggcggagttctgtcgcagcttcaggaatgcgcaggtgccagacggggtcgtggcacaaaagaagacagaattccgagcaattcaccagggcaacaggacagtaactgagtacctccatgagttcaatcgactagcgcgatatgcaccggaggatgtccgcactgacgcagagaagtaggagaagttcctagcaggcctagatgacgagctgaccaaccagttgatctccggggactacgcagacttcgagaagttggtagacaaggcaatccaccaggaggatcagcacaacaaaatggacaggaagagaaaggcagcatagttccggtccaaccaaggaagtcaccagcgaccgcgcttcactcccggacagcagggtggacctaccaccatgattgtccgccagcatcaccctttcaactcaagcagctttcaccagggcgccagtggcagccagaacaacccgggaggtcagcccaaccgcagtgcagctccgcgcccaccaatggccacaacacaggcagctccatcagtccaaggcaagaaggatactggagcaaagccagggtcctgcttcaattgtggcgagcatggccacttttctgacaagtgctcgaagccaaggcgtgccgggccaaggttttgcccaagctcgtgtcaaccacgcatccgtagaagaggcgcaagtagcaccagaggtcgtactgggtacgtttcctgtcaactcaatttctgcaacagtacttttcgattctggtgcaacgcattctttcatttcaaagaagtttgttggggtacatgggttaataagagaagaactgagtacaccaatgcgggttcatacccccgagaatagctccacctcggttcaattcagcccttctgtaacaatagaaatccgaagatcaccatttctagccaacctcatccttctcgaatccaaagacctagatgtcattcttgggatggattggctgaccaagttcaagggtgtcattgattgtgtgaatcgcacggtcaccttgaccaataagaaaggggaaacagtggtgtacaagtcaccagtcgcactgaagcagggaatctccttaaatcagattgaggtggaaaatccggtggtcaccgaggagaggagttcgaggaaattggaagatatccccatagtctgcgaatatccagaggtgttccctgaggacctcattaccatgccacccaagagagagattgaattccggattgatttggcacggggactgctccaatttacaagagaccgtacagaatggcagccaacgagctagcagaggtcaagaagcaggttgatgagcaactgcagaaagggtacattcgaccaagtacttcaccttgggatgctccggtcatttttgtggagaaaaaggacaagacaaagagaatgtgcgtcgattatcacgcactcaatgaggtcaccatcaagaacaaataccctttgccacggattgatgatctgtttgatcagctgaaaggagccaaggtgtttcctaagatagacctgcgatcaggctatcaccaattgagaattcgggaagaggatattcccaagacggccttcaccactcggtatgggttgtatgagtgcacggttatgtcttttggacttaccaatgcaccagccttcttcatgaacctgatgaacaaagtgttcatggaatttctggataagtttgttctggtatttattgatgacattctaatctattccaagtcagaagaagagcatgagcatcatcttcgtctggttctcgagaagttgcaggagcaccagctttatgccaagttcagcaaatgcgacttttggttatcagaggtcaaattcttgggtcacgtcattacagctcagggtgtggcagtcgatccatcgaatgtggagtcagttaccaagtggaccccacctaagaccgtgtcacagattcggagttttcttggacttgcaggttattaccgtcggttcattgaaaatttctctagaattgccagacctatgactcagttgcttaagaaagacgagaaattcaagtggacagccgagtgtgacaagagttttgaggaactcaagaagaaattagtgtctgctccagttctgattctgcccgatcagacgaaagacttccaagtctattgcgacgcgtcccgtcacgggcttggatgcgttctaatgcaagagggcagggtggtcgctttgcctcacggcagttgcgtccgcatgaaggaaactatccaacacatgacttggaattggcagcggtggttcatgctttgaaaatctggaggcattacctgattggcaaccgctgcgaagtatatacggatcacaagagtttgaaatatatcttcacccaacctgacctgaatctccgacagcgaacatggttggagttaatcaaagattatgacatgagtattcactaccatccgggcaaagccaatgtggtggcagatgcattaagtaggaagagctactgcaatgctttgtgcaccgagggcatgtgtaaggaattgcagcaggagcttgaacatctccacttgggaatcgtagaacacgggtatgtggttgctctagaggcacggcctacgctcgtggatcaagtcagagcagctcaagtaaatgatcctgagatagctgaactgaaaaagaatataagggtcggaaaagcccgggatttccttgaggatgaacgtggcacaatctggctgggagaaagattgtgcgtacctgatgataaagagctgaaagatctgatactcaccgaggctcatcagactcagtacttcattcatccaggcagtaccaagatgtaccaagatctcaaagaaaaattttggtgggcctgcatgagaagggaaatagctgaattcgttgcactctgcgatgtttgtcagtgagttaaagcagaacacctgaggcctgcaggcttgttacaacctcttcagatcccggaatggaaatgggaagagattggaatggatttcataacaggtctgcccaggacatcatcgggccacgattcaatctgggtagtcgtggatcgacttaccaaagttgctcatttcattctagtgcatactacttatacgggcaaaaggttggcagagctctatctctcaagaatcatgtgtttgcatggagtacccaaaaagatagtatctgatcgagggagtcagttcacctcaaaattttggcagaagttgcaagaagaattgggtacccgtttgaatttcacacagcttaccatccgcagacagatggctagaccgagagggtcaatcagatcttggaggatatgttgcgagcctatgcgcttgattttgaaggagcttgggataaaagtctgccttatgctgaattctcttacaacaacaactattaggccagtctacaaatggcaccgttcgaagcgttgtatggccggaagtgccgcacacctctcttctgggatcaaacaggcgaacgtcaactgttcggaatagaagtgctatcggaagcagaggagaaagtcagaaccgtcagagagaggctgagaattgcacaatctcgacagaagagctacgcagacaaccgccgaagggagctcacttttgaagcaggggattatgtgtaccttcgtgttactccgctcaggggagtacaccgtttccagacgaaaggcaagttggcaccacgcttcgtgggaccatacaaaatcttggaacgaagaggagaagttgcctatcagttagaacttccatccaacatgatcggtatccatgacgtgttccatgtgtcccagtgaaagaagtgcttgagggtacccgaagaacaagctgattcataccacattgacattcgagaggacttgacttatgtggaaaagccagttcgcatccttgagaccagtgaaaggaggactagaaacaaagtcagtaggttctgcagggttcagtggaaccaccactcagaggaagaagcaacctgggaaagggaagatgagttgaagaacgcccatccgcacctcttagccagctcttccgaatctcggggtcgagtttccgtttaaggggggtaggtttgtcacaccctgaagttcttttccccaagcctaaattgaatttataattggtctcgagaaaataccggtgtaaaagcaagagtgaaaccctaataaattaatgcagataataatcggaattggcatgtggaatttttcttgagatctacatgtcgaaatgtgctaacaagatttttagtggaatttccagagctctagaaataattttaaccaattaaaattgagcacaagcaatgtttaatccctggaaattcatttctttctttttctttttctttttcttttttcccccttttcttttcgaatgcgctgccggcccattcttctccccctccccctccccgctgggccagccgaaggccaaggcccagcagccggccacctcctccctcctcccttcgggtcgtcgacaggtggggcccacctgtcgtgcccgtctcccacctccagccggccccgccacatcccgcaaccgccgccccgctcgctcccgcgtctcccgggccacgtcgcctacctcgccacccgcgcccgctttccccgcacccactccctctctctccctcccgcgcccgcactcgagacggccgggattcaatttttgaatcctgcctctctctcctccccacctctccccactccgccggcgaaatcgcggtcaccccggccacgatcgaccctcgtgagtctatgtcacatcctgattttcgtcttacgatttataaattttttaataaatcattattagaatttatattaaatgttcatcaatttacaagtgaagttaaatgtgggaaataaaatttcctaaatataaagcatggatggatttaatttttattaaattctccatggttaattgtactctctggaattttctcggatttttcggagctcaattcctaattttaatcatacaaagaacatttcagtaattatccacatattaaattaatcattaaatggtctgattataatttttttaagtactttgagtgtccaagtattttcaggatttttcttgaaattatttgagcattggaagtatttttaacaattcaaagatcatttcagtgattattttaattgaaaaagttttaaaaaccctccccttggccgttgagccgtttcctgcccaactcctctctcctcgcgcgcgtgctgtgcggcccacgctggcccagtccaagccgccggcctcccccctctcagccagccaaaagtctactttacttccccgaatactgttcatcttcaagcttggacagaagcccgagctgccgtcctgtgccctgtgcagccgccggtttctccaccaaatccgccgcatcccgagctccgtttgcaaaattagttgaggggaaatattcctcttatcctcctctatcctttcccccaagaatcggactttatcccgaagaaatcaacgcggaatcgaattcgttttcgagtttatctctccaactaaccctctgtttttccggctcaaatcctctcggttggagtccgatctcttcaatccaagcctataaatagcatcccctagtcgccctatttcttttgcgccatctcccgagctctctcgtgcctcgtagtgccgccgccgcgccacccaaaccgccgccgtcgccggccggcgaacagccgcctcgcgccgccgcttgcatcgtcgccgccgcctcacgtcaccgccgttaggtgcgcacggtggagtagaagctcggccgccccactccccgccgtcgccggtcggcggagacccgccgccgccgtcgaccgaatcgccgccgccgcacaggctcgccgccggccgtcgttcgtcgtcgtccgtcgttgttctttgcaccggtgagttcgcgtcgtcgtcctctacgcgtaggtgccctccaaaagtccggccgagtctcctagcgccggcgaggtcgtcgcctatgtcgagccgacgttgatgatgtcatcatgacgtcatattccttttttttcggttttcttttcagatgaaaatcgattaaacttcggaaattcataactaaatcatcataactcggattcaagtggttcaagttgctaaattcatctaaaataagatctacatgttaaaaatatccacatgtactgtttatacttgttttttactgttttcttgattttgttctttcgctttagtttccgacgttccggaggagagggttttcgttgaggaaggttcagaagcatttgatgaagttcaaggcaagtcacacagatcccaaacgaccctttgagcatgttgaacccgtttaaagctaatgttttatttcaacttatgcattattttcgaatgtcagcgggtggtgagcctttcccaattaattaatggccgaagatgactttattttcctatgggttataatttgattagctagaaccttatatattggtttggttcagctaaatgctatatatatataattgcttagccatgtttagaaacattagctcactaatgggatgaatcatatatactacattattatttatggttatatttaatggtagctcacgatggttaatcgtgttatgataattaattgataattaaaacttgattaaaggtgggttgtgagcaaatggttttgaaagtcgtgctcatggcaattaaggaccggttcgcgagctactgttgtgagacattaaccgtgccaaccacaagccagtgtgggcaacggctttaccttttgtatagcatgattcattgcggggtgccagactgagaagcggtgagaagtccgtgggggtcgctggggagtccatgcctctggtttttgagggggtgattatgatccaggaatggtgcactgtggtgagttgtgttgtgcgaagggtactgtcacgatttccccctttgcagtgccgtggtggtacttcggggcatggcaacatgtgtggaatcgtgtcttgtgggtacagtggtacacctctggccagagtaaaactattcgaatagccgtgcccgcggttatgggcgggttgagcaatgtttttcgtaattagtctcacacctctcacaaataattattgatgcaataactggtaataatttatttagctcctggtttggagttagatctgtacagccgggtatggttgttcaggatggttgggcctgagcagcatgggtgtgctgttcagtgttgattaaaatttctgattaattactctactgttttactactcttaactctttgctaaatgctgcttttgcaaatgagcctatattatgccatcctttggtatccttgtgcacttgcatatttgctgtgtggcttgttgagtatgtcatatgctcaccttgcaataatcatcaaacctcagttgaagagaaaggatccagaaggagaagacgtttggcttataccccagttgagctgcctgtgggagtggagctgaagccatcgctagaccgttaattccgcagctgtttttcttttcttttgtaagtatgtaacgttattattatgatggatttgtatattaaattgtcagtttgtgtacctcggctgattcctggacgaggattttatgcacaaattagttcggaaattacttgtgaatttccgggcgtgacagtctatataaagcacccctgttccctcctctctcttttttgttttgcaatcgcccgctcccgtgcactccaccgccctagcgccgtcgccctcctttccgccgccgccgccaccactccggccgccgctagccgtcgctagccgctgcgcccagccgcgccgtcgacgccgtcgcattcgccgtcgtgcgggccaccccgtccacccctttcccgtcggattccgccgccggaacccactccgcactgtgcgccggtgagccccgccatggccgccgccttcggccggcgtcctcgccctcttccatctccctctctctctctctctaacccctttcatcgtgttcgctaagtggttccggagctcgtcccgttgctttcatcgcagggactaaggatgccaactgagctagaaaagccatctaacttgacatttatgttttctaggaccttgtcattggccgcaagctttttgcttagcgcatcggtggttttagcttgcgcaaaaacaagatccttcaaggagggctggttagaaaaattatcgttgttgttaccttcttgataatatgggcgtggttggttccacccctgacctccttatggatgatacccgttgttgttgttgcccatgtacatcgcctcctcacgggtttccgggcagtcattcccagaatgacccgtgttgccgcagacctcacatgtggcgtgagtgtccaaggccttgagggtgccttgtggccgtttctcatggtcgtccaatcgtttcatgaggaggtccagcttagcagcaagtagcatgcctcgctgacgggtctggagtcgttcctccctccaacccatattggagaccatcttctctattagatcaacggctccttgaaccgttttagagaagaacgctcctccagctgccgcgtccaggtgatcgtgggacatcggggtgagtccataataaaagttttgcaggatcagccagtcgtccatcccaagatgaggacatgcagctacgtactcctgcagtcgttcccatgcttccggaatagactcatcccttgtttgctggaaacttgaaatccttccacgaagggcattggttttgcccatcgggaagaatttcgagaggaatgccgtagagcattttgtcccaggtattgacagcagcaaggttggcatagaaccactgcttcgctctctgaagaacagagaacggaaatagtcgtagcctgacggcgtcgggactgacgcccttgatggtgtatgtgctacagatctccaggaactattgcagatgagcattggcatcctcatcaggcttgccacagaatgggctagcctgcgccatcgttatgaggctggacttcaagttgaaatccacttttgttgtttgtatctttttgatgtgctattcttttctaattaatagatcgttcttgatatcatgttgtcgaaaaagtttatgatttatgcactgagttgaaattgctagatgatattgaaattgatatcacatatatccagagaaattttcatcatatatagatatctattgatttttaagatattatattaagggcccctactttttgtttcgccctaggccatcgaaaactcaggaccagcccagatgatggctgtgacgatgacgacgtggtggcggaactcaacatcctggttgcacagagtggagcagcagggggggcatgatgtctcaacctatgggaacaccacatgatgaacggagaggaggaaatgatgaaagacttttatggtgtgcaactgcttaccaaccgtagcaaagaagaggcggcacaactttccgatgtaagtagcaaagaggagacggtagtagcaggaagatgatggtgctggaaacagaacgatgatggtgctggactgatcctcccatgcagccgctcgttctcgcgttgacggtttgatatatctccatgccaacagcacgatggccgtggctgggatttcgaaaaacagatcaaacccatcaatttgatttgatttttggtattgatcaatggaaatagatgaggagcggaagagacgagcagggaattgagggaagcatcatgaccttcatagcgaagcagaaacatcgtgcttgaagatgaagcagtagccaacatggtgactttggctgcacatggcactacatgcacgcacacggtgtggctgcgctggttaaacaaagaggaaaggaggaggggtgctgcagctatatatagagaagaataggagctaagcagccaggagaattggcttttacaaaaatggctcatgctcatgaaggtgatttaatttttggtgttaaataatgagattggtgagggagagggagagatttattagtgggaggacgaactcgaggagacagctcagatttttggaagatcagaaatgtggctgagggaggacgaagatggagagttgagagaagagactgggaattggaaaaacagatttgtctcatcatggtgattcaattggagataatgcagtgtaatattatttggttcttggtctgctttagtttcttggttgatgatcaacagatgattaaattcatggtggatggaaactgcaatcaactggagattaaatggctagcatttgcatttgatcaggagatctaaaggctgtgcatggtgaggtggataggaagaaggtggaaaactgatttggttcatgatggtgattcaatttttgtcattcaagtggagaaattaattagggaggagaagagattgcagagatagaatgacagggagagagatagagagagagagagaggcatcggcctggaggaaaaaggaaaaaggaaaagaaaaggaaggaatagaaaaggtggggatttttctggacttgggatttttttttttttgggatttatgggaaataatgaaatcgagttccacttcaaaaattcaaataaaaaccaagtaactctaattaacaaacgataaaataaaacggcggcgtaattaatttatttagtcacattaattttttttcatttataaaattttcattaagctattttaggcgaacaaacacgaatgtgattgattttttttaaaaattaagcaaattagaagacacaaaaaacgggacgtgacaccactccccttcttctccaccaggactatacaagaaacccactccgcataacgacatggcccaataaaccccgccttcaacaaccgatcaatctcctctttgactcggtcatatagcaaaggattaaaacgacgaggtggttgtttataaggcctaaaacccggtttaattggaagccgatgctcaacaagctcacggctaagacccggcatctcatggtactcccatgcaaagcaatcaacatactctgtaagtagctcgattatattaaccttataatcggctctcatatttttgtttacaaaagtcggccttggtttggttccatcaactatgtctacttcctccaatggatcggccgatgtaaacccttgtccaagcttctccacttcatcaaaatcttcaatagtttcaccaatatcgttctttgtagaccgatattcttgcaccctcttttgtaaccactctaaattagcctctttactcattatacaaatttatatggcttagctgtgctacactagccggctttatagagataggtacaaattttccatcagagatactaataaaatcatagttagaaagatccctccccgataagcattgaatattcccatgacgccactcaaaagtagcatcggccattgcaacctcggccgatgtatccgcttgaacaatttcaacatcatcgccgtcctattgaattaaacattgatgcaaggtagaaggcacacaacaattggcatggatccaacaacgacccaaaataacattgtagttaccttgcacatcgacgatgaagaaagcggttggtaacgtcttgttccccacggtaagctccgccgaaaagatacccttcgcctccgttggttcaccattgaagccattgagaatcatgttagtcttcttcaactcatcatcttcacgccccaacttcttgaacaacgagtatggcatcaaattcacagcggcacctccatccacaagcatcctagataccggctttccatcagtatgacatttgagatagagaggcttcatatgacggtttgattcatcgggcttctcaaaaaccacatctttaggacctagtgaaaattgagcaacctcggcttcatccatagcacaaaactccataggcaacatacataccttgttgatatccatgtcttcttttggagatgactcatctttagcaatcgattgttcttccttcttctctacaacaaccggttcttccttctctatggttttacgcctccataccggtggtggtcgcaactcattgaaccttttatccctttgctcttcagcctttttctctcttatttcttgggcccgaagacattgcaaccttctcctttgagtagccgttaaatacttaggcatcctcctaggtttcggctctgttccaggaggtaaataatgccccctattaggtctagttgatgacgatgaagccctcacatcgccctttgcaaacctcctatcaaaccggcgctggagcctggtcagaccggacgtagaccaccggtcagaccagccagatgcgctggtcagatcaatattcgatgggcggtcaaaccggcctgaggcgtcggtcggaccattgtcgggtcggcggtcagaccggcctgatggcccggtcagaccagccgtatggctgcggccgactgcgatgagctggtaccggcttcggattttttgcttgaggactctccaactttatctctagaaggtattggcacatcatgagaccctactttgatggtaattacctctgaagtccttgcctccactttaatgtgctttccttctcacctttcctcattggcccggttcttaccataaaaccggccgttgtttggtgaagacaaacgctcatgaattggcctccttggtcctccccacccttgattgaattgcattggaggcatatgattgaacattggcggcgttgccccccatggcatgtaataaggataaggataacccggcggcggcattggatagggaccccatggtatgtcttgtgaatgatgatatggaggtgaatgcgaccgtcttggcgagtgaccaaatcgctccctaggaggtgatctctgtattttccccttgttgcgagctctctcactaccttgcttttcatatttctccaaaagcatatcaagggtcactttggtcttcctaggagctttagaagttgaagcttcacttttattctctttacaaacacaaacctctgggttctttggcactattatctttggccttggttcaccaatgattactccttttcctttagtagattcggcttgctccggccgaatcaacaccttcttgtcattgaaattaattgtattcaccggaaaaggatcatgatcaagcttcatcttggagccatcggtgaacttcaatcgtccttcatctatggccaattgaacctgtcgtcgaaacacattgcaatcattagtggaatgagaatgagaatcatgccatttacaataagctcgacgtttcaattcttcttgagatggtatgatatggcctttaggtaatctaatttgtttttcttgtaaaagataatcaaaaatcttatcatacttggccacatcaaaactatatttaacctcactttgccgatctttgcgaggagtcggcattaggttagaacaaacaaaaggcttgtttttgttagtccatgaccattcagcaacatacatatcatgatcaccctcatcttcactatcactagcctcagggtaatcaatcacattaacattaggctttttctcatatggtctaacaatttttttattatccttaacccggctttcctgagccagagccctttgcataagttgactaacatcaagaaattgttggccatctagtctttctctaagaggggcaattaaaccattaaaagcaagaccagccaaatatctatcagttatattcaagctataacatcggtttcaatcatccctaaatctcttaatataatcaatgacaggctcattatattttttgcttaaccgatgttaaatcacgtaacctaagctcagtttctcaagtatagaaataatcatgaaatctttcttctaattgagcccaagtatgaatagaatttgccggtaaagaagtaaaccatgtaaaagcggtactggacaaagataaagaaaacaagcgcaatttaaaagtatcactattagcctcaccacattgcgctaaaaattgacctacatgctcccatgtggtcctaccatcttcaccactaaacttggtaaatttgggaactctataattacgaggaaacggcatattatcataatagtcaggatacggcttttggtaaaccttagcaagattcctagtttcaatcccgaatttatccctaataatcccaccaattatttcctccatattatcaggcctatgttgatttggtggtggatttggtggcctaataggttgtgtttgcggcgcaatatggttatattggacttgcctagtatcgggaggataccccctaccaacatcattataagcattaggaacatgtgggggaacttggggattagttgcagcactagatacaggaggatcaaatgttctaagatgatacaaataactagcattagtcattggatctatcccctgaattggtattattgcgccggtctgaccggtccagggcccggtctgatcgacatccagaggcgcgatcagactggcctaagtcccggtctgaccgccggggtaatacccggtcggaccggccgtttggcctgtcggaccgacagtgaagtcgcggtctgaccggccatcaggcccggtcggaccggctgtgtgcgccactccatcggttctactatttgtttgatctataggggcttggctagcagtggtagaggctttatttttacccacaaaatcggccaagagagggccgactttaaatcttaaaaactcatcaaatttatcctcaaaagttgcatctaattatctttaaaaacagtcatagatgaatctattgtagatgctacttgttgttggatagattgtgttacctcttcattgcttaccaaattgggagcgagcttaggacgtggccagggcttgatgatcacaccttgacgagtcctagtagacgccctcatcaacgcctcttgtgtgagctccttgatgtactcctccatggacttgcggtcttctccttcgaaatcattcaatgtgattggtatcacaatggccggctccacctccgccttggatgatggcggttccgtcatggcgaaatcgaagttgagttgacgttgaacggatctccccagtggagttgccaaaatcgtgttagcaactttttgtgacaagttgacaacaacgatcgcagcaccttatgccttgcggtgatcctagagtcgccaaccacctcgatctagcaaagagctaaacctagatggattttgacaaataaaccggctaatggagccgatttaagataacaacccgtctcatgggcaaaacggaaggttttcaggacaaacctacaaagagatgtcgcactctcgcagcggcggcggacggtttacggcgcaaaccgacaaagatggacaaactaagggaaaactaaaagcaatacgaaaaacgattcgattgattgattgtagattgtttttttacaatagaaccggccatgtcccttatataggggttggtcttgccctctacgggccctcctccacatccaactcggggtagaaactaaaggaaacccgaaacatgccttcccgagcaaggaaatctcgaaacccgacgaaacacaatcggactcggacctgtcagtcggaccggccacacaccgccggtccgaccggccgtcaaccggcggtctgaccgcccaacacacggcggtcagaccggcccactcgaaggaaaccggtagacttccaaattttggcaatctttcctattttaatcctaggtgccaaatttgggtgtaaacaattcctatacttgaatccgataagacatcgttgaaaaatagtttttcaatgaaggacttaggggaagcagcatatattctgggcataaggatctatagagatagatcaaagaggctaattggattaagccagagtacatacattgacaaggtgttgaagaggttcaacatgcaagattctaagaaaggtttcttaccgatgtcacatgccattaatcttgccaagaatcagtgtcctcaaacgactgatgagcgaaacaaaatgagtgtgattccatatgcctcggcaatctgatccattatgtatgctatgctatatacacgtctagatgtttcatatgcacttaatgcaacaagccgataccaatcagatcctggtgagagtcactggatagctgtaaataatatcctgaagtacttgagacgaactaaggatatgttcctagtctatggaggacaggaagagctcgttgtaaatggttacactgacgcaagcttccaaaccgacaaagatgattttagatcgcagtctggatttgtgttctgcctgaatggaggcgctgtgagtttgatgtgaccatggctactatggatatgaccattgctcacatcatgaatcaacaagaagacatcaagatcaagtcctccatgtgctgcaatctaattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggccgcaatcacagaagcaaggtgctgcgtcacctgtattgggccaatgggcttgtaactttgtttgggaccctggcccatgtggggtcctacatttgctaatttgattctaagttgttgtgagatatgagatagtaactaagagttgctataatcctagtctaagttcgacttaaattccggatgttttatttttcaaaataataacttatggagttcctcatttgatataaattcctaccagagccaaaaatattccatattgattaaaccatatatattttggttacttataattccattgaactttgtcaaattcttgtgacttgtgaacatacttctcatgatctatgatcaagatcatacatccacatatatgcacatgctaaactcctacactgcgagctagcaattatccattccatttccatactaccaccaaaaataaattcgccatgcttttatgcgctttcttctcctaaaaagaaaatcctttctgaaaaaaaaagagagaaaagaaggaggaaaaggcggttatgaaaataaagttatgctctctcaagaatgagcatgatattgaaaaaaaaagagagagaataatgtagccatgccctctccttatttataaaagaaggattttaggagtaagcacaaaggagaagcgttttttctttattttacacatttcatttccaccatatatcacacacacacacacactttgcacgatcttgatcttgagtatatttagtcatctattttagtctatgtttttgacttagtaataaatgtgaatgcaagtatgccatgtttgatccctaccaaactacacatatcaaccttagagtaggaatcaaaaaggcaaaatggtgaggaattcattttgatacacttggagagaccgagtgaatcatttgaggaacttggatttcttttacaaaaatcatttgaaaacttccagaataaaagttgaatgaagattgggtgattagtactctaattgttgttctgtctttcaaccgcttaaggcaagaagagacaatgtctcgtgggaatcaggggtaagggtaagccatcgtgccaaagattatttgatttaagagagagtacatatgccttgaacctatacatttgagatatacagcatagtagcaactcatgatcaacagccaagtctttgtttcctttcatcctttactcgtgacgagcaaaggttcaagcttagggggttttgttgacggtcgttagcgatcagtttcgaccgtcaatactaccaaaataaaggagaactagttatgcttacaatgcatatttgtattagaataataagtattccactagtactgggattgctaacctcttgcagagaatgaacataagagcatccctagcagctcatctatatttcatcccccaaatgcccatatggattacttcaccaagtgggccgaagctgtgccgttgaagaatatgactcatacggaggtaattgactttattttgaatcatattatccatagattcggtattccacaaacgttaactacggatcaaggtgcttcttttatatctaaggaagtgaggaattttgccgaatcttatggtattaaattgttgagttcttctccttactacgctcaggctaatggacatgccgagtcaagtaataagacattgttgaaactagtaaaaaagaagattaaggaacacccaaagaggtggcatgaagtgctttccgaagcattgtgggcgcatagaatatctaaacatggtgccactaaagtcactccttttgagttggtttatggtcaagaagccgttttaccggttgaagtaaatcttggttctcttcgttatatcaagcaagatgatttgtcaagtgaagattacaagacgttgatgggagacaaccttgatgaagtcattgacaagcgcttgaaggctttggaggagatagagaaagagaagaagagggtggccaaggcgtacaacaagagggtgaaagcaaagttgtttcaagttggagacttggtttggaagacaattttgcctttgggtactcgatccaaggagttcggtaagtggtcccctagctgggagggtcctaatcgagtatgtggcattgttcgatgaaacgcatattttttggagacacttcaaggggagcgttttcagcgagcaatcaacggaaaatacttgaagaaatacttcccgagtgtttggcatgacgcataggaggtactatggccggtaattggattatcgtactaagaccaaaacatgttctatgattttagattcacgttgttcatcaaaaaggcaggggggcatgtgtttacaaccaaatttggcacctaggattaaaataggaaagattgccaaaatttggaagtcttccggtttccttcgagtgggccggtctgaccgctgtgtgttgggcagtcagaccgccggttgagggccggtcggaccggcggtgtgtggccggtctgaccggcaggtctgagtccgactatgtttcgtcgggtttcgaggtttccttactctggaaggcatgtttcaagtttcctttagtttctaccccgagttagacgtggaggagggcctgtagagggcaagaccgacccctatataagggacatggccggttctattgtaagaaaacaatctacaatcaatcaatcgaatcgtttttcatattgcttttagttttcccttagtttgtccatctttgtcggtttgcgccgtaagccgtccgccgccgctgcgagagtgcgacatctcttcgtagatttgtcctgaaaaccttccgttttgcccacgagacgagtagttatcttaaatcggctccactagccggtttatttatcaaaacccatttagatttagctctttgctatatcgaggaggttggcgactctaggatcaccgcaaggcataaggtgctgcgatcgttgttgtcaacttgtcacaaaaagttgctaacagaaacttttggggatttcttggggatattgtagaggatcccattcccgcaactaatttggaaagaggagcaacgaggaggtcggattttggaaggggatcggcatcatcgggctctgctacagcgtgcactggcgggagacggctggagcttgaagtagtactatagcgagggggaggcaaaacagacatttctgcgggctgagagaaagggatagaatgggctgaattcggcccaagactaggaaggaagattttattgcttttccaaataaattaaccaatgagatgatctttcaatcgttaaaaatacttccaatgctcaaataattccaagaaaaatcttgaacatacttggacactctaagtatttaaaaatattaaaaccagaccattaaatgattaattttaatatgtgaataattattgaaatgttctttgtattattaaaattaggaattgagctccgaaaaatccgagaaaatttcagagagtataattaatcatggagaatttaataaaaattaaatccatacatgctttatatttaggaaattttatttcccacatttaacttcacttataaattagtgaacatttaatataatttctattaataatttattaaataatttataaatcctgaaacgaaaattcaggctgtgacactagttggcaccccgcgccttgccgcgggatttgctagttttatcatcaaataaaattaatattttaaatgattagatgcaactctgtatatatacaaaataaatggtaatctggcttcatagatagcctctgctattaaaatacaattaatgttttattttttataaatataattgtgtattgttatgatatacgaaagttatttttatgcacaatttggatatctgttaacgacgaaatttggtaagcccaaagtcatcatcgacttagagtcagtatcggtttcagagttatggaatcagccgataggagtcgtcaaatcgctagcacccgtgttttcgatggagtcggatcaactaaaggaaatttatccagaagagtccgacttcaagaaggatgtggcatggtagtttaactattaattaggaatagtttgttagttttcttttatctttaggaaagtgtgtttagtgttcgataaggagtttatgttttccttttatctttaggaaagtttctttcttgtctgacaaggacttgtatcaaccaatgggtataaatatgtacacccggggtctatgtaatcatctccacgatcaatacaattcggcgcatcgccaccttttaccttttctactttattttatcgtccggcgggacttggcacttgacgcggggctgcatcggtgctcgatctccggctaaggggtaagtccaatgatctgccggcctaggcaattgtatcgtttacgttggtgtcgttcaaggctgcatcagtacattcgacctattggattactcttgtttggatggtatatttgcctacctatttatcatatgtctatgttaatctagtcttagcatatcaatttagctctatcggctgcttctcgttttagggtttctgctggtatcggctaaatcgcgttgctagattatattagcttagacatctaccaccctgaaaactcagtcaacggcttgattgtctagatattatgtttcttttcatacttagtgctacatcagttaagtttgatccactaagtcatgcttagaaccataatctctagcctgcttcttgattgacaataagggtttcatcggggtttcaaccgaggagttatctggacgttgcatcggcttacaaggattgcatacgaattggatttagccgatagcgacaaaggtttcattgatttatctaatcgtttggattttatgacatcggacctgcagccaatgtatgctttaaccttcggatcagtgcttattctatcatattgttagccgattggtttatactggattatattgctatattatattatcagccgattgccttcatatcattatatacattggacatatagccgatagctcaaaaccctattgctatcggctggcattgtcatcggttagaactacaacatcggcttgtcagccgatcggctgtttgatctactgtttacatatcttgtcagttgcaggatcaaactgactggcacgcccgcatctcaccaacctttggacctgcactggagctaagcagatctcccaggccaatgtgtgtttttggcatcaacaatatcatcaaattagggtagtttgcacctctttgcttttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15769 - DNA, 735 bp, Oryza sativa
agtatgaatagaatttgctggtaaagaaattaaccatgtaaaaccggtactggacaaagataaagaaaacaagcgcaatttaaaagtatcactattagcctcaccacattgcgctaaaaattgacctacatgctcccatgtggtcctaccatcttcaccactaaacttggtaaattcgggaactctataattacgaggaaacggcatattatcataatagtcaggatacggcttttggtaaaccttagcacgattcctagtttcaatcccgaatttatccctaataatcccaccaattatttcctccatattatcaggcctatgttgatttggtggtggatttggtggcctaataggttgtgtttgcggcgcaatatggttatattggacttgcctagtatcgggaggataccccctaccaacatcattataagcattaggaacatgtgggggaacttggggattagttgcagcagtagatacaggaggatcaaatgttctaagatgatacaaataactagcattagtccagggcctggtctgatcgacatccagaggcgcgatcagaccggcctaagtcccggtctgaccgccggggtaatacccggtcggacctgccatttggcctgtcggaccgacagtgaagtcgcggtctgaccggccatcaggcccggtcggaccggctgtgtgcgccactccatcggttctactatttgtttgatctataagggcttg

SEQ ID NO: 15770 - DNA, 705 bp, Oryza sativa
ctaatacgactcactatagggaaagctggtacgcctgcaggtaccggtccggaattcccgggtcgacatcatcatcatgatcgctcgacatcgatacgactttgttttttttttttttttttttttgcgtgtttctaaagtacaaattcagtttattcatctgtttatgacacagtacacaggaggcaaagtgtttcacatcatagacttcactttcaactccttggaatgttcatttctttggcttacaggagagacttgacaggaaggccaggcaatgcttaggcaactaaaatgaggttgggggtaatgctaacgtcaccctcacagggatggccacggggactgttatttgcaagctggttttctagacctgttagctggaagcatggtgagcaccatttttggacgctcaggccgtgtcgggcttcagtcatctccaccacacaggtacagcagcgctttctggtagtcgcccttagtgtcttgctggatataatagtacagggacttgccgtactttctcttgaattcagacctaattttcaacatgtccacttcactgcgggagaccatgattctgatcaggaccttatctcgcgtccccttgcccttctgtcgtcttctcgcagccgtatagtagtagtaggcggccgctctagaggatccaagcttacgtacgcgtgcatgcgacgtcatagctct

SEQ ID NO: 15771 - DNA, 57929 bp, Oryza sativa
  unsure (1)..(57929): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtaactaatcgtgtaggggattttggttgttattaggaattctaggttttttttggataacaggtagtttagagtttcgggatttgtttaaaatagctaataactggattcctaataatgagattaactccttgcttactattttgtgtgcttttttattattccttggtgcagttgcgaaatcggcacaattccctcttcacgtatggttacccgatgctatggaaggacccacccccatttcagctcttatacacgcagcaactatggttgctgcggggatttttcttatagctcgacttcttcctcttttcatatccctacctttgataatgagtttcatttctttaataggtacactaacacttttcttaggagccactttagctcttgctcagagagatattaaaagaagcttagcctattctacaatgtctcaattgggttatatgatgttagctctaggtataggttcttatcaagctgctttattccatttgatcactcatgcttattcgaaagctttattattcttgggatccggatctgttattcattcaatggaacctcttgttggatattcaccagataaaagtcagaatatggttcttatgggtggtttaagaaaatacattccaattacaagaacttgttttttatggggtaccctttctctttgtggtattccacctcttgcttgcttctggtccaaagatgaaatccttagtaatagttggttatattcacccttttttggaataatagcttcttttactgcaggattaactgcgttttatatgtttcggatatatttacttacttttgatgggtatttgcgtgttcattttcaaaattacagtagtactaaagaggattcgttgtattcaatatcgttatggggaaaaaggatatctaaaggagtcaatagagatttcgttttatcaacagcgaagagtggagtttcttttttttcacaaaatctatccaaaattcatgttaatacaggaaataggatagggtcctttagtacttcattggggactaaaaacacttttgtctatcctcatgaaccgggaaatactatgctatttcctcttcttatattactgctttgtactttgtttattggatctataggaatccattttgataatgaaataggggaattaaccatattatcaaagtggctaactccctcaatcaactttttccaagaaagttctaattcttccataaattcatatgaatttatcactaatgcaatttcttctgtaagtctagctatttttggtctattcatagcatatatgttttatggatctgcttactctttttttcagaatttggatttaataaattcctttgtaaaagggggtccgaaaaagtattttttccatcaactaaaaaaaaagatatatagttggtcatataatcgcggttatatagatattttctatactaggatctttaccttgggtataagaggattaaccgaactaacgcagtttttcgacaagggtgtcattgatggaattaccaatggagtaggtcttgctagtttttgtataggagaagaaattaaatatgtagggggaggtcgaatttcgtcttatttattcttttttttatgttatgtatctgtgttcttattcttttttctttcttaaggaattcccctatctcctgcctaagtagctttcctatttgccgattttttccattcctctgtgtaaatagcctaatatgggttcacaatcaataacatcttcaccatcgagagtaacgatcagtcgaagaacaccatgcattgatgggtgctgagccgaaccgtgcttatctctggttctggttttttccggtcgaaccaccggttcggtccggttttttctactatgctcagaactcatggtgatgtctttctagacatcttgtgtaaaaaccagagctctgtatgtggtagtagtacaccagtaagtgtttgccttagtgtttgtgtagcaagataggctcctgcactttcttttcgttgaagtaatgcagtactgctgtggtgcttgtggtttgtactactttttatcatctttaaattggtgcatgttaagaatgatgataagactaaaataagaagagaaaagcataatgaggataatataactaaatagttttattttaatattacctacattgattattttatagtaaatctgattctttcttaccattttgagattcatccaatgatcatttatgtattctggctaatgagttgaatatgatagatggagcaaaacaacaacaacaacaatggtactagtcaggatggaaataatactagtcatggtgccactggattaataatacctagtgcaagtaatcaagacccttgggctaacttactcgcaaatatactgggcaagcaacaggaaacccagcaacgacagatggaaattttagaacgtattactaaaagtgatgctaaccggaatggacttggggaatttcagaaattaaagccaccaacattttcaggaactgccaatccactcgaagcggaagaatggattgtagccatggaaaagtcatttgaagctatgggttgtacagataaagaaaagattatatatgctacctatatgcttcagtctagtgcttttgaatggtgggatgctcacaaaaagtcatattccgaacgtatctttattacatgggaattattcaaggaagctttttacaagaaatattttccagaaagtgttaagagaatgaaggagaaggaatttctagagcttaagcaaggtaataaatccgtagcagaatatgaaatagaattttcgagactggcaagatttgctcctgaatttgtacagacggatggctctaaagctcgacgatttgaaagtggattacgtcaaccgctcaaaaggcgcgtcgaagcctttgaattaaccatattcagggaggtagtaagtaaagcacaacttcttgagaaggggtatcatgaacaaagaatagaacacggacaacctcaaaagaagtttaagactaataatccacaaaatcagggaagattccgtggaaactactctggacaaatgcagagaaaatcttcagaaaatcaaggcagaaaatgtcccatatgccaaggtagccatgttccatcaatttgtcctaattgctggggaaggtgctttgagtgtggagaagcaggacatactaggtaccaatgtccactgttacagaagggtaaaaatcgagttagttcaactactcagccaaatactaaagtattgactccagtaccctcgctttatttacctggaccgtcttcagcaaataatcatgggccaaatcaaggaaagccacttgcaaatactaataccacacgaggaatgcggtcgaataattcacaaggtgggaatcatgctcgggtatacaacttaactaagagcacagctgaagaatccaccccggtggttacaggtaatgtcttaatctgctcttatcctggtaaagttttatttgattctggtgccacacattcgtttatctccaccaactttgtgagaaaatacaccatccctactagtcagctaaaagaaagaatttgcatagaaactcctttggatagccaaacaactaatctaatttgcaaattgtgtccaattactattgatggatgggaattaactgctgacctcatacccttggacatgcatgattttgatattatacttggtatggattggttatgtaagaacaaagcacatattgattgccatggaaaacagattacacttaaaccatgggatcaaaaccaaattatttactatggagatcaaaaccatttacctagacctttagtggcagaaatcatgagaaaggaagctagttgggaaggaataccagttgtgaatgaatttctagatgtttttccagctgaattaccagggttaccaccagattgagagattgaatttggtattgaaatagtaccaggaacttctccgatttataaggcaccctacagaatggcccctgttgagctaaaggaactaaagttacaactaaaagaattagaagataaaggattcattcatcccagtgtctccccgtggggtgctcctgttctatttgtcaagaaaaaggatggaagtttgagattatgcacggattaccgagaactgaataaggtgactatcaaaaacaaatatcctttaccaaggatagatgatttatttgatcaactacaaggagctcgtgttttctcaaaaattgatcttcaatcaggctaccatcaactaaagattaaacctagtgatatacccaagactgcttttcgtgcacgctatggacactatgaatatctagtaatgccatttggtttgactaatgcaccggcagcttttatggacttaatgaatcgtatattcaagccttatcttgatcaatttgtagtggtattcatagatgatattttgatatattccaagactaaggaagatcatgcaaatcatttgagaatagtactacagacattgcgagatcataaactatttgccaaattaaagaaatgtgatttttggatggataaagtatcattccttggtcatgttatttcgggtgaaggtatatcagtggatcctgaaaaggtcaaaaaccatcacggagtggaaaaggccatcatcggtaaccgagatacgaagttttcttgggttggcaggatattaccgtcgatttattagtaacttcgctaaaattgcagctcctctaacccggttgacacagaagggagtaagatatgagtggactcagacttgcgaagaaagtttccaagaattgaagaatcggttaaccacagcacctattcttgccttacctattatgggagaagaatttaccatttactgcgatgcttcaaaaattggattgggttgtgttcttatgcaaaaaggtaagctaattgcctatgcttcgcgtcaattaaaatcatatgagaaaaattatccaacccatgatatggaattagctgctgtcatatttgccttgaaaatctagagacattacctatatggggagcattgtgaaatatataccgaccacaaaagcctaaagtacatatttactcagaaggaattaaatatgaggcaaaggagatggttagaattattaaaagattatgatttgaatattaattatcaccctgggaaagccaacattgtggcagatgctttaagtcgaaaggctctctgtaatatggctattcagatcacacaggatcaacatatacttagagacttggaaagattggatgtggaattaaagatccatgaacccggagtattattagcagtgctccaaataaagcctactttagaagaaaatattctagagaaacaaagagacgacagtgaattacaaaaggcaaagaaaaatattgaagaagggaaggtgtctgaatttcaaattgatcataatggcgctatacgtttcaaggacagattgtgtgtgcctaacgatcctgaattaaaacaaaaaatattggaagaagcacattcctccccctataccatacatccaggaagtactaaaatgtatcaggacataaaaaggtatttttggtggaataacatgaaaagggaaattgccaaattcattgcataatgtgatatttgccagcgcgtcaaagctgaacatcaaaggccagcaggactgttacaacccttaagtattccactatggaaatgggaagaaattagtatggactttgttcaaggattacctaccacacctgccggaaatgacagtatttgggtaatagtagatcggctaacaaaatctacccatttcttaccggtaaaaagaaatttttctttgaaaaagttagctaaactatatgtcaaagaaatagtatctttacatggggttccagtaaggattgtgtcagacagagatacccggtttctgtccaaattttggaaaagcttacatagggccccgggaacaaaactagatttcagcacagcgtatcaccctcaaaccgatggacaaactgaaagggtgaatcaaataattgaagatatgttacgatcttgcatcctagaatttaaaggatcatgggaagaatttatgccattagcagaatttgcatataacaatagttatcaatctagtatacgaatggccccgtatgaagccttatatggaaggaaatgcagaacacctgtttgctggaacgaagtaggagaaagaaaattgctaggaccagatataatacaacagacaaaagaaacaatacgactgatacggaaacgactgcaaactgctcaaaatagacagaaaagttatgtagataataggagaagggatcttcgttttgatataggtgactgggtatatttaaaagtatcacctatgaagggagttaagcgatttggacttgggaaaaaattaagtcccagatatgttggaccatttgccatcgtcaagcgaattggagaggttgcttacaaggtgaaactaccagatgctttgatcggagtacatgatgtatttcacatctccatgattcgtaaatgccttcggaggccaagtgatcaagttgaaattcctatggctgagttgcgtaacgatttaacatatcaagaatatcctgtttgcattctggatactaaagatggaaaaacaagaaaccgaaacattcgatttttaaaggtacaatggagtcatcacactcaagatgaggccacatgggagaaggaagatgatttgcaaaagaactatcctcagtttttccatcaccaaggtacaacaatttcgaggacgaaattcctcaaggaggggagcctgtagtagtagttagtagtagtagtaatagctgtagcagtagggaaccgttcatacagtcttgaattgttttgggaggaggacagataaatatcaccgaggttaatggataggatcgaaccctttcagtgtaaggaagagggagggtgaatcctatccctatcatcatggcttggacaggtgtctgcttcacactgaaggaagctgcactatttaagccgtatgtgagcctacaactcttgtccatcagtagtacttctccctgctctggctgtggcgagagttctgtgagacacttgagagtgtagagctaatagaagcctttcaggtaatacatggaaccttgtcctttggttttattgagtgcatggctagaataaacatataatgtctagctataagtagagggattagtgtagaaaatatacctgttagtgaaaagactaatgctctggctagcagcagctacatgcatgcatgcaagcatctactagtactagttggttccctccctctagtatagtcacatcaactagctatactctagtaggctgttagtagctattatgcatgcaaatttatacattgattaatatgaaagatttgcatatttgactaggtgtgaggcaccggtaaaacagcaggaaaccaggcaagactgcgcccatcaactaatttacttaatcacctctaattgaatttgtttacctgcattatattaagatggtcgtactaacaatctaacaataaacattattaacactcgaataatggattgacgatttcatcagtgagaatcataacgtgattatgatacttagcctgagacggccgatacctgaaataacgatatcgggttggctgatatcagtgtgagatgaggaatacctcacacaagtagggaatccgacggcgtgattctcagatgagggtatcactaattgggggaaaaacggattgaaggaacgagattataacgattattttaatacctctgcagtgtatttttaattcatttactatgtttaatgtcctttattatttattggctattaatatctatgggtaatagtatttttcttctgtctttataaacatatatatatatatatatatatatatagacacacacacactaatcttgctgagtatgtataacatactcatatatcattactatttgatgtgcgcagaaactagtcaagatgagatgtcagaggggaatgatgacatgcagacctagtggggagtgtggtctacttagtctgtagagacatccagaggtcatacttgcatgctaagcatagggttttgtcctagtgacaataagttggtcagtgaaccaaccgatgtaatatgtagtgtagctggtaaaaaaaaagtaataataataaacggaaccactgttgtaggtgtccaagctccagttgtgatggttagacattgcatcttgccttgtatccttgtagacatatataaatattagtatatatgcgtataaggatacggcagactgtcagaaaaaaaatgtatatatatatatatatatatatatatatatatatatatatatatatatatttgggtcgtgacaaaaaacgactagatgcgctacaataaactgaaaaaagggaagagaacaacacatgtttatagatgatgtcgacaagagaggggaacatgataatgatgtgtaaatgggaggggaaggggactgaatgccatctcaagcattggggctgcatcgtgtttgcactcaagcatcctcacggctgcactggttgagtaccagttggcgatttttgcactcgcttgtccaaactcgcgtgtcgctctctacacttgagatgtgagccaaggctatgtgttcaaccaaacatgcctgtaacgtgcaagtcagaggtgaaggagaagtagaggtattactatagtaattatcccgtgctaacgctacggtggcatttaataacgtaaatcaaacaaccaaaaaaatacaaatatgttttgtgataagactacaatgcacagtatagtttcaaaatcatgcaagaaaatgagagcgctgagctgtataaacatttatcaaccttttgtatatacattataaatgggtccaaaatagatgtgtccgacaatatataataaattccctacaaataattacttatcaccatctttgaccagtagtgaaacacatactgtttgctatagatcaataataacaaggcaaaatattatataaacaccatcatacttcgagcatcatcaattcattcgggcagacatagtcagtgcaaggctagtttactcaagacatgttgatctctaaaaatgagtttgcacagcctcagaaatataggagaaaacatattcacaaatcttaaagtacaaagaatttaaatggaatttaatggttttatgaaaataatctgacatatacaacggtgtgaggatggcatccaagcaagtgatgtctaaatgatacaaacaggttggtgcagtggtgcaaaagctgctgcagcttaaaacttgaaggacttgatgtatcacattttggctgtagaaactctctgggttgtcatcgtctactgagattgaagagtagaatcacaacattgtagtattacgcttcgaaggaagtgaaaaaaatgtttgctcaaagtttttccatatcaatgcatacccagtatacttacttaccaacaaagattgcttattctttgagtaatgaataaatcataagggcaaaatatataaaaggtacagaaaaatgttcgttagaagtttcatgaaaaacaattattgatacgttcatatttcacaccataattttataattttatataggctcctaaaacacaattcagatatcaaattaataaaacagagagaacttgcaaaaaacaagtagagttttcatcaaagaaaataatgagttcaatgattagtaatagaggagaaaaccatgctgaaaatgtgaatgtaagttgtgctcacgaccaaccttgagcaggcagagctgttacagacccatggaagatgcgcttcaacagggaaaagagagctatgtgtttaacgttcaattaactgaatcccaattttagtgattaaaatccatcggataagcaagacaacaggaaaaggctacagaaaacaagaaaatttctgaaccacgcacctcttgtcaacaacatcagttttgttcccaagcagaacaatgatttcttcttgatcacctttttccctctaatggaccaaagctgtaaattgcccttgttctgcacatgtgaaaaacacttagcaattcatgcacatgcaaatctatacgaatgtgagtatcaaacagaacatgttagcagggtatttattatagaaaccaaatacagaaactatgaactcattctgaggtgataacttgtgtttctctataagtcttgaaacacatttctgaatataattgaagatgacaatggtttatgagtaaatatactctatccaagtgaattaaattaatatccatttaaattaaactaatctttttttctacaaccagaggagcagcacaatctgaagttacatttgttgaatcctctcagaaatccaggcatcaaacaaaagtactatgcaggctggcagacaggagataacaaagctgtatgacaactttacaaactcattatgctacccctcacaaaaaactttacagttcactaccagatttttaagatgtaacttcagattgcaggacactaacaaaaccatatttgtcttgcaagaattttaaggatgacaaactggtaagatttatgaacaattttgcattattgtcaatgatacttttaagggcgatgcttagtagctacattaccaattgtaaagttaaattcagatcaaatattattaggataacttcatataaggtttatctgaaacgatgtaaaacaatatgatttgttcagcttaataggctaactgttttccctcgtggttttaatatgaagagcgatagttgaatagtaatggccatttgaaaatataggagatatactgaataaaatcataaacatgtttggcagtaacacgtgtataatttgctgatatgtttaaaaataaattaatcagagacatgagatctaacaagaagctatagtctataaactgtaaaaccaggttatgtcgggaaagtgaacattaggggttattttacctagaaagaacgtatataaaggtgctgcactaagaacacgcaggatggctgtagcctgcaagaagatgggatcaagcaaataaattggacataaatgttttaaattcaaaagattgagattaacagagagatatgggatcttgccttcgccagctacgcgattccctccttgcccgcatccgccgcacacaccataccgtcatggtccacgggtgtaccacctcattacagccccgcccttggatatcgaggtcactccattcgcggtcatcctcccaggtgcactgtacattgtctatattatacaataataaataaaaatgtacagatgattaagtagtggttgcacagtaaactataataatagccacatgtttgagcatcagattaattatagccatatgtttacaacgcacttggatgccttctcaaattctgagataaaactaccaggtaataaattattctaaatccaaatagagtataaattattctgaatcatcttaagtaatgttgactgaatttaaaacctgttacaaatgagatccttcaaggttaaagaacaggaactacacatatactcacaaatagagtttggttcttcagtaatttatctccaagatttcagtctccctgtatttcacaatattgtagcagcacaaacactctgtaataatgctgtgaaaagaaacccttttagtatttagtatatagagcataaactatgtatagtgtgaaattggatctttgcttttatttaccccatcttttatatatgctgcccctttccttactgaagcctcaaacttcaaacttcaaacttcgagtgatttaactcatcactgacacttgatgcaaaggatacaaaacaatgctataaaaatcaaatgatataattcataatttagacggaaatttgtgaagtaactgcaaccgatgtactcaaaaggactcaaaactaacataggaaggaaatacctgatgaaatttcctcattcataggtagaatgaatgtggcttgccgtacttctccagcactaaatcaatgccggacctgggtggcccagatcattgttaaggggatgtcggacgaggtggcgacgagtccccccaacgaagagaccttcgtagatcggcggcggcaggggtatggatgagcttcggcatgtgtggaggcgatgaagttggcgctggcctggctgtcttcagctcggtagtcggcgagacggcgatggtgttccagcggcgccgatcgtcggcggcgttgatttggagggggggggaggaggaggagcgtcggcagggaggggcaccggcggcgtcgcgtgagaaggagaggattagggcgtggtggagagaggcgcgacgcgggcggcggagccggtcggtggtggccgcggaggagatcgtcgctggctcgatggtcttcggcttcgacgattagagttaggggcgaggcagcatcacgggtgccgcggcggggagtggggcggcgcttgcgggatggaggaggaggtggcagtggcgaggggagggggatcgatttgggcggcacgagagtctgggaggaggagagcgcgtgagagcagcgagcggcgtgatttctgcgagacaacattggattgggtgatgtactgatgtgcgtgcgggcgggctggggaaacgtgggacgatctgaggcgttggattgaatgattctggatcgtcggatttgatgaatgagtaatgtaggggtaagagtgagttggtgaattatagggtagaagattcacattgcaaaactgcattgttttagcctgtatgctacacttgagaacagtattttggtgatggggtgatatttggcgaaagtcttgtggatttgtttttttcacaagatggcataatcccaaatttgtcgagaaagacgggaagagattggtttgcttgatttgtgctggccgtgtggtagacaaacaagcgaagtcctccggaatatccaggataaacaagggaagagaagagccccactttttattttccggctcaaatatccgaatctcaccattcaagattcaaccaaccgaccaatgcccctcgcgtttcgtttctcccggattctcaatccgcgcctcaacccgtccacgaatcttggcctcgcgctcgcctcctctttctcctcctcgtcccgcccagagcagccggagctgcccggggcccgcggtggcggcggtgggttcccggcgaccatcagggaaggaagggcggagatcttcgccgacgactccaactcggtgttctacaacaaggcccaggtcccgcctcttcgcacattttcccctttgtttgtggctgtgtgggtttggtgttgttagggctggagtgggcggagtgggcacacttgtttgtttcaatgctttcagagactggagctgttgtgtgacacaatacgcatttcgcagtaataatattgccaagatgaagactttgacttgaacttcgtctttggtctaggcacaaatctatcaaagaagatgggtactgcagctttattttgcatatattatctgccctattagacccttggatgctgtaattgtcttcgcacgtttcctctgtctagtcaataaatcagataatagttggtatgaatggtttggatttctttcgaagacggctttaaacaaatgtttccattgttgcacttatgtggttttctgaactaaaattgtcaggttaacaacagggatctttccattgctgtattgagatcgtttatttcgagaagacgtgaagagcatgatatccaattaagaagaggtatttagtttggggaaaaaaaaatgcactacttattgctctactacccatatttctctaattgcttcaccagtatatccaaccattaccatgatgaaccaggcagtcatgctgaactaccgccgaaacatcacgctgaagaattgggccacataagaggatcatctgaggacaaggcattgagtgaagaaattagctatagagcaccaaaagttcttgaggtacattactgaattcttgcgctgacacacatatgcgcgctcgcacatgccgacacgcacgcaagcaccctcatatacctatacctgtacttgggacaacagtgtataatgatggtcagacaaaacaattatgaaaagaattatatttgatcctggattgtttgtttaaacatattttatgtagtttagtttagtattgagattcatccattgaatagatagggtaaatagagcttgcatagttgcatatacaatcttggttctttctcttcagtttctttttgtcatgggtcttgcaggctttagctgcatcgggattaagagccattaggtatgcccttgaagtagatgggattggggaagttatagctgttgacaacaatgaaggtactcatattatacttctatgacaatgttgcggatgctttttcagaatttctgattactagttttctaacctttgtatagttcaatgaaccctttgttctatatgatggttgtaaaaaaaatgttttatcaattgcagtagctatagaggctgtaaaaaaaaatatccaccacaatggcagtgtggcttcttcaaaggtggtacctcatcttgcggatgcacgtgtttacatgctcacccacccaaaagaatttgatgtggtatggctttattacttttaaatgtatatgttttatcatcaagaataattaagtggcaattaattaggtatggtattatgttgctagctagtctgattaggtagaacaatacttaaacttgtaccaataaagaaatatctgtttgctgccagtcctttcacagattagaaaattaaatccagcagatgtaggctgtgttcgctggatcatgttcccaagcggaacagtgtgcacggaaaacggaacggtctattagcacgtgattaattaagtattagcttttttttttcaaaaatggatcaatttgatttttttaagcaactttcgtatagaaactttttgcaaaaaaccgcatcgtttagcagtttgaaaagcgtgcacgcggaaaacgagagagaggggttgggaaaaaggggtgccgaacacagccatagaactcttctctacatacaggcatgattcataattcgatgtttcaataaaccacatacaggcatctaaagttctacagattttgattttcttcttttatgcttccaacctgtggatgctaatatctcttgcttataaatcaaatacttgaaggcaactacttaaattgtactccctccatggatatttatacaactttttttttgtttaaaaaagtcaaaagttttatggactttgaccaacaattagtcaaattacaagtacatttagtgtgtacaaaatttatcagagactcatattttgaaatgttttcacaattcacaaaatgttggttcaatagatctgaaccatttatttcgtgagcaatcgattgccaacgtttaatcttgaagacattttcaaaataacatatgccacaggtaataactacaatttagccactcacacaatttataaaaaactggtatttaaggtgagtattaactcaaccaaagaacattaaaattaccatactactcatatttaagtacattgggaatgggtcaaacaagagaaagaagcaataaattggcatgcatgtgttagagaaagaaacggagggagtaatgtgttagcgatcaattattgaaatgcaattttatggatgtaattttgtcttgaagtgactaatctagatgttactgtatgtattaatggttgaaattttgaggtttacatgtttattatccaaggcagtcaattgcttgttctaagttattaaaaaaaagtaatgtgacattctcctcaatcctcatctttttccatctcatctgcacatatactttgtacatatccgattccaggggaaatattatccatattattctgtactaatgctatatacttcttgaatcaggttgaccttgacccttatggatctcctgcagcatttctggattcagcagttcagtgcgttgcagatggtggtattttgatgtgctcagctacagacatggctgtgcttgctggtggcaatgcagaagtttgcttttccaagttagtttcaagcattaaaatcaattgctgaacataggactaccaaatccgaactatgttgatattttgtacctccaggtatgggtcttatccactaaagggcaaacactgccatgagatggccctgaggattcttcttgcttgtattgaggtaagacttgagttagttttcttatattcccttaatgtcactataactgggattttttttttgttttttcttgcagtcgcatgccatccgccacaagcgctatatagttcctataatatcagtgcacatggatttctacattagggtctttgtgcaaatcttcacgttgtcccctgcttatacctttcgttgacgcattccatccttaggatttatgttatttgtgcaattctgattattttttacagcccacaatacatttacaagtgtgccctctccatgcagttcagctagcacagtgaaaagctcacctcttaaattggcacatgtctatcaatgtaccggatgcagttcatttcacctacaaaacattggaaggattaattcaaaggtagtcttttcttatttttgtttcattgtcttgcatgatgtgcttatggatataatccttttctttttcttcaggacaagaggaatatcgccctaccaaatttttcccctcttgtgcctcaggaatgtgctgaatgtggccataactttgttatggggggacctatatggagtgatcctatgcatgacaaagaatgggctgcttccatcttgtcaagtatccaagctatgagttgtgcatattcagcgtatgcaaagatttcagctataatgacatcagtatcagaggtgatgcctatttttctagttcattttgcccttgttggacatatactatgtacactagagaaaatccacagatatgtactgcctccgtttcaggttataagacttctctagcattgtccatattcatatagatgttaatgaatctaggtacacatatatgtctagattcattaacatatatatgaatgtggacaatgctagaaagtcttataatatgaaacggaggaagtaagtagcaagcaagggttctttttattatgtggcagtgtaatgtgcaagcactttttttggtgataaaaccccttgatacagacatagagttagggtagattccagttgtattcaataaattacaacatatcattctatgaaaaacataaggaatgttgatttttttttttttgtatctgcaatattttgtgcttttgtggatttttctcaaactaaatacaactgaactaccaaaatgcaaagctggctctttcgtttgactttgtatctcttatttaactaattcaatgtatggattacatttaattatttccatctttacctttagaagacattttttactctgctgctattccaaagtgtaatttgacacttagtgatattccctgcttcaattcaataaactaggaggctacatctcgattggaagttatatgcaaaattaaaaatcctatgcaagttatgaaaatataactcagaaagaatacaagcaaacgaaatagttgactttttttctagacaatgtacttttgactaaacagaaaagcaagcaaagcagaacatttcatccaatttcacttacttgtgacacgtcaacgcctgcaccaaacaatgccaatttctggctacataaactacataaaaagatcgaaaacttctggctagcatcatgtttgcattttgtagtatcacattcctcatgctccaattgcattactgctaccattgttttgatctaatgatattacccattctgggtctaatagttagcaatgaaatctgtagaaaagatgtaaaatttctctgcaatgcattctgacaattagccaccccacattcagcacctgttgcttgcatggtaacacttccatacctgatagaaatggttaatccactctgaggtgagtatggaaagaaaagggtgtgaatgcgtactttaaaatacagctgattgatctggtcacactttctgtctgtgtggaatgttgtcccactttgtttcttgaccaccattgcaatttgaatatgataatcttcagccgcatttcctcactcatattccgtagttatattttgtatgatttctttcacaacatgccctgctgaaataaaatgcttcatctcaggaataaaaaaaatatgcttattgcctaatcaactctacttccacaacagttttgacatatccattgaatctgtaaatcataaatgtcattttcttgtgcaggaattgcctaaagcacctttatttgttagtcttcacaatttgtgtgcaacactgaagtgcaccaatccaaccattgctacgtttcaatctgctatcagaaatgctggttatcaaatatcaggcagtcatgtggatcccttggctcttaaaacggatgcccctatgtctgtaatttgggacatcatgcgatgttgggtataatgaaaaactgtattggtttgatgttagtaagccagagttcatggtgaactgattcattggtggtttcctcttgcaggtcaagattcatgctgtaaagtatcgacctggaaatcatccaggtaccaggatactgtcccaagagcctaaattacaggtatatttggtttcatgtatgcttttcctttgtcctggagatctggcctacttcccacctggcagcttgattgcatttttatgccagtaacagttggaagcaaatttgaccgttggaatttaaatctgtataagtagcttaaagtgacatttttatggggtactatgtctctctgatggaaactgttatgatcccttctaagttagaaacggttgccatactagcctgctgggatttaatttagaatagtagaataaagtactaacatgttttacctagtgctagctatcctgttagaaactagtaaatccttactgatatttcgtgcttatttgctgtgattaaaatatactttataattattaatcctaaaattatcaggtcaactccacaagaaatttaactaatattgtgttcttcagatatttttgtggactactatgcaagattttctttcttctcaatggctatatttttttaaaatatcattcacatagaataatataaaaaggtatatccagaaattcaaattttgtgtaagaccacattggttcaattgctactcttttaaaacaatattgtgaagagctcatacatacaaccacaaaagatcctctagagtgggagtaattgtataacgtactggactcattttactcctacaagataggatatttcaaatgaaatactatatttcaaacactaatccaatgttactttagtttatagttgaattgattgaatcttttctccgtatcttattgtgagctttacgtatccaaattatactactacaggcaaaattttcccatgtacctgggggtttagcagtacagaagagcccaagatttgtacctaatcctgaaaaatattggggtcctaagacaaaggctgggagacaaccaaagagattaccagtggacaatttataaatatttactgacagtatggttgcaaactaggagattgagatcagttgcattcttttgttagaaaaccgagcatatacaagctcaagttcaagctcagtttctggaggcatgtatgtcctttcgaaaatttggtggtcattacagattactaacggtcagttgcgtgggttggtgttaactacaggcatgtccactttgctacaattttcaactgcaccaaactctggcattgccaaattttgtgaagatggcaatccaaacatatcctaaatactctaccataccttaccatgccaatatttggtgattttctagaaacttcacataataccaaacaagaatatttggcaaggtaacaaatcaaactacacccatatacctctacctttccaaattttagcatcgtcaaacattgccaaattttggtgttgccaaaagttggcaagatttattttggcatcaaagtgaacaagccctacattttcattggagtgctattggcatggtttgaaattattgtgttgtcaaagaatataatagttgtttctaagtgtggacaacgaaagtaaatatctgtattgtttgattcttagaactctgcccttgcagtgtcccttgggagcctatttatagagctagggttttgcttacacagttttacattgcttatattgttatcctttgataatgacattcagggcttgttcggaatggagggatttcacatattttttgtaggattggttattcctttggatttggcactgtttatgcattcggttcaaaggaatcatgcgatgaattttgtaggaatactgtagcaaccctgtgaaaacgtaggaatttgatagcattatgaacatccactcaaacctcatttcttttcattagctacacgggatggatgctaatcatgttggagtgactagatgggaaataatattttattgcttaattggagtttaatctatcagattactgctgattggaaaattccaatggtttatatattcctgtgttccgaacactcctacaatcaaattcctatgtttttcaatcatatgttttgcatatgcaatcctatatctttcatgtgttttttctattcctatatattttatgtgttttttctattcctatagttttcctattatgtgatccgaacaagctcttatgagggtatacatgcctttttcttacagatagtaatacttgggccagtgtgggcctttagatggatctactaggctgttttagggcttcatcatacatggggcccttgtcttcagtcctgctctctccaatctccatgccagatagcctttgctaactcggcatggtccatacctacgtacaataatctttgttgtgtattgatctttgctacgtgtggtggtactattacacaaacgattttcctggacagggactcatttagattgtaggcagaccataactggtcgcgtctggaaaaataggcttattttgcgtgtgctccatttaagaggaccgcacggaaaaatcaattttactgtgcggtcctcttaaatggaccgcacgcgaaaatgagcctattttcgcgtgcggaccagttaagagagccgcacacaaaaatacccaccctctccttccctccaacccactttaaactttcgcctcttctctcctcctctctatctctttttcttccctcctctcttcattttccccgtcctctcctctcctccccaagtcccgatggcgtaggcggtgacggcggtggtgatggcgcgcggcggcagcggcggtgtggcgacggcaagcgggatccggcgggtggcagccaacctccgcacggatccggtggcggtggccgtccccgcactgatccggtggtcggccgccctctctcccgcgggatcccgctcccctcccctccccttccttccctccccagatccggcggaggggagaggcatcgtcggtggtgcggtcggaggggagcgtagaggccagcgggagcgtggatgcagtggccgaccgccctcctcccgcgggatccggctcccctgccctccccttccttccctctccagatccggcggaggggaggggtgtcggcgacggtgcggctagaggggagcgcggatgccggtggcatgcggtgcggaggctgccgacaacgacaacgatgaggacgatgacgaggaggatgacgatgacgaggaggaggcggcggcgccgctggattcgttcttttgaaaaaaaaaattttggatttttattttctcgtgcgggcgcgaaaaatccgattttcgtagacccttgggcgtgtgtgggctgcccacctgcacacgaaaatcagattcaacaaaaaccgttctcctagtagtgtggtctttgcgaaaatgattccccttagacgcccgacctgcaatgaaaaatccttccacgtgttggcgatgatttaaaactgaaaagaattgagtgccctggacgacaggctctctttttctttatactatatacagaagcactctctttctctttctgcatgttgcatgcattgcgatgtgtactcgctttactctcttataggttcaaaattgtattagtagcatctaaacaaatgttctcctaaactatttaacggatctacgattcgattataccattgattttgttttaattaaatatttaaaataaagtctcacatgattataatttagaggaaaaaaaatatatgcttcaaccgttaaaaaattgctgtttcatatgtaataagcgaatgtttcaactggttttaactatgttgcatcgtttaaatttttcttgtgtactttttcttttttttcaatgttgcacattgtgtaatttgaatgttcagcaagtatattctaatgtttcactagctcatttgtaaatgttgcacattgttcttcatatgttgcaacaagtattacgtgatgtttcaattaaaaaatataataatataaatcatgtgtgatgtagttataaagaatttattataacgaatataatagtataattagatagatgattaaaaaattaatttaggaaaaaataagtttaaagtttgttaaagaggttatttaagtaaagggagagagagacagtgctcccctagctgatgcctaggagtaacaagcatgcatgctagtgagttgattggacttggtagtacatgcggacaaatgcaacgatacttggttgagtgatcgaggagagatggtgacgcagatttatactggttcaagccctcgaatgaggtaataccctactacagttggtgtaaattggatctatgtcgtggtgcgcagattagcaatgaagtggctgatggcgcgtatggatgatggagtcagtaacccgcttagggtttccatctgcgccctttatatagagctaggaccaccggtgcctagatggtaagacaacccttataatccgagtgcttgccatctatttacaaaggataggattgatttccttatccgatatgtcttccttatgttacaaatgcgcagcatgggcctagggcacttggcccatcccatgtcgtgcggcccaaaggccgagcgcggatttttcgtcaacagagtgatgaaggaagccttgaggtagtcgtcttctttgagggcgatttgatgatagcctgagtaggcgtcgagaaaggagagtagctcgcagccggctgtggagtcgaccacttggtcgatgcgaggtagaccgaatgggtctttaggataggccttcttgagatctgtgtaatcaacgcacatacagcattgtttagtctttttccggttgatacacctctttaataaagccagcggctaatagttttgttaattcttccctaataacctcccttctatccggagcaaaccgacgtagcctttgcttgatgggtttggcgtcaggacgcacgtgaaaagaatgctcggcaacctccctcgagacaccaagcatgtccgagggtttccaggtgaatatggccttgttggctcggaggaaggtgacgaactcgtcttcctatttggtgctgaggccaacaccgatggtagctgtcttggtaggagtggccgagtcgagcatcagatgtgtcgatggagatcttggaagttttggaagcagacaactcaatgtcgccggctgattttgccaatgcgtcgttggcgatagcctcttgatggcctcgagggattgggccatgtcgcagctttctttgtcgcagacgaagaattgcctgatgtctgctcggagggagattatgctattggggctgggcatcttcatcatcgcgtaggcgtagtgaggaacaaccatgaatttggccatcgctggcctgccgaagatagcgtggtaggccgtttcgaagttggcgacctcgaagaccacgctctcggtgcggaaattatctggtttgcagaaagtgacctgaagagtgacctggccaaggggagttgatgaagtgccagggatgacaccatggaatggtgacttgcttggttggaggagggattgcgagagccccatgtccttgaaggtcttggagaattggatgttgagggcgctgcctctgtcgacaagtacccttttgagtcgtacgccttccattatcgggtcaaggatgagtggtagcggcctgggtgaggcacgtggtctgggtggtctgatttgtcgaacgtgaggacggtttttgaccaccggagatactacggcgtgtcggcgatggtgttgatctctcgctccgtgagtttctgcttgcgcttggactcataggcgtctaggcctccgtatatctgattgagctcggcatgaggatgttggaagctaggagacctggacttgtcatcgtcttgcgctgggttgtgtgtctcctttggcagggtggacttgtccgcgtggagttgttgtgctttgaattgggatcgtataaacagggaccatccatgaacttgttgatgttgtcggacttgggtggcttgaagcgtcgctggctgttgctgtgcttggcgacgttgacctcctgtttgctcttgcgtttggggggtttgttacgatttgagtcagcgttgtctcggcgggattggtatgaggaccgtttcttgatttgcgcatattccacaagctcggagttggcgtccttgttggcgcggtcgaacatttgttggacgctgatggcgctgctcgcgctgagtgaagttttgcggggccaccacttgatgaagtcttcgttcttgcagccttggtggaatgccgccattacctcggtgtccttgacataagggattgtgttccgccgttctttgaagcggtggatgtagtcggtgaagcgctcgccatcaccttgtgtgatcggatagaggtcgcagtgggtgctgggatgagggaaggtgccttgaaagttggcaatgaatcgagccttcagctcggcccagctgttgatggtatactcggggaggccagtcaaccaagccctagtggatggtgttaacatgctttggggtcgatcttgccatcgtacttgtcaatacccatgggtttgacgttggtgggccattgtacccagcggagtggttcggtgaatgtcgggatgcccttgaccgtgtcgtcacggcgatgtcgtggatcgggggagaggtcgatgtagtcgtgcatgggacggtcgtcgatgtgaccgtccggcatgcgctcgacatgtcgtcgtcctgcttgttcatcgatattgtggatgcagagttgttccgtgtctcgttgtcggcgccactcgttcagaacgttacggaggttggcattgagtcgtcggttggagtcgatcttctcgcgcaggtcgctgtgggtgttccggtatgagcttcttgcttgcggggtctagtggcgatcgtgctgctgacgagagggaccttggaggacgatgtgccagccgcggatatggtgggggccatctccatgtgttgtacggcggtggcttccaccataaccttgatttggccgatagtggagttgacaaccatgtactcattgaagttgatgttgtctggcgatgccttggttgccacgatgttgtaattaggggtcatgaagacgtcacccatctttgcttggaagctggcgtaccgagtcgctcgtccatgctggcgcaattcttccatgtgccagttgaggtcttcctgttgttgcttgatgtagcgttcctcctcttctcactcctgcttctctgcctccatttccgggcaaatcacgacgaagacgtctcgtgaagggtgaggagacatcggcgtgctccgaaactttccgactcagagtcggagaggtgcatgaatttgtcgaggaacccgaccaagcgaggccctagttcgtgggctagctgtggatgtggtgcgccttccctgccgccatcgacggagatcttagcgcgatggttttggcggcgatggtggcgaagttgctgataacaaaggttagctggggtaccgtggtcggcggcgaggtgctgggtgaagcaggcttgaggaagccggctttgtttgcggtgaagtcgaaggagccgcagtggaatgccacacctgcggggaagcggagtgcctgggtgcaacccatcatgctggggctcgcctggactagttcgctaacgtcgttggtgacaaacatggaggagccgaagatgatgagagtggtggaggggaatgtggtggtcgtcatgaaggtgactccgtgagctgccatctcctcctgccaactgttgatttctaagatcggcaatataatttatggggtgcacaaaatcgaggagagatggtgacacaaatttatactagttcagaccctcggctgaggtaataccctactccagttggtgtagattggatctatgtcatggtgcgcagctcaacaatggagtggctgatgacacgtatggatgatagagtcagcaaccccttagggtttccatcagtgccctttatatagaactaggaccgcggtggctagatggtaagacatcccttataatccggatgcttaccatctatttacaaaggataggattgatttccttatccggtatgtctttcttatattacaaatacgctgcatgggcctaggcactcggcccatcccatgtcatgcagcccaaaggcctctcctcaggtaacttccccactcaagtcgttaaatgttgttgttgtgaatgatggagaagaggaggttgatgatgaggttatggatgattacttgttcaagtccataaccaaggaatcattgccacacctgtgtgagttgtttgagaaaattgaacaacaatatgcaactcttgagaggcaagagttcttgctcattcgtgagaatgagcaaactaatgaactcaagggtgaacttgataaacagagagaaatgagtttttggtacggctttacaagaaaaccaaagaatctactctagtcagaccgatctaaatcggattcgagggtaacttttaattccactaaaagtttatgtttttgggtactacaaccattcacccccactcgcttaggctggctcggttcttgctgtgcaatcctacaagtggtatcagaaccttgttttcttcttcggatctttatcgatcttgttttagccatggctaagaagtttacaactaagccccatattttcgatggattggattttccctattggtgcacaaagatgaaagcttttatgtgtgcaaaagattataatatttggctaaaggttattaatccatacgaaattccttctcagatcaatactgctggtttaaaagctgaatttgaatagaattacaaagctcgcaactatttgcttaatgctatttctcgttcagattttgctcatgtttctcatcttggaactgcgcattagaggataaacttttggattaaatggcacgcttttcaaactgctaaatggtgcattttgtgcgaaaactttatatatgaaagttgttctaaaatattagattaatccatttttcaaatttgtaataattaaaactcaattaaacacacgttattacgacctcgttttgtgtgaaacacttaatcttcatcttcatgttcaggagattcaaacaccacttagatttggaataccttaaacaattttcatcagggtagtctgatatcatggaactacatagaggttgatatttgagatgaaatctggagaggcttattgatgactatcttgtgctttaacaaagttttaagcaatgttatgtttgttgattcatcttttgatatcaattattctcaatgtgaggtttcttgacacttcttgaacggtcgtgatatttatcagatattttagagcaacttctatataaattttcgcacgaaacacaccatttagcagtttgaaatgtgtgccacaaatatccaaaatttcatccaacttttgttggagaaacaaatgggaccttagttagtggtgctagcaacatctgggtatgatctggaatcctggactcaatttcttccaaatgattgtgttagctcgtctacattttcgtcagaagggttttctggaaatcttctttattgttgcttggcagatttggaagcaaagaaatgggttgatatcccagaatatgcatccatcctttgaggcttgcagacttttgtttaagaaagatattcttctgcatatgtacagaatgaaagaacccttaagaaaaggtatttacatctctttgtaaatatcttttcttaaatgaaaatataccgcgaggcaaatttatctaaaaaaaagataatgaggtagttcccccataagaatttctcgaatagacgttttctgcttttacctctaagaataagagatgtgtgacgatgaataaaaaacaagagtttaccattgaatctcttaattttgaaattgctagattatgatctcttatccctaatgatgatgattgcaataattgtgaggttttaatgaccaagatttcaaaaataagatatgctaattcttcacacgatttgagattgaaatcttctcttgctcttggagttgccacgcgcacacacactttggatgaattgttgttaacaaaaagttgttgaaaaaaatatcaaactgtgttttatgctagttagatgttttgtaacaggtcttcggggtcacatgggttgatgtgacgggggagattattgggcctgatgtgtgatgggggagattgttgggtttagtcccacatcggtaattgatgatgggggagcacgacttaaaaggtgggggcggtcctcacccatcagactagtcttttgggttgtgtagggctaggacctaaagttgtggctccgattaggcctgtggtggagcaggtccaatgtgacctaggtggcccacggttggtgggccaggctgcgcactgtaacaaatatgatttgtgctaaaaggttaaaataaaaacatggtgttttgaatttctgaacatgctcactaaacaagtgaaacgtgccttaggtcatgttgagtacatggagaacgttgtagaatctgaagaagtgttctcttactctagatgtcttaagcaaaaaggtattaaggttaattatgaaaattgtgataatttgagtagggaaatgttaacagtgaaattttgcaagatataatcggatttggagatagatgtcttaagcaaaaaggtgttaaggttaattatgaaaattgtgataatttgagtagggaaatgttaacagtgaaatttggcaagatataatcagatttggagatagatatcgaagcggatttgaaggagattgaatcttgccaaaaacagactgcacattggctgggcagcgtatcggctggaaatagagtcgggaactaattcggccgatatggaaagtggccaatacagcttgacttgggcttagtttgggcctcgattgaactaaccgacattgccgtatagagatacaacttatttaaggcaatagtatctattaattaggatattaaagtcggtttgaattacacatatggtaagagtctgccatgtggacttgtttgatgtttttatctttaggaaagtttgagcagtgtccataatggacaagttttgtactttgggtataaatataaatccaagatcattgtaaaacaggacgacaatccaattaatacaactttcggcgcatcgccaccttttcttttaagttttcgacgagttcttgcttcaagtcagggtcagggccggccctggggtagggcggacagtgcgaccgccctgggcccctaggcgtcaggtggcccaaccggctatacactgctatacgtgcatatatagtgcgtttggttgctttgcgcaggagtattaagttaatctcacctttaaaaccagaccattaatttacagtgtttatcatgttgcccattcttgtgtatgctaaaatagcaccctaaacagaatgattagactgaactcatggtaattagtacctttgtatttttttttcctatttaattcactcctcttgtgatcttgcaccaatttattgaagatgtatttgtcgctagtatgtcttgtatgcattctactcttttcactaggcttagatattgcttttaagggtgatgtttaatgacatttaaattcttttacttgaaataaagaaatatgcaatgtttaaaccagtgtttattttgaatgactaatgcttatatatatgcttgattggattgttattccttaaattactctttgtttgttccaaatgccgcaagtgaaaatattgcttgtatttacttttaagagaggtaacaatgaataccgaatccttggaaacaatcttgacgacaatgacatattcacggtgaggaaaataatgagtacataatccttggaaacagtcttgacgacaaggatgcacttgaaataattgagagattttatgttcaatgtcaaactgagcacaaaaatttcaaataaaagctgaaagttctcttggagttaatttgagactgaataataatgcaattggtatatgtctaggggttttcttttattctctgtacttgtgaatatgttgcgttataaattgtttgaaatcatgaattttgattgttgatttgattttactagtaatatctttggttcatgattgtactctagtgtatgcttgctatctagttgatgactttatcttctattgcgacacatgaccttgaattgctttatgtataattccaagctcttgaaagtaaataagtactaaatgctaatgcttgatgaaatcattgtcaggaggagaaaagatatacaaaatgtgcatattttcaaatgctagggaaatttttttcttttcaagtgagagaaatttgttttttgaattttgagcacttcgatggggagattataaaattgatatgtgtttgatctttatttgatgaacaattggcatatgggatattgtttttgatatttgtaaattattggaaaagtggttttggagatggttgatttttagatgatgaacatgatgtttgtctcacggttgtggtcacagcggctaggctaggccgatcataccagtgctaggtgtgtggtaagaccagtcggcccgatagtctgaccgaccagctctatgacggttgtttctttgaatatgtgtgattaattcatgtttatggcttctatatggatactatacatatgtaatactattgtgtgctaacattgagccaagttggagagaacatgtactcggatatggtttcttggttgatgtatgtgtaggtgagtcttgatgcctcggaagaatgttgccggtgatggatcggaagtcaatttgggagaagatggtgttcggacgagcaggatatcatacgggatacttactccgaagatcaacacacgttgttggtgaagatttcatatatatggcgtatgatagagaaattgtgtgcgtatgggatacggagtagaatttggaaaagagtccaaatttggtgcggttggactttgtaaagtttgtttcttgtaggggaaggttttctaagatcttaagacttattgtacaaattgggtttgtggctttaggctgtcttaccttagatataaataggtatggagggtgaggcctcttggtattgattgggtgagaattaagtttagataaaagttaggatcttgagtttagtcgagatttttgagaggagttttgttgttgcaccttgtaaacagaataaaagtaatgaagtttaatctactttgaaatctttgatttgtgttttctcgaggtggcagtccagttggtgggacaacagtagtaaaaccggcagcttcaggacggtcagaccaacggccgcgatagcgacggtggtgcgtcgagcggtcagatagaagaaactacactggtcagaccggaggtcttcaagcggtcaaactggcacatcaactccgatcagatcaatttatatcagattcgagtataacttttaactcctctgactaggttagaccctgtttaacaggatccagggaataaatattaggatgcattcgttttcctgggttgggaacgctaccctccggcacggaaaataaaatggtccataagcgcatgatttattaagtatttgctattttttttcaaaaatggatcaatatgattttttaaacaactttcgtatataaaatgttttcaaaaaatacaccgtttagtagtttgaaaagtgtgtgcgcggaaaacgagggaaagtggttgggaagcagctagaacgaacgcagccttagtccatatcaaatcgaatgtttggatactaattagaagtattaaacgtagactaatgacaaaacacattccaaaaccctaaactaattcgcgagatgaatttattgagcctaattaatccatgactagtctatgtgaagctacagtaaatatgtgctaattacatattaattaggcttaaaaatttgtctcgcgaattagctctcatttatgcaattaattttattattagtctatgtttaatatttctaattagtgtcaaacatttgatatgacatgtactgttatttagtacctagatcaaacaccatttgttgtgcaatcatacgagcggtacgtacattaaaaattctgacaatgtagtactccatggtatcaaggtgtcagcactgagcaacagtgtattttatacggacaataattaataatactactgtcaagtggtaagctctgacacggacacgaagatgcttttcttgactagattatgccaagggtctttaacaataatttggtgtttagatccacggtgcaaatttttggcgtgtcacatcaggtattatatagggtgtcgtatagggtgtgtgagcattaataaaagaataattacagaattcgtcagtaaaccgcgagattaattagcatcacattgttaaatcatggagcaattagacttaaaagattcatttcgcaaattaattagtcgtaatatgtgcaattagttattttttagcttatatttaatactcactccatctattttttatagtcatattttatcttgacatacaaatcaaggataaataattttacttatcatctattaaatatgatactagtcattcctcgtaaacaagcgattcattaatatttacattttttaatgcccatgtagctaatcttgtgtggaagaatggagagtcacgcattaaattcgagaaagtcattaagatgataagttgttggattgaaatatgcctatcaaagataaatttttcagatttagaaatatatctatcaaaagtagatggagggagtacttaatacagatattcaaacgttcgatgtgacatgatgaaaaattttaaggtgagatctaaacagggcttaaatctcttgaaattgattaaacgtaaaaatctcatccgcggacaatggacacttgtatccctgacctgcgtctccaaatcaagccgtcacgtgcgcgtcgacgaaggctcccgtgagatcggtcttcaccagtcaccacggcgagcatcaacagccactacaagagtacaagcatgtcaagcctccatatgcacggacgggtgtggagtggacacgggccgcacaaaaccgagggctgggtccagggcgccggctctaacgaactcggcgttacaggtccttaagcctagaattaattttacttgtattgagcatgtatcctttataaagtgacgtaaataaacatggctaatatgataaataataaagtaaatagttgcaaattgtaacgtggtactcgataaacaacattgacagtattacaatcaacaagtaaaagagcaacagaaataaagttgtgtgaataccttaacttaactaggacattggtgttgcgagaagggtccattcctagattatattttgccaagggtctatttataaaataaattttcaaaatgacaaaaaaaataataaaatcacagatagctcgatgggagtgtgttgtacccacctacggtatttgtaaaatatggagatcgttggtatagggtgtatgtgagattaaggtaaaagagacggtagacagggatttttataccggataaataagtctcataactgacaggtaatagcccttctcctattggccgaagccggtgttgtctttatatataaatcagtatcacacgagtacaatatttaggatgatctaatcttgtctacatctgcatagcgacatggagctctcgcatgtggtcgacggctagcgtagtctgcttcctcgaatataaactcgtcaagattagagatgtctctagatccctcatatcggtgtacatggctcgtacattgggtttgtgtagatctatattggcttgtattccgtgttgatctgtctcctttcctccaagaggtcttgtatttatacttttgggtgtttcgttgtccaaatagagcagggaaccaagtatggatacaatccgagttatctttgttgtgcccaaataagattttgcttctttttctttatctggaacacatttcatatatgaggcttaaaacttgatatatggtgggtctcgccaagccttacacaaaaatactatgtactccctccgtcctaaaatataagttttagagttggacacggttattaaaaaagtaggtagaagtgagtggtggagggttgtgattggatgagtagtggaggtaggtgggaaaaatgaatggtagagggttgggaagagaatgttggtggagaaattgttatattttaggacaaatcctgagagctaaaaattgatatattttgggacggagggagtatgtcttatctacaacactgacatgaaggttggaggatggagcgtgaaattactaaaatgccttttcaaattgtgtgcaaattctaaaataccttttcttatatattgacagtatatactagtatatgttctttttaaaagtcctcaaatttcctgccgataaaacccaccggataaattactcctatcgcattaattactgacctcgatgaatttgtgtcgaactatacctaggcctgtttagattctaaccttttttttttcaaacttccaactttttcatcacatcgaacttttctacacacaaactttcaacttttccatcacatcgtttctatttctccaaacttccaattttaacatggaactaggcctagtttagttcccaactttttcttcaaactttcaacttttccatcaaatcaaaacttttctatacacacaaacttccaacttttccgtcacatcaatacaatttcaatcaaacttccaattttagtgtgaactaaacacaccctaaggcatgtttagttcctaactttttcttcaaactttcaacttttccatcaaatcaaaacttccatacgcactaacttccaatttttctgttacattgttacaatttcaatcaaactaattttggcgtgaaccttagggtgtgatccttccgtaaaaaaaaaaagaaaagaaaagacaacctaagagaggatgggatcatttctattacaataaatatggacaactctcgctctaaattcattgtacttacaggagtcacatcactttttttttttttaaggatggagggagtagtacaaatttcaaatttgttgcttggactgctacgcgcacgccggcccctttgaaactcttcgtcaacacctcgttgcagctggctccttctcggtagcttaaataaatgccgttcgtacgttgcctgcctagatgtgccctttcctaaaagacaaccaagttgcaaactattcgtggccagtagcctagaacacggtgcagctccaatgcaagttgcaaactgtgcagatgagggttgaagggtatgagttgcaagaagaaagggtttttggtgtcctgaactcctgatcccgttgcgatcgacaaacaaaaggtatgtgtacttttttgaagaagtagtgagctatatgtgttttctttctaaccaaaagtgaggcatagatgtgaggtgaagctagaaatacttactactagttcgctgatgttacccagttttctttctaaccaaaggctgtgtttagatctaaagtttggatccaaacttcagtccttttccatcacatcaacatgtcatacacacacaacttttcagtcacatcatctccaatttcaaccaaaatttaaactttgcgcagtggcggatttagaaaatcagttcgttggtgtcataacgtgtctatcggtgtcatagaatgctaattatgcttcgaacatggtgttattgtatatggataagcagttttgctatatattttaccgaaagtcatcagtgtcacctgacaccgacgcttatactgaagatccgcccctgtttgcgctgaactaaacacagctaaaagcttggaggccgaaaggcaataagctgggtgagttgactcttgactggacggatgatgcagtagctagctcggctataatgtaggtacgtgtgcataatgcttcgctccttttttttttttttggaatctccgtttttttcttaagaatctcaatatatatatatatggccggtgctattcctactctccagcacttgctatcttctaatgatagagatttttttttcttcccctttgttctttttggtttaccacagggtcttgattgtgcttcgaagagacaaaggcagcaggatggtcctttagatctgtatgctatttggactccagtggttctttaggtccagatcaagttcgttcaacggtaagtgcttattgatacttcgcatatgttctcacaaattatggtcatagctatgataaatggttatcttttgcctgacagtatggtgcttatcctaacgtacgaccttttcttcttcttcttctttaatttttaggttatgttataaaagaaaatagaaactcaggccgccctgctctgctatcagattcaacgagcaaccaatggctgaggctgtgattcttttagctgtcaagaagattggtgttgccctggggaatgaggcaatcaatcaggccacttcatatttcaaaaaatttgtcacacaactgacagagcttcaaggtagcatgggacgcatcaagagagagcttaggctgatgcatgagtttctttcccgaatggatgtccgcaatcgcaacaatcagacatatgaaatctgggtggaggaggtcagaatgttagtccatcggattgaggacatcgtggatgattacttgcatcttgttggccacaaacaagacactggatggggtacctatctgaagaaaggattcaagagaccaaatgttctgttctctttaaacaggatagcttcatcgatcaaggacgctgaggccaatttagtgcacttgttccaagccaaagaacgatgggtgtggatggctggtggaagggctactggcagcaaaagctcaagctatattattgagacgtctcgacatctagctaatatttcacgctccctcgatgaagatcttgtgggggtcgatgaaaacataagaaaactacatgagtggctaacaagtgatgagttgcaacgtgaggtgatagcgctgcatgggatggggggtcttggtaaaacggctttggcagccaatgtgtacaggaatgagagagaaaagtttgaatgccatgcttgggtctccatctctcaaacttattccatcaaggatgttctaaaatgtttggtcactgaattagatttaaaaaagaaaattcagggtaacattggtgacatggatactgcaactctccaaaatgaactgaagaaattcctgatggatcagaagtatttgatcgtattggatgatgtttgggtaccagaaactgtcaacgacttgtttagcatatttgtttcaaatctcaaggggagcagagttctcgtgacaacacgcattgatggtgtagcccacctcgctttcccggacaagaggataacactagagcctctatcagaaaaaaagtcatgggaactcttttgtaagacggcttttccaagagataaaaaccatgagtgtcccacaaaactgacagtactagcacaacaaatagttagtaaatgtgaaggcttacctcttgcaattgtctctgtcggtaggctcctctttgtgcgtgacaagaccgaagaggaatttagacgcatacaaaaccagcttgattgggaactaatcaacaacccaagcctggaacatgttcggaatatcctttacttgagctacatctaccttccaacacatttgaaaagttgcttcttgtattgtagtatgtttccggaggactatcttataacaagaaagaagcttatacggtggtgggtagcagaagggttcatagaggagagaggtggaaacacaatggaggaagtggcagaagagtatctcaaggaattggttcacaggaatatgttgcagcttattgaaatgaatggatttggcaggataaaatcattcagaatgcatgatattgtacgtgagttggcaattgatttgtgccgcaaagagcacttcggttgttcatacaattgtgagaataaacatggtaaatttcttgaggggaaggacgaacgccgcgtggtaatacataaattagacaagcatattaatcaagccattttgaatgaatgtcatagcctccggtgtttgatcacattggacgaagcgacaccaccatcaccatgtctgctacatttggtagcagacaaatgtaggtatatgtcagtacttgagttaactggactacccattgaaaaagttcctgatgctattggtgatctatttaaccttcgacatcttggcctacggggttcaaaggtgaagcacctcccaaattctatagagaagctctctaacttgctgacgctagatctcaacgaaacggaaatacaagaagtgccaaatgggattgttaagctaaagaagcttaggcatttgtttgttgagaaaatgaatgaattatatgggagagaattccggcctcgcactggtgtgcgcatccataaaggcctagagaagctgaatgagttacagacgcttcaaggactagaagttcaagacgaagtgtccttgaggcgcttaggggagctgagacagatgagaagcatccggatatggggtgtcaaggaaagctactgtgaaagcctctgcgagtccctgcagcagatggagtttttatccttcttaagtgtcaatgcaagtggcaaggaggaagtcctcaaattggatggtctaaacccgctgcctccaaaccttcgaaagcttaacttgcgtgggatactggcagaagcaggcatgttgttgggttcacctgcagcaggagatcaaaataaccactcgttgtattcagtgcatctatcgtggtctcagctgatagaggacccactgccatccctctctaggtggtcaagtctgacggacctaatgttgacaagagcatatgttggggagcagtttgtcttccaccaagggtggtttcccaacctcaaggaactcgttttaagggacatgcctgatctgaagcgcctggaaatacacgatggtgccatgacaagcctgcaagatctaactcttgttaacctcagtggcttgacagaggttccatctggcatcgagttactttccaccctcaaaaacctgggcttttgggagatcacccaagacttccttgcagctttgcgccaatgccatagaattcaccatatgcagtggtggtacagtgtacggggggagacagatggagctctctgatgcaatgatatgcatgattgatggatgcatcaccgtcgggtcgttctaatgcaaacaatcattttaattaatacagtaccgcattgtcaggtaattcaagctatcagagtgatttctgttttgtctttcggtggcctagtgtgagcctcgtgtttttttttttttgagtgtagctagtttctcgcgtcatgtgtgccgcggctcgctgtgggatggcgcagcaccagagtcgtagtgtatttgttgtgtcgtggacgtcatggctcgctgtgggatggcacggcattcgtggagtcatggcaatcacggttgaggtggattatccaccgcgtccatgtaatctatctttcgtatttaatcaagatgaaagaaacagaaaagccgtgaagtaaccggcaccaaaaaaaatcctctcaatgtgcacgttctgtgggttgtcttcaacgtgttcgtcaaaacatcttgcattgtgtttatgagtcgagaccggcaagctgacaattggtatatcagagtgctgtcggctcttgtcccttgccgtgtgctcttgccctcgtcggccccttcggcacaaccgtccgtgatggttgtctagcgcgtcatcaaggaggctgaactatcggcgtcgtacccgatcccgatgctcacgaagaccaactacgacgattgggccctaatgatgagggtcatgctccaggccagagggatatggagacatgtgggattcaaggaggatcacatgacactcaaaactgcacatcatggtgtgccaccggagatgatctcaacgattgccacgaaggaacaataagggaaggaaggaaaattgacaggaaaacagtaaggacaggctattgcaatgtcgatagatagacaaacaactgtcaccaatccaagccagtactccaaatcagggcttctctctggcgctgtcgggcacttggtcattcacggttggaaatggaatggctacggctaccatactgcgaggagcagcttgcttctcctccttgatggccttgacacgctcgctactaccacctccaggatcagtatctggatgaatggcatctcttgtcggattgactcgacaagacccttggtccactcattcatcttatctaaaccagatctcagagaaccaagcactgatcctgctccctctcgatcgaacctccccaagcatgcttacaaatgccacgatgacggcagtattggctagatcacctaagcgcatcacctcatggcctccttgatcttgtacaggaaaatgaaggcgtcaaactgggctgcaatgaagatgtagatcaggaggttcggcgctcatacataaggggccacagcaatttgcctccgtcctgtcttggtgtatagagcagatcgaccttatcatcagcccatttcctgcacaacgatcacaggttaattacttaattagagatgcgtgcaatgaatgagctagtgttcttaatttgtttctcttttttttaacggaaaacagcacagcagtgttttttcattgaactaggaaggaagcccgcgcattcgctcgggcattatgttattttgtttcggaaatagttctaacaaaataagtcgaaattaaagtaaggtatttttaattttttaattgaatttttattgtttactttttccttaagaagtctcgagaaacttttattgcgcgtaagtttactttttttatcatcctacttgctttctttttaattgattatatatatatattatagtgcttctttttaatatgtgagaccctacagtattttaaagaaaagacctaatcaatatgaatcttaaaataataatttattaggaaaaaaatataacttttaatcatgttattataataaagggtattgattttgtattgccaccttaggggcttatacatgcaggttgtggagaaagccatggagctactttaaaggatagaatttactgaattgatttatcattaccttcgccacttggtgtttttaatatgacttgtacgaagagaaatataaaaatttggaaagaataaaatatcattatgatgtaaaatgagcgctccactaaaatattttagttttatgtgtaaaagcatcaatactacattgcggtttaagcaaaatagtttgtgtaaaagtacatttgagccacatttgaaaaggattctcgtaaaaatcatttgtgtagttgtgatgaaaataattattcatacagttaaaaagttagaaatccctatgtgaaaataatggtacttgtgcccatattattctttgccaacaatcgatagaacttgatagttctttttggtatgtagtaaaattggctagatattttacaacttactacctccgtcccaaaataagtgcaactgtggggatccgtgtccaacgtttgaccgtctatcttatttgaaaaatttataaaaaaaactaaaaaaataatcatacataaaatactattcatgttttatcatctagtaacaactaatcataaaaaattcaaataagacgaacgaccaaacattggacatgaacagagcaaaactgcacttattttaggatggagggagtattattgtatccccgttgctaagatgcacctgctaatttttttctatatgctgcatttcaaatgggtgccttggtgcatgtgacactatatatattccaaataaaaaagggaaacaactcattgtttcgtgtagagtgcgtgagacttcacatatagcctatgaatataatttcatagctaaaaagaacttcgcaggtgtgattattattgcagtgtgcacttttcatgcgcgtcatcatgatttaaatatttgtactctaaatttataattaaacattaggaatttatatactctgtttttttatagttagcatgcattagacttttagtattacacttatgtgtaaagtgttacccttaaattcattatattttagccataacaaaaattatgacgttcttaagagtataaatgtctttttctagctcacaatatgtgtgtatttgtgtgtgtattagttggtttacacggtgtgttcacgcaggttgtgcataatcttcaatgcgaaacctgcaatacctaccctattttatcttatcttctttgtttgaaagaattaggaatttaaacagtcatgctagtttattatgtccattactataagatgggctacaagcatttatagaggtatattggaaataaaagttttactcatgatgacatggataaatctcaaacttttatttttatatcatgtgatagtttttaggtttgcaacatatgtggtttatactacatatttttcctcctaattaaacctccatttatatgcatcgcaccgccatatgtcccggcggtgcacacgtaaaatctgtttacttgaactcgccggaaaacaaattcaccccaagttgttacttatatatggtattatatgtctatggcatgttttacgagtatgctccagtatatatcaattgttggtttgttctaggcaatgaacaatttagcacagtacaatatgaatgggaccgatccatcttcataaagttaaagttgtattgtatacaatataaagttgtagctcatcagagtaatttgacacagtgatggcgatctcctaggaccgccagaggcgcattgtagaattgttttctttttcttttagttttgaggctctggttaattagttcaatctaatctaacggtggatgtcctggttgttctttttcgatgagataaatccaattcaagtaaaaaatcaaggatgggatgtttttccttttatcataatttatatgaatttttaatttattagagcgtcatgtgatgacttaggagcgtatataggatgccacgtgatggtttagaagcatttgtaggaagtttaatggacttttatataaaatcatgtgtttgtgcaactatattatcccccctctattaaatttacaaaaataatgaacaatgtacatatgtgttcctagaacatttttacactgtagatataacgctatcacattaaaccttttttctataattaacgaaataatttgtcatgtatgttggtgcgaccttggtacatttgatcattctttgtcatgacatcacataggggtgtgaagtgaggttcgaatgacttttttttaaaaaaaaaaggatagatctaacgacctaaaactaatttaagtaaaaattgatggtcgaatatttttttggattttctctaatttaagagtgtcaggtagttatttagaaatatttctatgatatttagtgtactataaagagagagagtacagaggaagggcttgctagatatagtaggttgatgtctatctatagatatttctaggcacataaagaaaaaataataattttagtaatcatgggaataaaaaaaagaatggaacggttaggtacatgcgtgagaatgtcacacagagggagatttttcagaagatagatctaacgatttaaaataatgggttcattgatttaaatgaaagtcaacggtcgaatttctctgttttagagtgccacgtgatgactcgaaaatatttatagggtgggttaagagcgtttgtagaaagtttaatggtctataattataatcatcaaggtatctaaaaacaatatgtatgtacatatataaatattgctaagataaatgtaatagtaaaaaataattggtcgaccatatttaagtagaaatcgatgttttttttcttcgtattggagtgttgcttgcctacttaggagcttatttcgttgtctgttattaaaacataaaggatagttgtcggttattaattatttagactatagttccacatgacaactttttaattaaaatataggtaatatggatgttatattttaaatagagaacaaccgaagaaaataaagggtaaggattgatatcttcctttccaatcatgggtgcaaacgtgcatacatatatttttttattttttctgatgaatagtttttttttttgttgttttcctttagcaaacagtgtgtaggcagtttccttacgtacgttgcacgatagtacgtagggatgattggatgtgggcccatggagataggagagggaggtgaaaaaacaattctaatatagtaataattaaaaatagtggggccatttattatttattaaagtgacacgtgccgttttaggagcgtttataggactgccacttgacggcttaagagcgtttgtaggaagtttcatggacttttagtatataataaaagataatagatagatatagaagaagaaaatacaacccctagaggtaaaacaaaaagatctttagactatacactatacagagtgcgggatgagctcgcgcaaccttttagccccagctaaagcccacaagctggcctcctctttgatttttgctaggagaacacctattgccatctctttgtgatcaaaaattcgccgatttcgctccttccatatttcccaaacgactagcaggataagggaccgaaggcccttctttggaatgccgggtgtattagctaggctctcccaccactgatggactgatcgggcttcctcccactgggctggttccaattgctgatatcccgcccatgtagcaatgaggtgccagattctcttcgtgtatctacacatggtgacgaggtgcaaggccgtctcggcgtcacaacgacataaggggcaatgtccgttgttctgccaaccccttgtcgtgagtcggtccgacgtccagactctattttgaatgatgagtcaggcatgaaatttatatttccccggtgcccaaactttccagattagggagttgaagtttgtgttaggcgcccctaaacattgggcatgataagccgaggaagctgtatagtggccgctgcttgtgaatttccaagcaatctgatccggctcttcgctatctaagtgcacattccgtaccgcctcccacaggcggactagctgatcgagaaggttgattgtgatagatgaacccgcatcaagggtcaggtcatgcacccaggagtcgtcttctttcccttggcgcagggatttcttcctatttttggagatctcatagaccaacggcattaggtcttttggtctttgaccgtcaatccatgcggagtcccagaagcgcgtcgtattcccatcgcccaccgttatctttgttgaggcagcgaagaggtccctatccacaccatcgcaaggcgtttccaatcctacccaaggcttacttagatctctctattcgttccacaaccatcgcaatctcagagctcttgtgaacttgtccaagcttaggacacccaggcccccctggctggtcggcaagcatgtctttgcccagttgaccttacactttcccccggtgatatcacccgtaccagcccaaaggaagcgacgtctctgcttgtcaagttgctccagggattccttcgtcaccttcaaggcagtagtgaggagataaattggctgcgctgaaagcacagactttacaagcgtggttctcccgaatttgtttgttgagttcgtacctgtgtttctcaaaaagcacctacagtgtcccggagaatatttatgtggagacgctgcttttgcatccagggacttgtcaatattggctgctaggcaagaatgagatctccttcaaggatcccgtggcctctgggctttcgccgccggcgggctccttgccattttttttttctgccgagaccgtccttcttttcgcctcaaccttgacacgcaacatccccctgctggcctaccctgcttggtcgacaaggaagatgtgaagaacgctcacactccatcctccaactcgatctctaggagccccgtcgaatggtataataagtcaaagcaaaattattgaatttgactttgaagttgattttaaaatattttcaacataatttctttttagcgtgggttttgaagtcgttatgaacaaatatataaaagttttagttatattttttttattttctaataaaccattttatcttattagggaatatgtgcaaccgatgatgctatatccctttagctctctagttctgtgactcctccacccgatctccctcttatgtcgggttgcaagcgaaagcaaggcgttccagcatgttccccaaagtcctctttcgttcacctcaggtatttccctttgtccctcactgagctgaccagaacgccaccgtcttcttcggcgccggcagatgttcgactgagaccccaattaccataatcggtcagctaattccctcgacagaccaaataacacgacgtgcacccattgtacgtgtttctcctttttctctctaggcgtaattatcgctctcttgctcaaccgggccacatcgattgacgaggaacaccagtggcctcgacgccgacgagcaccaccgatggcgtgcgacgccgccggtgaccgtgcgggtggcagtgtgttggcacgcatctggttttattgggcctagtggctaactggatcgcatgggccggaccacgcggagaaggtggaattttgcatcatactacgtttttgtaccgtaccgtcagcctaaccaggttcgtacgtcgtcatattgggctcttcacgtctactgggcgccacgcggcaagggtggttagcaaatgatatatgagttgaaattcggtcttgtttgagcgcgctcaagggcacatgacacatgtgcatggcatttttgcatctgtttttcttttccttcaaaaccaataaagcttacagttattcatatctagttggccgaaatttggattccattgaaaaattagacttttcttttggtacagcttcttcagggccatgctatgtacattaagatctcgttcttttctccaataagagttggatgaagattaagattttcgtggcacgtttttcaaactgctaaacggtgcgttttgtgggaaaactttttatatgaaagttgctctgaaatatcatattaatctatttttcaagtttataataattaaaactcaatcaatcatacgttaataccacatcgttttatgtaaaaaacttaatcttcatcttcagaagaaaagaacaccacctagggagtgaaaacgggatatggatattcccgaccaactaaatgacatttgtgggcaatatctgaatttaatttcctacaccgtaccaactatgccaaagaaatattatactccatccgttttaaattacttattgttttagctttatcctatatcaaacatgtataactttgaacattaaattcatatagaattgattgatggttaaaagtatttaactttaaaactacaaataattttcaaaggaggtaatattcaagatagcaaagtccattggattcctttattaaatgacctaacgaaacaagacataatatagggaagcactagaaatatggtgctgccattaaatatttgggaaatcaggtgcatatggtttcttccactgttccacaatattaaaatccgggtaactacaacattacacgcaatcagataacgaatttagcgatgttaggtatttgttgttggactgatccatctcttatatgttttaaagagcattctcgggtgtatgtgatatgcatgtataatgacacggtacatgtgggagaggtgacgtcagtgctatgccagccctgttcgtttcttccacaagcatgggataaaattttggatactcgtggcacacctttcaaactgctaaacggtgtgtttcatacaaaaactttctatataaaagttactctaaaatatcatattaatctattttttaaatttataataattaaaactcaattaataacacgttattaccacatcattttgcgtgaaagttcatcatcatgtgtaggagactcaaacacagcatggatgatagataaaggatgaaattgagtttgcaataattatttgagattacaagcgtaacataattaagcaattaacgcacgctattgcatactccctctacttctctattaactgacgatagaggctaataatttttggattgaaaaaattggcgttttagctcccagcctaatagcttcccagaggccagaagtatccctggatgcatgcaaaaacaataaagatgcatgcatctgttgcttcgttttaacgaagtgagctagatgaaattattggtttgagatgtccccaatatatttaatatgggtataaccggaaatatgagtccgaattaattactcattggtatttgtaatgctgtccaaaacgacagttaaaatagaaccggagagtacctttattggttttgttgggcctaaatgattttttttatgtatggataggacgtggtgggccttctttgtatcttattcatttatgttattttgtaatttttgccatacaaaatattgataacttgttaatattttataatacttatctgtaaaccaaagatgacaaatataaaaaaattatgtaaaaggcgaacggtagagagttattacattgttaaacacatagccttatgcgtgaaattgcatcgcaacttgtatatcatcgaaaacatctcattcttgatttgctaagtatgtactctaaacttctgactgaaacttagtgcctgtaatagcacctgttatcagcaatccacaatcttccacaaagatactattccgctatagctcactatttgaaattgtttcattacgtgcagatcactgctaacatcagtagcaccgaatttggtactcatatcaaccaggtgatcattaagaacgctaagattctgttcaacatctgcaatgtttaatataagataccagaactgttagttcatactatcatgatatgcatgcttgtttactacgttgtggttcagatgaatgcgaagaaactacagaattgaggtttttacgtgggcttaacaaagaaattcggggcatgcttgattgtcaaagatacacatctctttctcatttgttacaacttgcttgcaatgctgaaagtaaactagaggaggacatgaaaaagcagcatgctatgtttttgcctcctattactaaccatttgcaggaagtgcataatcacggaaaataggagagagacatgaatgagccgccaatcccattgtttgcactcaaattcaatgcacctccatcacctgaagagagtatcactggtaaactaaatgatgttgagattaatcaaggtgagtgtgctgattacgaattgaatttgtccacttttcatgctatagcagagcaaccattagtggaaccaattgctgagattcctttgtcacaagttgatttatttgcagttccttgtgataaagaagagttgtgtgataatgcttcacttatatcaataccactactagttaatgaacatgctatctctagtgttaattctttgtgtgctgatttttagcatgttgttcacattgctaatgaagtagaggaacgtgaattgacatcttctttaaatactttgggctatgtttagtttgatggtctttttgagcttgataatttgaaggagaaattagttgccaagtctgatttgctatgtccgagtaatgctatttttcatatctttagcgaatataataatagaggaatatatttggtgcatagagtttacatctgtttggatttagaactcctgtatatgtagataaaacatgcaagctagagagacatgttattgctaatcatattatctcgagtttgtcttgttttgattggaggaaacaggttgttctaaatagactacgcgaaaagcaccatatggaaaaaccgaggatggttttccgtgaagaaggggagaatgatttgaccatagataccattgatacaaccattgttcacatcattgatcaataagaagtcatcaaggtcaagtcctccaagtgctggaatacgatttggtcacctactacactgttgacttcaaacggccgccgaatctatatacgacctccgttttcggcctatgattagttgatggaaagctctcggagtcctctttccaatggatccagcctcatctccgaattccatcttgtttggatgcaagggcctacgggcttgtaacttcgtctgcgaccccggcccatgtaggacccatgtggggtgcgccccaaccaagtagagcacgaccctagggacccctaggtcgtcctcccacctccttaaatagctaggtaccccttcagagtttcttgggttttgttagattaaagtttagccattattacttgcttgcagcgcgcgtgtcggctagatcgtttgtctgcttattcttcggaacccctacttatcatttgtattcaattcctatttgcaatatcatattgcttttatcttgttcttgcttgtttcttctatttgtttgcagaaatcgggttgatttgcaccggcaagatcagcaacccacgaagaggtgtatcgatcgctaaggcgcaatgcaaagtcttgtacggttgtagtcgagtcgtcaacgtttctctcaaatcgtagttatctaaactcaccaaaagatcgggccaaacaactgccttgactgtctcgagtggaactcagggtttatcaccaaatataataataataataataataataataataataataataataataataataataataataataataataataataataataataataataataataataataataataataataaatgaaatccctatttgatttagattattatcgtgaattatctactccattatagagataaattaaatatcttgataaataaaattaattaaccgaaaacttaaaaacgagtgatctatgcaatgtagcctaaaaagtttattaatgaaacatatttttgaagcattgagcaaataatacattttaataatcaaatgcataagttaaaaatggtctcctacaataatcaatatgtagaaaattttgtaatgtttacaaggaaatattcagaacaaactctcatatatcaatatatctgaaaaaaataaagtattctgcgttctgtaggagtcctgcatctggaaaaaaaggaaaaaagatcaattgctcacttctcaatggagaagcccagcagtaaattgtgaaactttttgattgagcgatatgataccagtgtgatgtcccatatatggggaccgatcctattcttgtgagttgtgacttcagtttatgcctgccacaggccggctttaataagtggtggcccacttccatttttcccttgctgatgcacaactgcacaaatacgtattcccttagctccacaagaaacaaacctatgacatatcctaatataacgaatcgacacatgatatatcacatatagtattaagtttgtttttggtgggatggagaggatagaactccaatgcaatctatgaaaagcgctcaggggtcttccagtattaagtttgtttttggtgggccagacgttctgggtttgaaacctcaccccttctaattatttgatattagatcatttcctaatatttgcgtcatccttttactatctgagtagagtattaccagtgttttacacataaagtaatcaagcatgcatgcaaaaaaaaaacattctggaaggtgctagatttcatgtgtcaatccaactacatgcatcgagctaaactttgcgtagttgtaacgccccgattttcgttcgggattaaaaatcaattaataatgcatttctagaaattatattaaaagttaaatcaatttaatcaagtgaaattatagaggaaattaaaatttcctttaaaaatcattggccgggaatattttgcaatattctttgtgccctaaaatactctccagatttttccgcaaattttcggagctcaagaaataattttaaagtcacaaagatcatttaaccaattaaataaaaagaaaacaaataaaatcctccttcctctctttgggcccctttcggcccaatccctcctttctctcccgcggcccgcgcgccccctttctctccctctcgggccggccacctccctaggcccgctcggctctctctctccctcaagtctgctttacctccctcgcccgttttcccctctctctctctccccgacaggtgggacccgaggccccacctgtcatcttcttccccaacctcccatcgccccaactgccgccatggccgacggtttcgccccacgatgccgtggctcccgcgctccaccccgccccacgagcgcgtgaaatcgatcccctccacctcctccacctttccccccactcttcccgtgaaaatcggcgccggttaacccctccaccaccccacgtcggcgccccactttgccggccgattccgccgctccccggccctctcctcgcccccttgagctataaaatcaatccccgtggcctcctcttcctttttccccgttttcccgagtcccccacgccctctaccgagctctccacgccaatccccatcgccgtcgctcgccggcgatctccagccgcgtgccgccgctgctcccgccgtcgccgcgcctcaccacgtgtgccatcagcttcgccatcccgcgccgcacgccggcctccactcggttttcttcaaccgccatcggaaccacctccccaccgtgtaacctctctctgccgcttgccgccgaactccggccgcctctcctcgtcacgctagccaccgccaagccgcgccaccgccacagtcggcttcgccgctccaagccgagcaccggccaccgcctcgttcctctaatccaccactgagccggcctccccactaccaaccagagccaccgtcgccatttccgcctccggccgcgccgcgccgcctcttcagtccgccccgtgttgtgccgtcgccctccgcggtaccgcagccatcgtccgtggctcagcaatccctccgtgttcgccggtcttcgccggactcatctccccgtgcctcccggtccctccgaccatcggccgccggttcctgctcacggaacgccgccgaaccgccgtcgccgctgcctcctcgaggagcgccgccgcctctttccgccgccggcgacctcccgctctgcctcgtcggcccgcacgctcggtgagcccctcctcccgctccccttccctttcgcgtgcatcgccactgcccgtgagcgccgccgtcttccggctgctcgccgccgttcggcacagccggctgctgcctccggaggccgcacgctgcccagcaccatggctcggccgagccggtttcatgccgtgcccatgccccagccgcgccgcctcgtggccgtccgatcggctttgagccgatccgggccgttggttcccatggaccggcggtggaccgcctcggtggtccctgtccacggtggatcgacgcccttgtgccgctgacaggtggggcccgcctgtcggcgccggccccctctcttgctgacgtcagcggcagtccttttcctttgtgaaaatatttaataattgcgcaataaatcattaataattatagaaatccatttaaatggttcaaaacttctaaaattcatatctaattcattcgaactccgaattgggccattcaaattgcaaaattcatctaaaattgagttctacatgtttgtttactttttatgtattgtttccttggttttattagggtttttcctcgttttgcgtgccagcatgtagaatccgtcatttcggacgatcgcggtcgcgaggaaaagagttcagaaaatccaagtggagaagcaaggcaagtcacacatttcccttgagcatgttgttcccaatttataaatgttttaccatttgcaaataaatatgcatgttttgctaattacatgggatcagggtttacctatctgctcgcttgcgccatgtttacttgatatctgtcctttgtcaaccgtgggtaataaatcgcctagcttgtgttactttgatgacctagctagaactatatgcttagccatgcttaattaccactagctcagtcgatgggataattgcagtattagacctttctagtatcttattgagctgcgtgctcgagacatctggccatgtttcatggtcgtaattatccaactaaaatgcgactgaatggtgggctgtgggtgcatggttttgtgagtcgcacccatggcaattaaggaccggttcacgggaaaccctggaagacttacaacgcttgccacaagcgggagtgggtaacttcttgaacagaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcacttgacatggtgacgtgtgcatcatgggcacatgatgacgcggtgacatatcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtataggtgggttggttgggcctgttcaacgtggtatagcgttgatcagtggagatctaatttaccttaattattcaacagttttactgttttgctcaacaaaatgttttacaaccgcctttatgcaaatagccacaagccattcttgaatccccttgcacgtctgcatcgttggtgtggcctgctgagtacggtggttgtactcaaccttgctattattcccccttttcagaagtgtagtgcttctgagctgaagacgaagttggaagaccaaggctcagaccccagttgagttttgcctgtggagtggagctgaagccccgctagtatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctagaaatttgggctaaatttctgggcatgacagtagtatgatactctcatattgcatattgcatacaaactcaactactacaggacgagaatcacggcatgctcgttagttgccatcactgccaatttttaaattgacaatgtatcattcgtcatttgtgggtgatactcctcctttacctccaccgctcccacactcgcgctcggcgaggatgggccgcgcatgctccatcggtgcactcgagaacagcgacaacaaggtccgccgtgggccgtggcgtccacggcccctgagctctgcgctcccccaacccgaacaagatctggcgtcgtccctccgagcattgagaaagaggtgaagagtgatgggaagagagaagagggaaggatggagaaagaagatggaactgacatgggttccatatgtaatgatattttggtctatatgatcacagaaaacatcactactagaaaaaaacgttttgccaagcaatcaaatttcattatttcaaacggccaagcgttccacatgcacttgaaggcatgcggaaatagatcatttttataggcggccttcggatccgcctgcaaaaatcatttttggaggcggcctcttctttttcgtaggcgccaaatccacccgcctgcgaaaacatttctagcgcaaaaaaattgcacgccaccaccccctaccgccgccgccctaccagcttcggccgaatctagggttagggttttgggagggagagggaggggagggaagccgcgttgctgcccgccaccgccgctgcagggggccgctgcccgttgctagggatgaaaacggatcgaatacggtcggaaactagctctatcatattcgttttcattttttttttggaatcggaaacccggatatgaaaacggaatcgaatattatcgaatacaaatacggagcaaatacggagtgaaacgaataaggtgatgaatattaattggaatataaaaaccctcaccactacacaaatgatttttatgtacgaggccctatgatttttgcaaacagaccacaacttgtggcttcgacattttcgcatacgactcattaagacaccaaaatgagattatttttacatgtggaccacttaagagcccgcatagaaaaatcaatttttccatatgggcgtcttaaggagccatatgcgaaaataaaatttaaaaatttgaaactagtttttctcagtcatatgaactctaaagtggatgattctttttcctaaatgtttctaaaatcatgctcttttatgttattgtgtttttactgctattattttggccaatttttcttgtaactttgttttatcaattaaaaatttgaatttcaaaacttcaaatgatattttgaagcagtaaataatttcagctgaaaaggtcatgaacataaaagttgtagaactcatcaagatatacaacttttattttagtcatttcttcatccgacaaag

SEQ ID NO: 15772 - DNA, 4609 bp, Oryza sativa
agatcttgatgagttatacaactttattgttgatgaccttttcagttgaaatcatttagtattttaaatgttgtttgaagctggtatattttcaaatctaatttcaaactgtgcaaacaaagttatatagataaatgaccaaaataaaagttgtagatcttgatatgttatgcaacttggttgtatgccatcttttccattgtaattatatcctacctgaaaaattatttgaatttcttatattttaaaatttagattttatataggtcaatcgcctcgggatggagaaatgaccaaaataaaattggtagatctcaatgagttctacaactttattttttacaacttattcatatgagttcatttagtataataaaattcaatttgaaattcatttttgccaaagagtctgatttgcctcctctttgggttgggctggcttatgagctatggcagccttatgtgtaagtcggatatccgatggaaaattccggataatatccgacggatatccaattccggcggatatcacctatatcatattcgttttcatattcgaattcgaaaattttcggatatattcgaccgaaactaaccgaatccgaaaaaaaggtccggtcgaacggaaattatccaaatcactttcaaccctagccgccgccgccctcccccctcccctccggccggatttgggagggggagccgccgccgccaccgccctcccctctcctcgctccggcaggatcttggagagggaagggagaggagccgcaaatgttgctccgtgcctccgctgtcactcgggaggggagccgcctccgtgctgtcatcgtcgtgcgcccgtcactccccttcctcccatcggatcttggaggagagagttgccgccatgcactgtcacttcctccactgccgccaccgtcaccgcgtccgtgccgccatcgttgctccccctcctccggccagatctaggagtggggagggagagagggggagccgcctccgcgccacctccaagccgcgccgccactgcccttccctcctccggtcggatttgggagggggagggaggaaggggaggggagcacagtgaggggaggggaggagtggtgaggagatggtgtggtgagaccgggtggtgatttttataacttcaaaactttttgcaggcggacatcctaagatatcgcttgcgaaaatcgatttttgtaggcggaccacttaagacaatgatcctgccccatggatgttatttttgttaggcagctatttagctccgagagacctcgtctggaaaaagaaaattgggttttctagtaattgcatggttttaattttgcaaaattacagtgttacctagccaatattgttaatagtaatggtattttttaagtgacaattttgtaatagcatgttcaaatttatccttcatctaaaaccgtagatatgaggcttactctcccaccctctcatgtagctaaaaattaaaaagcggtatctataatcttgtattggtgcggcagtttattaaaataagacactagtaatatatatgcaagctttttttaataaaccaacactcttaaaatgtaaaatgattatatgtgtcggttcttaggtggtgtttgggagggaccttaaaaatagaactatgggaatagagccaagccgaccaccaagcaagctagctagcctagtttttttatgaaaaaattttatctatagtacaaacattttcctagtaccataaataccacaaaattcttccaccttttagaaatagcacagcaaaacactattagtataaaaaaataccacaaatctcaacgaaattgacgcgggtggggaggcgacgctacttttcaatgaccaagttgccacttcgccccttttctttaaccagccgtatcttctcccttttttctcgttcttcaccagttttctgttcaagacttgagacctcgcccatagcacctcctcctctcatcatttgccgccaccttcttcctctccttgatccccttttttcgcgatctctctctccactcaccgcctccctctctagttatgttgcatggctgcctcctcttggcatggcccaccctccctccgcttctccacataccaactctctcgccagcctcctctagtaccatctctcgatcgcatcaagaatttagatctactagattcagccgtcacgtgctcgacggccgccatgtgaggcgtggaaaacctctagtctgaatttgaaaggttattgtccaaacacattgatgatgatcattagcaaaaagggattcgcacagtttcaccacaagagagatatgcacaaaaacagccattttcttcttcgaatgatttcgtcgtcggctcatccaaaacgaacatcacaaaacgtcaaaatgcacatatattactgtccatgcaaaaaaaaaatatttattcgtgtccatgcaagatttgggaagaagccgacgttgctattgtgactttctagaagccactctcacgcatcactctccatctcaccaccagggcccacacacacaatataataacaataaaaaaacacaacccccggatgaaggggcccacctaccttcccgcgccatcggacggctgagcctccgctgatccggccacggacggcccagatccaccccgcgtacgtcgcgcgagcgtgagggcgtcggcgtcggcgtgcagatatttctgggcccccgtggggacgacgcggtgggggaagagataaccccagccaccatccagctgacgtctccatgacaggtggggccatgctatccatggcccacgagtcagtggcttgtaggagtaggagtcccggtgagggtagggggggtctggtccggataagacggctccctgtctccgcattgacgcgcgtgacgtcacgctgagaccccgcgcgctgtcgacgtggccgtgaggaggaggaggcggagacgctgacggcgtttataggcgggagtttttacgcccgtgggccccaccacgaagaacgtggggcccactacggctggggaggagcttatttttattctgccttttttttgtttatttattgttcgtgaggtggtcaggtgctgcacgcaacctcatgcgtttttcttttcctgtaatgctgtcctatttttgttacaaactgccttttatcttatgctcgtaagtcaccgcggttgagggttgctaaaccttttctccgcgtacgaaaaacaatgctactttattagcctataattattaaattaataattaactaaacaacttaaaaatattttgacgaggacatcaacactatcgatacatccacgtccccccaagtacagcatgatggtcctattacccgcgctcgtgtacgtcaactaaattatcaggtgagttctttcttgagttcatattcctcttctttataccccggagacgcgtgcactcgtgttttacttaggaacgatggagaggatccaaaggggagaggattcgcgcggggtggattcggactgtagggcagcgccaacttctgatggccgccacgacttcatgcgaactccgatttgggcgtgcaagtacttcatggaaagcttatcaagtctactttcaaatggatccagccacatgtccatatctattctggagcggccgcaattatcattttactcccgactgttttctgtccatggtgctgcgtcacttcttttggcccaatgggctgtgtatccaagttgggcccattaggagtgcgtcctagggttggagcacgaccctatggtcgttcttcccctcttcttatacctctagtcgccgccaagaacactgggggttttgatgatagagatagctacttgctaccagctcgcagcgcgcgtgttagctaaaccgcccgtctgcctgtaatcggaaccccaccatattgtgttttgatagtgaaactttcatctttatctagcaatttcagtgcttgttctacttgttcttgcttgttcttcgattgcttgcaggacgagtgccctcgtggccgggttgacgcgcaccacaagttcgcggcgaccattggagacggtgtatcggttgctaaggcgcagcgtctttggacggttgtagtcgggccgtgaacgtcgtcttcatccaatcaagttatcccttacctctcatcgaaagatcgggccacaaaccctagcgggttcgcatcaggtggtatcagagcgtggttcatcggtgagagaatttacccttcccttcgtcattaattttttttcctatagtccagaaaaggccaacaaaaaaaaatagtagattagttttcccgtgatcctatagaccattgtgcctttttactagtactgcttagttaaggcttgttgagttttcgattgcatcggttgtgttaatttgctagtcttagtgttaggcgattagagtttcgagttcttgccaccaccgcacatcgccaccttcatcaattttgccgtcatcaccaccgtcaccgccgtcgcagtcacccaccaaatcactttctatttgtgtttgatctgttgccgatagcttttgtgagctgccttgtatcctgccgccactagaaaggaaatag

SEQ ID NO: 15773 - DNA, 3419 bp, Oryza sativa
cggtttagctaacacgtgcgctgcgagccggtagtaagtagctatctctatcatcaaaacccccagtgttcttggtagcgactagaggtataagaagaggggaagaacgaccatagggtcgtgctccaaccctaggacgcgcccctaatgggcccaacttggatacacagcccattgggctaaaagaagtgacgcagcaccatggatagaaaacagtcgggagtaaaatgataattgcggccgctccagaatagatatggacatgtggctggatccatttgaaagtagacttgataagctttccatgaagtacttgcacgcccaaatcggagttcgcatgaagtcgtggcggccgtcagaattggcgctgccctgcagtccgaatccaccccgcgcgaatcctctcccctttggatcctctccatcgttcctgagtaaaacacgagtgcacgcgtctccggggtataaagaagaggaatatgaactcaagaaagaactcacctgataatttaattgacgtgcacgagcgctggtaataggaccatcatgctgtacttggggggacgtggatgtatcgatggtgttgatgtcctcatcatatttaatatgatttttgaagcaacaaactgtgctttattcttcacctcaattataaaataatcgatctagtcataaatgaatattcaaaattcagataatatttggttaaacttttaaaattctaacctttgcattaattcaaaaatatttcaactgaaaataaaattgattccaaaacaccctaatgcacgaggaaacatgtatgggcgacgtaaggctatatgctaatgcgttctaacatgtttaaagtccccttattacatttttgaaagtttcactcttttctccatttgatgggatggtaatcacatctcaaataactatagctcatgatagtgatgtgaacgtccatcccaagcattaaaggtttcatttctcccaaaaaaataaatcgttgtatcaggacgcaattcttcttagtgttaattgaaaacggaaaaagtctaaattaattacactgctaaactgatgggtgagtacaaattacctctaaacccgaaaaccagacatctttcactctcaactattaatatcgaatgaagtacccctaattcaatctagagtggttttgatcatatgtggcagcgcagtcagtacttttatatatatatatatatatatatatatatatatatatatatatatcttctatatgcatcttaaattcttctatatctttcggagttgctcctatatcttaaatttaaagaaagcaactctttttttagtgcccatgtgcctatactgtcctgggatataatgatatgaatattcttctttttctggaggccatcttcctgctgccctggctggtctttctctttctccttcattttttacagaaccctctccgtatcttttcctttttcctgttcccaaatctacttccatagcttccattgcattatctagattatgcaaaccttcctcatccaatgagtctataaaatcattatattgttctgcattatcttcttcttctatattctctatttcctctatcaggttgttttcttcttcataactctctagtaataatttctcatttacttcccattgctcttcctcacttaataccttatctaacttttggatttcttctcttggttcttctgactttatttgttctattttaatttcctgggttctgggggtttctatggccaagcttttctcttttttttttcttaatcctggatagttctctatagaaataaagttccttgtctctaattttaggccactcacttttcatagagttattatattcatctgctatatctcttaatttatcttcataatattttatttcactttcatggtctaatttttccatcaattcagatatactatgtcttctgttatctataatatctctgtcagatgattctgcatccaaatcatccgaagctctggttttataatttgtaaatctaatactaacattccctttgctgtcttggtaacttatgaagttttcaggctgactcaaggttttattttttataaattcactaattggccatttttctcctgctctttcttcagagtctattattaaagggctcatgaattttattcctttagaatgcattttttctatcacatcatttacattgattttgtatttggaggcacttctattagtcaatctttctataaattctatacttattaataaatttgttcccttaaactcttcgtatccttttgtttggaaaccaaaactcattttatctatgaattcatttacaggcatcattaaatcaggcgctatataggttatcaacatattttcattcatatctccttctagatagcctaaagatgctttgtttattgtgtcccatcttttatctaataaggttattagcactttagctcctaatttctttcttgtcattcctttgattcctattatgtacataccttggtgaatatacttatatcctgaatattttaaactattttcaaattctttagctactatttttaattctagtggctttgttagaacacttaattctagttctctagatattctataaagcccattcttattctcaaaaaatcccatgcagtatacttgttgaggccttattgcccttaaagtatctcgttgatatctttcgagctgcttatctacttgtgcaacatctttcagctcatctatgtcatcatatttgcctttttgtttatcagaacagttatcatctctgcttgctattcttctaaagagactcctagatatgtccatttttcagaattaatggcttgtgaagatgagattatgccagatgaagccaaaactatttccttacctttactagagttgattttgtctagtaattctttaatataatcactattctgtgaaattttattttgccttatcttataatcttctaataattctaatgtagtatttagcttattattaagaaaagaatattgttctacaaattgcttttgttctttatatatatcttctaacttttgctctaaatcttcttgtctcttactccaatttatatagaaattatatattaaatctacaattaaatttagttggctattattagagtgccaactatgttcttcagtatggcttagtctacaccttatgttgatattatctttggtatttattaactttccaatattagcttctaaatttagcttctctatgattaccaggctctgataccactttataattaattcacaactattcactactattcttagtgctgaattcacttattatgagtacagaattacttagtgctgaattcacttattatgagtacagaattact

SEQ ID NO: 15774 - DNA, 30622 bp, Oryza sativa
catctccgcaggcagttccacccgaagggaacacttctatacgttaaatcaagcgccggctgtttttggattagccaccctgcaaagatcctaaaaatttaaagaaagttttcgagtgaacattaacctgtgaacagtagtgaacagtaattctgtactcatatatatatatatatatatatgtacttatgtatgtatgtatgtatgtatgtatgtatgtatgtatgtagagggagagaattactttttttaaaaaaaatggactaccacataggatcaaaaccatttcggattgaattagggagttcttcatcccggtattaatagttgagggcgaaagatggttttatgtctagaggtaatttgtactaacatcatagtttagaggtgtaattcggacgttttcgttttcaggtgtacataaagtttgatttttccaatttttgtctgcctcatattgaagtcaatgctaaatagttaaaattgataaacatgaaatatcctaaccgaccaagaaccatttccatataagtgatatcgtttccgaccgttttcatcccattgatgcagcaaacatgaaaagaaatcaaattaataattacaattaggccctttacaaagcctagctagtaatttttcatccaagaactgaagccgaacactgcacaatttataatgggctacgcaaaataaattgtgttgtacaaaatctatacgaaaacccgatcaaatcttactagttttgcgtgtgactatattagagcaagtttaatagtatagcccactacgaactccaaatcatttgtagccaatgtaatagccaattcatacaatagttgcttactatactattaatgcatggtctcacctgtcatacacacattacgtcttgaagtccgtgctgtagctgactatagatctgtagcccgctgcttttctctctcttcttttatctctttaaaatgtctatagctggctatatcttaggacactcatatgaggggtctcagagtgcctagggccacaactctaaaacctaattttctcacaatgcaagtggctggcattgatttttttagcacctggtactattctagttctcatatattttttcaatttatgtggaagtgcaaaattttaaactgagcacactagaatccagaaaaaaaaatcccctctttcacctctctccctcatcctctccctcactcttggttcccacggcgacgatactgtctctcctctcctcctcccacggcaaacggtcctcatctccttagcttttggtggccctcctcccctggccggtgcgccgatgagctcggcggcgtgggagcaatggattatgatgagctcgacagcatggagcgggagacgacagcgacaccaatggcacggtcactcttcctcccctcgcatcacgtcgcggtcactccctacaagctccctgacgcggccacctctaccctcatcacagcggtgcctcgaaccgagcgggtgtagagcagatcgatacagacaaaccgaagcaacaaggttgaggcagctttggtggtgtggcaaggaaggtgctgctacggatgggggtgaggtggcttggagtggtgggcgataacgagtgtttcgggggatgacgaggggctcggtggcttagagctggggacgacgaatggcttggcagcgtggagcggggatgacaatgaggtcctaaatgccagatcctctgtcgttgccatcttcccttctcctcacctgcgcctctaccgaggacgtcgctgccgctccatcgaagctctcctgatttggcttcaggatcacatgatctggctagcgccaccgctttggggacaacaaagcagctcagggtggtggcctcgccgatgaggaccacgtgtggatcagcttgggatgaccaccactacctcgaatcagctcatcgtcaccatttttcacagggtgtaggggcgtctcaggaggctatgcctctcccaacatgtagcacgagccgttccttgtgccacccagacgaattctgatgaggaacacatctcacttgggctccacgttcttcacttggcaacgggagagatgtacgtggcgtgaaatctctgatgtgggaggctggggttgaactacagccatgcacactacgaaagcccttatgtttcatagagtctagacggtttcatgctagtagtatcatgcataagcataaacagacatccttcgaactcccaatcagaccatcagcaaaggaggtttcaagtgaaatacactccatgttttggctgttttgactttcgcatgatcacatcaaatccagcggagccgccaaaaacccggtccaacagcgaacaaccgcgcaaagagccaaagcaaacaatcaaaaagcacagaccaaaacccggtcgacaccccgagcaccacccccgccctctacccgggtccaaaattcaaaaccattcgaacccacgaagccaaggaaaaaaaaaaaaggaaaaaaacaccccaagggcaaccctgtcatttcgccccgaccaccccgctccgtcacacccagacggccgccgttagccacgcgtcctcccctcattggcccgcgcctgctgccccgggattcatagcaggcagggccagagtagtagtagtactaccggcacaaggaaaacgaaagcagcaaaagtcacacatacactctctctgctactactactcttctactgctccactctgctctgctcgccgctcccattccctgcggattctatctctctcttctccaattcgcgcgggctcgggcgccgcattggcgcgatctccggattgtgagggtgggggtttcttgtcctggattggcattgcgttcttggtggggggtttttgttggctgcgttttttttttttggcttttctctgatcgggaattggtgttgtgttcttgctttgtgcaggggtttgttgtcgaattgttgggggaattgtgggtgctggttgggccgatctcgtcgctggagcaggaggggtttcaggatcggtgcggttctgtgtggttattggggattgttgtgatcaagattcggcttcttgcggtatggcgaggatgggcgaattgagggggaattggagcgaatcttgggtccccaatgcttgatctctgattcttgggaagtacattctccagattggtgcgatcccggcgtgaattttggggaatttctcggatcaagaatttggccaactgtccctgcaagaaacaggggaaattgggggccaatctggtgccaattggggagtaatttggaggtggaggcgatcgatccggccggggagatgattgcggcggtcggccggggaccggagggatggggggaggacgagatgtccgtgctaccgcggcataccaaggtggtggtcaccggcaacaaccgcaccaagtcggtgctcgttggcctccatggcgtcgtcaagaaggccgtcgggctcgggggatggcattggctggtaatttcgctctgccccactcgcaattgctttaatttcgatttcgcagatcttgatttgatttgatacaatgtgaatttgctttttcgattgtttttttttttttgggttttggtgcgccaattggatgctttagtgagtggttctgcttttgggggtttagcttaatttttgctaatccggattaatctcttgcaatttggattggtcctgttttgatctcattaattcaggatcgaattgctgctatactgatgtttcatgatttgtttgcttgctgattgagcaatgcagtggttttgattggtctagacttggctggctctagatcttgttgtgcatctagggttccaagtaagaattcttggctagatgtatcagtcttggggttttattcagttgaattttatcttccagtttttgtaatgtattctagatcgaaatttagatcctgtttgttcactgtttggttgtggtcctgattgcactgggaatcagttttttattctcccactgctcttgatctgtatttcaattaggctgtcagcatcagtcgtggaagttgttgaccaagattgcttgataaggttggatctggagtatctagattcaaatccgattgcaatcagtgctagtttttaaacgaaatttgaagtgagctgcattgttggtatgggtgaaaatgcaatcagtgttccagcttgtcagttgtatgggtagaaatgctgtatggttcccaccgttacatggaacttgtgaggatattcttgggaatatctgcatgtcttccaaatggatcattgtgtcttgttgatggaaagaagatgctaatggggtaatgtttcaagcatccattgtgctccaatttgtctagttcaaattacaagataggttttttgtgtgacaaatatgatcaagattttggtctttggtcccacaatgatatggttgcgagtgttatgtggatccaaaataatggttttactgatttcatgtgatgtgcttagaaatattattatgaattgtgtttggtcccactaagcaagtagatccaaaatcatatgttcccctgttttcctgtgaagtgcttatctgattcttagtcccattctcatagagcgaggctaacaagaatgcaacactggcagaggatacccatcagatgtgtttggatatttagatattacacgatttggacgttccacctaatgtgattatttttggggtcatgttgggtttggcaatatgtgcttctctctgttactatcttattggtttgttgttactaataactggtttttataatcttccgctattcttgcacaaatgtcttatctaaacaatcataccaaaataaggtcatgttgggctgatgtagctgcattatatggctgctgttctcttggttggtcccagtgtcttttggatgtgcactccttgcaacagcagatagattgaacattgaaatgagatgaccacatatagggggaatcacacttttaaggcgatttcgtattgtgcagaattttgttgaaccattaggatttatttcagttttcaaccaaatctttcaactacccaagggaatcaccacctgaaacctcaccttcccgaatttttttcacaaaacaaagaaaaagtgttaattcattaagctacaaactaaaaatcatccctgcatcaaggtttaccagtatgcggttaccgtgcagtcacctcaccatgtagtgcttatgcgacctaagcgattcaaggatggggcacctgttcctgtaggcagccttatgcattacctttttgcattgtaacttttttgtagaacactgccctgacagggtattattctttggaatggatatatcagatcttaggtttcgatcttaaacaggatatgcattgctcagtgcaagggtttaattttctttcaggtgattgtttgcctacaatttttgcttgacttcaaataaaaatgatattattggcttgttgtgctaggtgcttaccaatggcatagaggtaaagctgcaaaggaatgctttaagtgtgattgaacctccaactggcaatgaggatgatgataagtttgactgtgagaacatgcagtggaatagttcagatctgggtaagatcatattcatcccacacagatgttcttgcttcatcagcaatgttccccatgaacttcatactaaatgctgatcttctcaatgctttcgtattttgttcgcatgataaaattctgccgatctatgaataataatgtcgtatactttgttctatcttgtggggaaggaccaaaaaagacagtttacctgatgcacgacaccataattttctgtaaagagcaattagcccctagaattagcccgaacgccgtctgtgtcacggaccaatttagcttgtgaaaaccgaacttaaaataatggcacggttttcgtggcacctaattatgtccttcgatttggttgcatgcgtctcgtttgtaaatagttggtcttgtttaatcccattcttgcagcatccgatgacgcacaatcaccaaagccacagaggtcaaggagcaggcagcatagagggttccagaccaaatccttcagccgctccatgtcttgtgattcccactccaaggcgtcattttcttcctcctcaagggctcacacggtgcgacttttgcttccttggtttctgtgcttgtaacaaccattgcttgtagcaccccaatcactttccagtaatatgtgtcagtgtcactgtaactttgctctgtcacaacctttgtagtatttggactaaatccctactgttagctgtaacattatgtgttctccatgatgatgtggtggtcgtagctgaagctttgactgtgaaatttgcagaaagttgacctgagcaagctggaaatgactgcattatggagatattggcgtcacttcaatctcgtaagtaatcattcccagatcaagctccaccagttgaataaaaatataccatgaaaatggtgttctgactacgtgctgaacaggatgctagccctaacccatccagggagcagttagtggatgctgtccagaggcactttgtgtcgcaggttgataaacaagactcatctctctccaatttctacacagcagctttgcataaccatgcttgattgacatcttggtcgtctcttgtgaatcccaattgccatgtttaagcaattggatgagttgcaggtcatcgttggtttcgtgcaggctgcaaagaggctgaagacaaacgtgaaagtggcctgatggagagaactggttgtcttcaactaacagattcaagataggatgcaacatgtttggtcaatgttggccatgctatgtaatatatgtgcatgaggctgcttagatttggatggctagattaatgcacaactagaactctcttggttcatcgtctttatgttagctccctgtgatgtagatatgcagtatgctggcaaaggatcttgcaacctctagctcagttatctcctgctgactggatgtgaattgacatgacaaattataaatcagcttctcatatttacccaatcgtttatcaccatttcatgggcatgtctacccagcaaaaactaaaattgctgttggagctttttgaggataactcagcttccatgacatgttgacattggtaactagtttctctgtttatgaagaatttgagccattcatataacatacctgtagataactattcagaaaaggtgcaggagaatgctgaacaggatagtaaattaccctgccccagttcaagtttcgtgaaacctttttgcaatagcagccaagagcaatagagagtttgtataggggctgctgagtaaaggtttgataaaagtggcagcactagtcttcaccatgtgcacctttagaagttgtctactgatgaatgacaacagcaatacattgaaatggaaaagtgaacagcccgtgtagcagcttgtgcagtcatgctcgtgaagatgctgcttttagaaggtaaaaccatcagcataaatttttcaacaactctgatgattactagacaaaataaactgctatcactctgtgtatgcaatctgcattgagtaagacaactactaattactaaacaaacccacctcagaaagagcatttgtgttacataatggtgatcctagatggactccataatttaatgacatctgcaaacaataagatgaatcaaattaatcactcagcacaaatttcacagaattgtattgcggtccttaaagattggagctataccttgacatattcatctacaatgcagtaattcatcaataatatgctctcaaaagcacaaaaactggtggatagtatgtagccagtacttgattttgtgtaccgaatgaacggtccagacctcattatgagttactgagaataccaaaaagcggacaacatgagaaaacaatacagcaaactttgcataatccttaaaaaggactaaagcttgatgagttgccttgaatagttgagttggttgatagatacaaagagaacactagactgcaagaattctaaatagtcaacaatgtaaagcataaaagggaagactgtttcataaatgatatgcaccttagtgactaaaaagtaaaccctaattaacagctcgaattaactaagcaagttacactgctaccatatttggagcattgatgccaccctgcaccctgcactttttttcctaaaatagaacttacaatagatatgaacatgcaaatagtttgtcacgacatgaataagaaacaactacttaacacaacaaccgcatgcatcaatacaacactacaaaacaagttgcttctcaaccttaaaaaaaatgtaaactagaagtttatctaacttagaattccagcttgtgcaaaacaaagttacaaaattgtgtaataactcttcaattgtggttcctgccaacggaagtttctttatgacatgtcttcatccatatcatttaagttgtactgaagcagttgatctccaatggaccgctttcttaaaataagttcggaaatacttaaggaattttggtgaacgcaaaaaggcaactaaactgaacagggtatttaactattttttttaaactcgttagtaagtgtcccagaattcgcagcaaattgattgtaataagtattaacagatgaaataaaacagaactctccaaaaaactattgagctccttgtttttcactgtataaaactgcgggccctatctttatattgcagtaattagaagtgtcttcaacaaaaggaagaggctaggaaagtctacgcaaaaaagatagagtttgccttacacttgattttttttaaaaacttccaagctctcgaattaagttgtttgaataagatgtttctttacaatcagtcttttggagacttccaactgctcagagtcatctataaattaccatcacaatcaatgtttctggtaaacacttcaactgccctactccaatggattttccccgtttcaaatagcaattgataacatcacgataatcagtttcagctttcaaggttctcaaatcatatagatgcttttgcacttctttttttcaatttaaatgttaccatccttggggcagcagtcctaccaagtacagagtaaagattaaccaaatcatttacagttccatgtttaggtatatattaaataaaattaaaaataccaacagacctgtgtgtcaatatcatcatgttcaggcagcaataggtgctggaaggattcagctaatgaaagatgaagattttggaccatcttctaaccatgaaaatcacaaaacagatggttacataagctatcttcaggggaatgctcattgcgatactgaagatgccattgcatctccattctctctcttcggtaatgttcagattcctgtttccgcccagccatttgtaatccatgtatcagtacttcatatgtacctgggcatgcagatactccattagcactcatttgcaagaatagttggagagccttatcaactttcccatcttgaaaataggcactcataagggcagtgtacgtaacaacattcttgtctgtagtcaataatccaaaaatgcgcactgcggttgaagaatgcccagcacaagccagttttattattaatatagatgatagatatgtcccaagattgcagccagatttaatcaatatttcaacgatctcaaacaccaaatcgaatgaaccatttctgatgtaatgaccaagaaggctgccatatgcagatctatcaagttcattgcctattcttagactgtaacgcagaactgcaagcccacatgatggtctgcagtttgcacagcttgcttgaataatgtcagagaggatatgtgattcaaccttgatattcttgggggtcatttcatttatcatgtgttctacggcggaccagtttctagaagccaaaaggtacaggatcgtactcctgacagtaatgtagcctagatcagtaaatgctgggtcacattcgatgccttcaaatgcaagatgcggattcacttcccgaagaagattgtcactctcaccattagcttttagagcttcaagtgcttccaaaaatataggtcggcgaagcacgatgaaattttccttcatgtattgaagaattcgggtcatcactgatgtctcaccagccctggagcatttctgaactagaatattacagagtgctttatctggttctacaccagcttcttgcatcttgtccataatttccatagtagcttcaaatttccctgaagtaaattagatttgtgttaggatatgatggtacaaatattataacttaatgcagtgcaaattagaagtgaaaacattaatcaaatatgtgatgtatcataactgccaagccaatttatcctgcctaggcagccaccttgcttgcccaactagcacctcttacatcggccagtactcgtgttaagttgcagcagctgtagagtggagttcatacaatggtgacaaggattttgagattgtttactgcacttcagtaagctaagaaacttttgcagcctagactggatttgcctacctatgtacagagtattccagaatgctaacaattgttcaatcttttcttcacaggaagttgagcacaaatgactcaatgaatgaagaacttcagatagatattgagtacatctaaaaagagatagatattgggtatgcttacaagacagtttgttataaaagggatattctgaaggccaatgaatgcaatagattaatcttactagccaatagatggtgaactttaattgtgcttaatttaagcactaacatgtctacacaagctgagattcccactgtactctaatggatggcatattctaattgcatgccatttagcaatccgttgaagaaattagagtgcaaaaactaagcaaccgaccaacaccaagctatgttcatcgagcaaaccaaccattggatcttccataccattcaggcatttcatcgaacaacagatcaacagctcacaacgagagtgcagtacagaacgtagaggtaacaaacaacatggtaggcatttggtcgaacacctcacctacgttcgcgagatgctcgatgagcaccgtgtacgtcttgcagctgggccgcagtccctcggccaccatctcctggaacacctccctggcctccgcaggcctcccggcgtcgaacaggatcttcacgcacgccgtgtagctcacgagggtgggccgacacttccccttccgcgcgcgcatctcctcccacacccgcatcgcggcgtcgacgtccccggcgtgcgccagccagtgcatgaccgtggtgaaggtggcggcgtcggggtccacccccgcgcggagcatctcggcgaggaggcgcatcatggccggcacgcggccggcctcgccgaggaggtggagcatggaggtgtaggtgaagcggtcgtggcggaacccgccgcctgcgccggcggcgaggcggaagaagaggaaggccttgtggagaggcgggtgcgccttgaggacgcgcgcgacggtgtgggagtcccaggcgaggcccgggagggagaggaggagcggccgcgccgccgaccaggggtggccgcggaggatggcgtcgacgcggcggacgacgtcgcgggtgtaggtcggggtgggcggctcggcggcgggggcctcgcggcgaggtctcggccggcggcggggtctgggtgggaggaagtggcggctgcggcggagcattttgtgccgcggcgatgaaccgctcgctatggagggttgcgcactagctttatgcgacttatttagggggggttttttttctcgtttttattggaaattttcttataagcacttaaataattgcatagcctatcctacctttgataacataacagtagcaaaaatacgtaaaatacacgtgtgctctaaaaaaaataaatgtgaggaaaataaatagaagagccagttaagttgtgaaaaaaaaaagtttaagaagacatgcatggtttctactcctataatacaggatgataccataaatagactttgagaggctaacatgtgaatcctatagtctatgggctcacatatgaatgaccaatgttagagtgatcacactggcggcggctcgcggtgatcacagtggcgggtggcggcgccgtgcggggcgcggccggcggcggtgcatagcagcacgcgcggtagtcgcggctctcggcaacgccgtgtggcggcgtggccggtggcacggcggcgcgatgcctttggtaaagcctgttttgaagacgtcttgatccgggcgcccaatggtcgtaatcctcagggacgtcttgaaagctttggatgattttcatactggatcatcgaaaggagtactaaataagatggacaaaacatgttgcaagatgcgaggaaaccgagccctacctcgacctagtgcgccgcagccaccgtgaggaagcggcagcctcctcccttgcggcatcgtcggttcgttgtgcgctgacgaatatgacttttaaatcttcataccatgactgtctgatcgcctaaaagcaggtacaatagggctccagaaccggcgataaaaactacacgtcagctctaacgatttgctcgaggagaaaacggaagagagagaacgagagcaagcgactaaataagcgccggctacccacgcgctccaagaaaacagacccactaaaagggaaggaggggagggagaaagaggcagattagagaagatggtgggtccattaagataataaaatattagtgctatactatttctattgtacacattagctacactttttactatagatgacatggctatttgttggagctgacagcaggttatattattgaccttgctctaagagcatctgtaatgtatagtgcaggaaggggctcatatggcgggccccacagcacggatcggatagcatctggtgaaaatttttgtaatgtataggcatcatcagaagtgctatgagtgggacccatcaaggttaataaaagaaggcaaaatttgctacaggacatcgaaaaaacgtgtaattagctcctggacactcgaggccttattttaatatttcctatgaacttggagagagaaacactggtgagagtacgattttgcccctgccctcacaccggccagagcaccgctgccacctcctccgcgcggcggcggcgcgacgagcgcgttgggcagagggggagaaaggcgagcccgctctgcgccgcccgctgccgcgcccacgtaggccgccaacgcatgacatcgcatgcacatccgcgccaccgccgccagccaatggtgcgcaggccgccgccgccgccggcagcaaccgacgcacgcgcgcaccgctgccttccccccatctgcgccgccgagctggaagacgaggaagacaacagtgacaaggacgacaggaaggaggaggccgtggagctcaagatgctgcgcatcgaccgcgcgtggaagtccgtgaagccgacgagctccgccggtggccgccgcgggctgatgcaggtggagctgctccggcccgtggccgtggtcgaggaggaggcatgctcttgtcgacgggaaccgagaagcactctggtcgctggcgacgagcaccgccacgccgtcacgccgccgagccagctggaaagagctagctcagcgccatatgcgaaagggaattcacgagtatgtgcatgtgctctctccctcccgatcaaaatttcccctccttttttttgtgatctctccatctttatatgtaaattgttgtttgatcctctcccttgcaattgcgaagcaactgccattgacacggcaggagaacgggacaccggcatcgaggctggcgaggagcagctccgcgacatcacaactctccaccgtcgcccacgcgccgggcaccgtgttctccagtcgccggacattgtcgtcgatgtcagtgtcgtcaatcaacacgtgcattagctccacgccaaaggggtcgtcggcggcgagcccacgcacgccggccacagcacggagcatcccagcgatggccgccgccgctcagacccatcacagggacataacacaagcgcattgtcatcggtgtcggtgtcgtcagtcaacacgtccgttagctccacaccaaaggggtcatcggcggcgacgagcccacgcacgccggccacaacacggagcatcccggcgatggtcgccgccactcggacccgtcacagggacagaacacaagcgctgcacgtgttcggctttgtcgccgccgccggccaacccaatgctttgtcgctatccaggtcgagaccaagggcaaacttgtttttatttagtgtttctctctccaaattcacgagaaataataaaataaggccccgagtgtccaggagctaattacacgttttttgtgatgcccgttagcaaattcttgttcttgcggtgtccacaaactaattacacgttttttcgatgccctatagcaaattttgcctaaaataaagtttgtgtagatgactgcctatgataggtgggacagagactctttctcgatagagttgggcatcaagactagcgcccggttctaccttaggagcagttaagagttgggcatcaagactagtgcccggttgtactttaggatcagcgaaaaaaatcacccatacgtgtaggaccgatcctatttgtctctctcctatagaatctctctaaattccacattgcgcatgctctgagtaatgtaaacgcaagtgcatgcatgggaatccgaaatgagatatacattgtttattatcgctttcaatcatagtaaaatactagcacgcattaaaagttgaggttaaaaggttggttgcacatccaatgtattagatttcagagcaaatacaataaggtaacgtaagagcacccacaatggtaaagtaaggtgctatctataaaacatgtacatctcagcaatagactagattaatagtaaaccacttcaatggtatgtctacatgggtatctatagctctctaatccattgcctcgtttttctctatagactatctccaggttagtagatagctttcctctctctcttcatttaatctcttccaagtaggaaaatatgctgacatggatctcttgtagagagcctatagataaccattgcgggtgccctaagcgggctatataagttgccacatcagatttgtgcttgtgtgaaggagagaggagaggagagagaacaaaagcgggctacagatttgtaaccagctgcagcacgagctccaataaagtatgtgagagagatatgtggattatacattaatgatgcagtgtatttttatagctaagtattgtatgaatgagctattagattgactatagatgatgttttaaattttagagctagtagtgggctatattattaaacttgctcgtactacttcaatgccatcttaatcattatcttataaaagtgtgtttcacttgcataaactcctaagagcagatacaatagcaggctataagccagctgtaaacatattttaaggagataaatgaggagagagaaggccagcgggctacagatttgtagtcagctgtagcacggactccaagacgcggtgtgtgtatgataggtgggaccatgtattaatagtgtagtatgtaactattatatgaatgagctattagattgactatatatgaattggagctagtagttggctatactattaaacttgctcttacagttcctccctaaccgtttcagctgcacgcacttaattgtagtgccaattatgtatgtatttgctgaaagttgtagcatcaaaccaaagaaaaagttatcctcaggtgtgtcgctatcaacttagcttatagagaaaatcccttatgtacccatgaaaactcactcaatcccttttatacccttgaattttactcgatcctctctgtacccttgaattttcgctttgattccttccatgcccctccccccattatgtttccttcattttccagctaactgtggttgcaaatatccataatactcttgtagatggaggagcaccaagtagattggaaaataattgaaaaatgttgactgcacaatatatgtatgctatgagactaaataatgagtttaagaattttatcatggtattgaagaaaatacaatacattaaactttttattttgaaaaaaaataatagtgttagaaaatcaaagtgacatcagtttccactgtaaaaaaaaaattggtacagttagcaggagtgcaaaacttgctgtggacaaaggagaaaatacattgcaaaacatcaggagcatccaaaaatattaggaccattaatagcaccacttgataggaatgaaatgagaagagcatccatgcagaaatttgtgaaacaaaatacaattaggtcaataagagcatcaggaacatcatacatcatcattcacagagcacttcatatcaatttcatttccatcatccatacagaatactgtaattcatatcatgcacacaccagaatttcatttccatgcctgcaggaaccaaaccaactttccattccatacatagatgttgcaaatcgacaaaccaaattaggttcctgggcaagaagaagaaatgaagaactaacctaccactagggcagtgctgggtccgatgatgggtggcgcagcgacaggagggccgtggccggcggcgcccgcgaagcgagggcagcaaacttcggcagcacgacgggaggacagtggccagtggagtccacgacggagggccgtggacggcggcccccgcgccttggacgccggccaacgcgacgggagggcagtggccggcgacgccccaccgcacgccgcctgcacgcgacaggatgggcatcgcaagtggcgtgtgcaacgggaggacagtagccggtggcgcgcacgatgagatggcagtgaccggcggcgctctcgacaggatgggatgggccggcggcgagcgcgacgggaggccggtggccggcggcgctctcgacgggaggggatgggccggcggcgcgcctcgtgccagcgcgtggagaggatggggagaagagaagggattggattcgatcttatttgctaggattgccaggggcattttggtattttttttgaaaatactgacaatgtaacaaacagattaagtcacggatcaaacggaaacctaatgggaggggcatggaaggaatcaaagtgaaaaatttgggggtacagagaggattgagtaaaattcgagggtatgtaagggattaggtgagtttttatgggtacacaagggattttctttttgagggaaactactgcgggtgtttaaagtactagcctaaactttttattgaaatgaagaaacatttacaggagaggtgttacagggggtgagaaggggaaaataaattaagagataattacatagaggtaggaggcccagttgcggagctgttgcttgctctcagcatttttacatcggtgggaacaaaggtcaatgtcactagcacaacgttggagaactaacgaggcaggatcgtcaacggaattgaagaccttgttgttgcggcgtttccaaatattccacatgacggcaagcaggatggtgtgccagactcttggagtggcgggttgtcccggcggaggaatgtcccagacaccttcaagctgcggcagggaggcgatttgttgttcgtccaagccaaaggcgtgccagattgttgccactccggtgtagcgtaggaagaggtgctccacatcttcatcggaggagcaaaaaggacaacgagcggatgctgctggagcggcggttgcagctggcgggggccagagtggcagtggcaggcgctggagcaacgacggtggcatgcgagcgagggttggagcggcgacgagcgctggagcggcaacgactgcgtgagggcgagggcggcggtggcggtggcgtctggcggggaccgaagtggcaacggccggcgcgaggcgggcactggagtgtccaccaccccctcccactccgcctcgccacctccatgtcgtcgtcgtcgtcgtctgcatgtccttccccctctcccgttgctccagcctccatctccgtctcctccgccatcgaattccacacgctctactaccacatcaaggtgacgcgcacaccctctacgtgtatgcttcttgtttgtgttgtggcgtggggattggccgtgatgccattgttgttgttgttgcttgtgtgtgcagacaacgaagagggtcaggtggataaggcgcgaggtgcacaggcgtcatggcggaggcaggtgagggctggagctctacaatggtggtatcgcgaccagtgctcctctgtggctccctctcatgcggccgacctccttcctcttcgccacagtgtccaccatcctgtcactgccttcatccccacgcccgtctctggccctcacccatcgccgccaccaatccggcccccgctccccgtgtacgtccaatggggaagagaaatagggatagaaagagagagaggggagagagcgggaggaggaagaaggaagaaggagagaggatgacatgtgggcctcacatgtcagtggctcccacaatatcttttgtgcgaatgacaaatgggtcccgtatttattttttaattctaatgccataagaaccacatcaatgccacgtggaacgaagactagatcaacaccgccacgtaggcgtcatgtcgatgaaaccgtcctccaaaattgccaagggagtcaaagtccatcggttttagtagttgaggtggtcaagatatccggtatcgtggttcagggatacgagttagatccggccactaattaaaggtgtcaaattaaagtgaacttattccaagaggggagaccgagcttgagagagtgagaggggaggaagaggaaggaggctgcgtgggctgggatgaggaaagggatgatgtgaacaatgatcttagattttttcaggaatttgtgtgaagggatgttgatgaatttgaattcggtttcaatttaatatttgaactcaggatcaggattttaagtgaggtgcaaagaaaggagttcaaggaaaattttgatagaatttgatattggagataagggagaattaatttggagggaaaattcgagctttagattttgatatttgaataggaattttgggataagtttttgggttccaatggatggattttgagatattttagatctcatgattacgtgaccatgtttcctccaaaaactccggtcaggaacacaatgtccaccagcatataggattattttgtcgggtctatctatatttacgccgccacattttttatcaaaaaatagtcaacgtgtatttacattgtaaatcttaaaattacatatataagtcttaaaattacatatgtaattttagtgtatttataatgtgagttctaaagctacgtatgtatttacaaggaaaaaatatagcgtctccttttctatgattattaccttattttgatgtaataatttggtgttaatcatattcttatgaactagcgtgtgaacatacattatggcagagacacggaagtactccggcacgaatctaataggagatcccggggatacaaatctgactgtaatctaacaagatttatggcgacataattatagcaaaaccaaaatcaaatatcagattagccttcataatcataaacagatacatgcataatctgaacttacaaaaattaattaagtgggtgcaaatgaacgcaaaagcccctctcacattagaggccccgactgattatcacatctctaattaacgggtggactagctgtgaaagtcgcaagagccacgatcggaacaatagaggcacaaaccatgtaaaccgcacatagaaacattccatttccaaggccatcggcattacacctgcctgttcttggatacacaaccgtgaagaaaacaatcagtagggcaaagcacacgggcaagcaggtccactgcacacacacacacacacaaaaaaggagaatggattattactctatttaagttattgtgttataaaaagcatcgtgaagaaaaaaaaaactctgttggaaaattaaaaaaaaaaacagatggagtagttactctgtaagggatgacccaggcaggaaggggaggggccatcacctccgtgttgcaaagatggagaggacgaggacgtccttcctcgagcaagctgcacagtagatcggacgactccggctccgacgacgaaccacccatacggcaccgttgcagaacgacgtccgtccgtccgatccacgtcgtgttggtgatggcggcgacgcgtacggtctctattttgtggcgatacacggcaaggtcacacggagtaatatatatatatatatatatatatatatatatatatattttttgatactgaatcggagttggaatcgcgcggttccggtccatgcataatccagtcgaattggaacgtgtcaatctcgtccgatctggagacggcttggcgaccggtttgaaatcggtttaggtgtacgattgtatattttctgataattggtttaggtgtaggattattttctcttttttcttttgctgtatattcctcttgtacgctactacctctgtcccaaaataagtgcagccgtgaaaatccgtgttcaacgtttgaccgtccgtcttatttgaaaaattttaaaaaaattagtcacacataatgtattattcatattttatcatctaataataacaaaaaaaaatagtaataatttttttttaaataaaacgaatggtcaaacgttgaagggagggagtagtatattagcttctaaaatatattagaaccagaacgttccttgtttattcccagggacccaaaataacatcatcaaattaatcataaaagaaggcaaaccagtcagccagtgagccagaccagaagaacatgcagtgaccgtctgatgcaaaataccagtatccagttaatgcaccatttgctcagccacaacaaaaaggaattattcagtgagacattatttctaaattttcatatgtatgcaatacagaatactcaagcatcaacctttgtattctactgcaaagagttttacattgacatttgagatatgagaataacatgaaacaatatatagtggaccatttctctcaatttgtggcagggctcaaaacagcacgataaccttgtcctacatatatgaactctgttattatgcattgcttttgataattcacccagtgatcatgcaacaaaacttaataagtctgaaagcatatatcacaaatatgaacttgtcgcggtattttgaatgcatacatcttactcaattccagtcgtaacaacagtatgatcatcatataaggaaaatagcaccacctaagggtgaaataatattgctaagaagaacaagtttcatgacgtgaatgtttatcctaacaggaaaaaaggtcaagagagggtgcaattgcaacagtacactaatatatgcatctggtccattggttgtttgatttcttatcctctactgggccacttgtcctcgggccgtgaaaaaaacaaacatctcacgaaaatgtgaaggcatggactactccaaatctttgtcagaccctgtgatgtaagcctgcgcgtagacaaatattattagggagttaaatataaaataaactgcataaattaagagtcgaagatatataccgtagcccaagcatacagatgtccggaaagcacgagcacaaagtagatccagaaaatcactgtccaagtttgatcatccagtaccactgggaacagggtgacattactgacatctgccaatggtgacaaaggtgctgcagagtatcccttcgcttccatcatctccaagtgaagagtgtataggaccagggcagtgaaactaataaagacgaagcggctgaaggacttctcaccagaattagatccaaacaatccaaattgaaaagccaggctgcccaatccccaaatggcaatgaaggccatcaaaatgtaatgatcatattcagcaggtatgagtggccgtacagagaataggagtgccaatggagtcagaagggaaatactcaatgacatctgccttttctcccagatgttatcctcctgtgaagagtctcaaaatcattagtactaacaaatgctgctgttcagttaaacactttagcacatatttctaagggatccaaatgcataccttcttcagtagaggtgcagagggtttatctctgctggtagccgctcgatgtgttgcctccatcccgctcaccctctcctctcgctgcgtcagggcgagctccctcctccccagaccctccatccagcgctgcagcgacgcgtcctcccggactctggttgctctttccctcccctgaagcctcccctcccatcgccgaagtgctgtctccgtccggactcttagcgcttcctccctctcccacagcaattcttgccggtgctgcagctccacagcagcagcctttgtagcatcatcctcagctttcagaattgatgttagcaaccgatcattcactgcagccatagtaaagaaatcatgcagttggttagtctgtcagtgtgatagtactactcttgcaagtaaaaacagtatttgggatttttgcagatgatagtaaaaaacagtactacgctgccaatttaaattgcagatgctacgcgtcaaaaagacaggggcatgccctgaatgaaaacgacctgaaaaacagaactgttctttaattattatttaacaattggtttgggatagtgagcagaacaagtaacaccagtaattaactagatttcgcatagcatgtggcatctgcaaactggtagcatcaaaaatcccaaataaaaggtagaggaaggccctgaatgcttcagaagattcagttactgtcatcactcatcagaacatcatgaatatttctacctagttaagcttgagcagtaatgtattgcaggaattaaacacattcctatcaccaatccatactcagcatgcacacacaggagtacaggactgcttgagtgatttccacaaaattcaacacaaaggcaattcacattactgaacagatctagtgcactgcttaccgaactacacaaacaaatgttcagaaaattcagcaacacgcatatcaaactaagctgctatgcttacctggggtgttgggcctgataagaacaatgcacagtgtctcccggctgtgaggcaggtcaatgaacagaggggtgagccgcccatggcggccggcccggacacacatggtgaagtcgtcgtaaccaatacgtcgcataaggtcctctctcaggagatccaccgatcgaccagtgaatcgaaccgaaccgaaaccgaagttatcggcgtcatcgacagtcacgaattggatctccctattcagaaggggccagcacggcaagtgctgcacagacagaatcaagaattgtattagaacgaatttgatcgattcagttgcacactgttaattcgcaacaaatcaagatttattcccagctcaattaacattaaggatttgcttcaattcgtagaattgcgtattagaaacagaacaaacacaataatccggggggacgagaaggaactcacaggcacgatcggtcgctccggacgagtggggactcgaacgcgcacaacctcccaccgcaacgtcatctcgttgccgatgttgacgtcgacggagacgccgtggtggcgagacaggaaaccctggttccctcgcaggtagcgcccggacctgtcctgcagaaggacgacgctgccggcaatgtccgtgccggagcatccgataggccgccacatgatgtcgtcgggctcagcatcatctcggtcgcgctgcgccgcctggagcgagcagcaggggagcgggcaggaggggagcgggcaggcgcagcgctcctggtcgcggtcgcgggcgtcgggggctccggctccgaggtaccggccgtaggcgccgcgaaggagcacgtagcgcgtatgggacgccccggcgacgagctcctcgacagcccacaccgcgttgggcaaccaggcgtcaccgtcgcggacgctgccgtggtagacagacctcccgtcctcgtcggcgtggaggaatgagccacacggccagagccgcagcgccgcaaactccacaccacggaaaacctccatcatcgagcgagcgagcgatcgatgtccgtgcggtggcgaggcgaggcgcagcgtcgcgtcgcgtcgcggtggcgaggcgaggcgagcaggagcgagcgagcgcgcgcccggtggcgagtagctacccctcggcttctcgcttctcggcgtggcgtggcgtggcttggctcgccgctcggcgggaggcggagcggaactttggtcgagcacttggtgggcgaggcggcgcgcgcgcggtggcgaggcgccgaggcgagggcttctctgcgtggggtggggtggcgtggggaggaagaagtagccgtagcggagggagaaaagtttgttacgtctctggctttctgctcaccgccggcatttgaaccgggcgtggccagagggaggagacgtgcattcacggggttgtgggatggacttttttgttcgggccatccttcttttcttctttgggctgggcttgaagggttctgttttcttgggcttggtgggtcccacaaccactattcactttttttttgaaaaatctgagcctgttttctggtcccactgctgatttttctcatttactccgagactgtgagagagagagatatatatagtcgaagctctaagagaggcaggggagcggcgatgtcgccatggtgaaagggaggtgatttcgccggagcgacttctagacgattcgatggtgaggagctcgttgtcaacggagattctctggtgagtacttattcccttgttgattctttcatgttttgcttccttcttccttccccttcgtttgttgtcggcatcagtagccaccgcaacatccatgatgagagtacgaggaggtggaggcagaggcggatggtttcattctagatttgaacacgttctaggagcagtgccgcgagtggtagtgcggccgtgaagacagcaacctctgcataaacgacggcatgaggaagccatgcatcgctgatcaaagccatgtgagtgtgccatttgttattgcttttgttcattgtcgatttctgttatttttgttactctcgtttttttttttgcaagtatttgctatatttgtgatttgggacttttgtttaggtgtttacagtgcgtatctggtggtttcattaatggttagttaatttttattttatttttgaacttgatttgatgcagatctagtgttgattgcactaggtaatgcaatgatttgtggttgatgtgatgtagctgaaggcaggggcgtagccaaggggtagtcccggtgggctcgggactaccctagaatttggcccagagacccccacccctcagaaaaaattaggcccagccagccgttttggcccaaatccaatagtaacagcccacgaagagttagggttgagttgggggagcctggaggctggagcgcttccacctccagccgctactcccttcgtgcccgatgcccgctccacgtcgccactgaccgccgcctgcgccgcgccgatggccgtgggtccgcgttcgccgtccgccgtcaacgccggcgcagcccagtgccgagccacaccgccgccgacgcccgtgggtccgccgaccgccatccacgccggcgccgcgccgagtttggggctgtctggccgacgaggtgacgacagcacgactcctccagtcctccttcgctcctcatgtcgctagctgtcgcctcgctgccggacgtcggccggttgccggcttgccgcagagccgccgccggccatctcccgtctgcccgtgcccgtcttcggctctccgctaccgtccagcctcctgctcggctcatcggctgctctactttaggtaatgaaatcttcctcagttcctctgtccagtgtccactcctgcttcataaatcgatttgtgattcctgaatctgagaatgattgagtatgcactttgtaaattgtggttgttgaatgttgattagtgaatgtatgccatagtttgtaggattggtaaaacatgaagatgagcagatatattgcatcgttatttcggaaccatgaagcaaaagcaaagaggattggtgatgaagctcctgtacccgaagaggaaccaccacaagttcctatatattaatgacgaagctcctgtactcgaagatgatccaccacaagaaatatatatggtaagcaacgtcacttctgctttgtttggtttcataagtatagttggcttgaatataatgtggcgaaggatgctaggttttgcatagtatgttgtatttgtttggcaatggaagtagtaattattttaagggtagttggaggaattggaacaaatccaatgcacttgacaaacatgtgggtgcggtaacaagtgcacacaataaagctcaagagaaatataatttatttgtgaaagatgcaccaattgataataccatagtgaatgtttcggatgagaataaggctaggttgacatattcacttagatgcctaagattttggatgagaacttgcttgttaagtaagccacttatgaatgttgcaaggcattatttctattgcatttttactaaatttgtacttgtgtatcggctttttggtgttagaaactttaagcatgtgatgtgaacctgcgaactaggactacccaaggaaaaattcctggctacgccactggctgaaggtgcacttaaacccactagtgggttttggtgattaatgacaaggtggttaaaggggactaacgtgtttatcaagtttatttacatgagtttagtcccaaagcatgttgtgatgactaagaatgcaaggcgaccccccaatttgaatgttcctaagtgcaaaaaggaccgaaggtgattagactaggtttttcactttcgaaattgagtttcagaaaaaccgtactattaagaggggtttcaagtgtggttctagggtatacacagtgctcttagtcatatccatgagtcaaaagatttttggaatcatttttgaaaaatgattttctccccaggacagagagggctacccgaaggttctggccggaacttccgggcgttgtttcaaagcaaaaaatttcctaagtgctgcccggaagttcctggcacttttgcccggaacctcctggcaggtttcccgttcaaacttgtaagtaacggctagatgacgtcacctagccgttatatatatggatttcgtccccaggtcaccctttggccattccactttagttcattcatgttctagggttttctagtcactcccaagcttcctttgtttcctccactcaaatttagagcctatcttgtgagattgagagaatagatgagagcgtaggagtgttttgagatggcttgaagattagggttgattgagcactttggataccttgtgggctgtcacttgggcttattactcttggagatcttctcctagatggttaggtgtcgcccgtgagcttccaaagatcttatggatgtcccgggaaagtttgtgaaggttttcctcacctccgcaaggaaacgaggtaagtgagtaaagattcttgtgctgagttttcagaggttgtcctaggtagagcaacttgcacttgtggtcttttctagaaggaattttgagttggatcttggtggtcactcaattctagaaaatgatctagaagtgttgagttgaaggctgtggacctcttctgggatctttgcataagtgaggcaaggggttaatcgagacccggctctttggagcaccttaacggagagtaggatccgtgcgatccgaacttcgggaaaaaattgtctttgtctctcttgtgcatgttcgttgtttgaatctgctgatatcttgtgatcttcatcttgtgcatatgtgtgcctgaacttcctagctaggacctgttttttttctcagttttcaaattatctctgctgcccggaagttcctggctcaagaactccggaagttccgggctactcatcctgcccggaagttccggtgttcatcaccaggaggtttcgggccctgtcaatttaaccgctgcgattgttgagaaaatttcaggaaagcctattcatccccccccccctctaggctacatctctgcacgttcaattggtatcagagcaaggtgctcttgattcaagtttcaccgcttggagtgatccacgatgtcgcatctagagggaaccggggggttggatgacaagggagacgcttctagcaccaaggatactggacccaagggagctactattcactttgattacggcaaacttaatgttcctcctcataactttgtctccgtgccttccgggcgtgttcctcaatttgatgggacacattacgccgcttggaagcacaagatgaagttgcatctaatttctttgcatccaagtatttggaaagttgtttgtacaggtattgatgtaccccatgatgacatggagctcacctcggagtgagcaactcatccaccgcaatgctcaagcttccaatgcaattctctccgccttgaatccagaggagttcaacaaggttgatggacttgaggaggccaaggagatatgggagaggaggccaaggagatatgggatactttgcaattggctcatgagggatcacccgccgttcgtgaggccaagattggattgttagaaggaaggcttggaagatttgtgatggatgacaaggagatacctcaagagatgtatgataggatgatgatccttgttaacaagattaaatgatttgggagtgaggacatgacaaatcactttgtggtcaagagacttctccgtgcttttggtccaagaaatcccactcttgtattaatgatacgggaaaggaaagacttcaagaggctcaccccaagtgacattcttggaagaattgtgtgtcatgagatgcaagaagaggaagctcgtgaagtaaggcaaatggtgaagaatgccaccatgatcaaaaatcaagaagtggttttgaaggcaaaacaagaagaagagtcaagttatgaagaaagtgaagatgaagagatggcttttattgtcaagagattcaagcactttcttcgcaagagtggctatggcaaagggaggaaggaagatgacaagggaaagaggcaatcaaagagagcttgcttcaattgtggcaaatatggccacttcattgccgattgtcccaagtcaaatgaagctaaggttaagggaggcaagaagaagccggagcgtgctcatgtggcggaggcacacatggcggaggtgtggtactccggagatgaagaagattccgaagtcaagccctagcccaagccaaaagacaaggttgaaggagaaggtggtgttgctaccgtcaccttcaagtcatcctcttaaagcaaggagcatctcttcaacaacttgagtgatgacgacgacgactcctgccacaactcatgtttcatggcacaaggccgcaagatgatgacttaaaatccctctcacacctctcttgatgttgattctagtgatgaggaaagtgataatgaattagatgatgtgcttaagagctttagcaaacacgctataccacatttggctaagttaatgagagctttggatagtaaagacaatcactcgaaaggcaagaagaattgcttattcttgagaagaaaaaaaaccatgccttagaggagagcctagctaaagaatgtgctaaaaatgaacaactagctaatgagcttaatttggctaatggttctctagctagccttagggatgtcaatgaaactcttcaagacaaatttgctaatttagacaaaagtcataaagatcttgaagttcaatttgacactctttcaaatagcacttatcaaccaaatgtggtttctaatccttccaacccatctactagtaatggttgtgctaggtgttacaatattgatttgaactcttatgatactaatgttgatgctatgcaagctcttaagaaagagaatgaaaggttgggcacattgatgaaatatggatgcatgaagacataccattcaaaagatgccctttacaagaccatcaccgctcatcctaacaaggatggacacgggctcaggttttctggtggaagtcctgtgtctaagcgtgtgatggtaaatgggaaagaatgcttgatgtttgtgagagaaggtaaagctccacaagcaagtgaggtgacttgtcccttcactggtcagacacccggaagttccgggcaaaatgaccggaagttcctgccctgtaagacaggaagtttcaaacattttgtcaggaagttccgggcttctgataggcagaaggggctgaccgaaatttccgggtataatacaaggaagttccggccagaggatctttactatgattcatatgtaatttccaaaaattcagaggcaaaaatggttgcttattt

SEQ ID NO: 15775 - DNA, 151 bp, Oryza sativa
gggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagt

SEQ ID NO: 15776 - DNA, 315 bp, Oryza sativa
agaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcaatgtaggaaggctgtatacatgggtcatcgtcgattccttgcagcaaaccacccggtacagaagaaaggcaagcacttttaacataaggccgaccaccgtacgaagcctaaacatcgcagcgggaaaacagtgtttg

SEQ ID NO: 15777 - DNA, 457 bp, Oryza sativa
catttgtgcaatatggatcttcaatttgcaaggaggtagagggcggcaccaaccaccctggcaccgtggttggggagggcggcgccagccatgccgcgaggcagaagggtttcgggctggggggagggcggtgccagctaccctggcgccgtggtccatgagggcggcgccagccgaggcctggaggcagaagggcttcgatgggggaggaggggggcgccagccaccctggcgtcgcggtctgggggggcgccagccgttgcccggaggcagaacagacttggcgaaaattttgaggggggagaaagttggtggggcccgcagaggaggggcacgccagccatgctggcgccgtggtatgaggggcggcgccactctggctggcgcccccttcggcctagtcagcacctccacgacagccctactgccacggtggcacgggcacggcgccagtgtg

SEQ ID NO: 15778 - DNA, 881 bp, Oryza sativa
atcagctcttcatcgccgttgacgccgaagactttgtgagcgatcaaggcaagtcatatctatcttgaacatgttgaatcccatattgtgaaaattatgttgttttacttatattgcattgctttataaattataatgttcattattaatattgttttattggttattcctatgctctttgttatggccatgttattgatttcatatccatgattgttgtgaaccctagtaaaattataacttgactagtctagtgccctacatgatggactgactagttgctttaggtaaatgcttagtcctgcttagttccaacttagaacttttggataaactagactatggtggttaacaactaaaactggattagtattggactattgactggtttgtcaatagatgggtgataaaattctttgtgcaactaaaacatctttttgggctgggctcggggtgcaagctgattactttggtagtcgcaccccggctaatataagaaccggtctttgggcctctgttgcaaggcatcttcgtgcaaccacaagtctagtgggtaagacctgactggaagtttagatcttctcaaaacaaagaccattggttggaagggtgtggggccaagattaaggccgttttttcaccgggcgcaagggggggcctgtctcatcccgggggatccggcaacctttaccttgtcggggaccggcgggcggcgaaacctcagcaggttctcctgttttgggtagacctagatggatagtcttgtcacgacctctatccgagtaccgtggtggtacccggcgcgtggcaacgcgtgttgaggttgtgtcttgtgggtaaagttgtacacctctgatcagagttaaaaactattcgaatag

SEQ ID NO: 15779 - DNA, 5626 bp, Oryza sativa
  unsure (1)..(5626): unsure at all n locations
gattaaaatgtttaaactatggctttctgcaaaataaaccctattaggccatttttcttgttttccctatgcattattattgcatttccggtgtgacttgttgagtacggtggtggtactcactcttgctcacaaaaataatccagaggatggacctgagaaagatgaaggcttggatctctagttcgctccgccgtcgagtgcctgtggctgctgctgttccgtagtcttccgctattttatttgtttatctttgagcgtgaggacctagagtcgcccatgaaataaagtacttcctttacgtttccgcaaataatcaacaatgctatgtgtacctcgcctcctgggacgaggattaatgcactgagcgtttggaaatggtgtatatttccgggcgtgacacctagggaacacaatgagaggggctagagggagattagaggtccgtggtaagctagggtgtgccgaccaaaggcggcggccatggagagctcaccgacgtgaggggagtgggctccggcgacaaaatttgacggcggaggggtggactatgtggccctcgggcttgcgaatccgacggcatcgacggcacggcccgacgcgacggctagcagcggctagcggcaaccggagtgtaggaaaagtggcagtaagtgggtgcgacggcgctagagcggaggaaggcacaaaagcgatcagcggaaaaaggaaaaagggagaggaggaggaggggtccatttatataggggcgggaggtcaagaacggccggaagtggcgcggattcaccggcaaagtgggggaggtacgggaggagagagagaggtgggattcaaaaattgaatcctggccgtttccagcgcaggcgtgggccggagagggggtagtggggtgcggggagtgggtggcgtgcgcggggcgaggccattgtggtgcggtggaggctggacgtggccctagaacagcgggagcggcattgtgggaggcggtggcggcctccggaggttgggggaggacccgacaggtgggccccacctgtcagcaaccccaggagacagaggaggggcgcgcgggctgttgggcctcggcctgaggccagcccagcgaatgggcgctggagggaaatgggccgaaggcccaagaaaaagtaaaaaaggaggaaaatgaaaaagaaaaagggaaaaaggaatttccagggattctttaatgcttgtgcgcgatttaaattgactagtccccaacccgtgcgttgcacgggctcatattattgatagaataaatgatagaatttttaatcacacgctaaatagttggttacttacaaaattacagttgcttgatcattactaatttgatgttataaaatgaaattattataaataataaatgagagtttgcgatttgtccaacttagtatttattaattttgaattttaaaattataacaatttatacaaactaaaaactaaacaatccatggtattttcagtttcatgttttatttaacacaaattcatgatacacatatggatgatcattacattccttaggtcatatacatacatatgcgttttaacttgcagttatattttgttgtgtcaagagcaaaactttcacaattcgaaattctctatatttataaattccaaaaagggattagaatgaactttatttcacaattttaaatactttatttagtatttcattacttaaattactttgtcaaagaagttcaatagcaaactattggtccaacagttaaagttttagacatattttttgcaagcatattaaaataatgttagaaaatactatattatttatacttaatatatatcttttaatccttatttagatgcattaattagctgctgttgtggaagtcggccttaattcaatgttttatttttgtgttgaaggataaaaaactaatgcaaacaataattattctagttgcatgtagaaaattcaagtatgttgaatccgtaaaagaaaaatatgaaaagattattgctatattccgatcgccctaaattagaggagagcagcagcagcagcatgggcaaaaatgcgagtatgttgttagtgtgaaaggaagagtagaagatatgatgagtatacttcagctgcatgaatattggcgtggcctaggccattcaaagtgcttgaaatttatgtacattttggagtgactgaaaaataggcagactcatatataaactattataaccgagtcaaaatcaaataaacacttggtgcactatcataagattcagtattgctaacttaatctccatgttttgaggtggctttgtatggctcgatctatctatgtgatcgatgttagcatttgccaataatcttttttaaacaaagtatgaagttaaaaaaaaaattgcacggactaaccttgttggattaagccttcaacatcttgatcctatacatgcaccatgtgtctgtcttagtccgtccatatgattcagccaggcaattagcttggctgatggatacggactgaaaaaaaaaaaagatagacatatatataacatcagggttaatcgataatcaatggccttaactgaaagcatgttgttaacaaattaagggtacatctctggcagggatagtcagccttgcgctgagcctctcatggtcaaatccatgattgtttttctatgcgctgaatcaatggggatacggagaaattactcacaatgaatcatgcatacatgcatttgcctgcaacaacagcctgcaaggacatggccgtgtggtcagcgtacatcgtcaccggcatatgaagcagcggcgccctaggctcgcaccgagatgccacagctttggcaggcgcggacattgcagcggcagaagccgaggcgactcggcgacatcgacgtcgagtggcgacttgatgtgagcatcggcgtaagctgcatcgatgctttccatagacgtgagcggcttgcctgaagaattaatcgtcttgccgcgctggctttgattccttttccatgtctctctattgacgcccaaggtgttgcatgcttcgttgattttcttctcttattgtgttgtgaattatagatagatctaatcatgtacttaacgctcaacagcaacagaaatattattgcctctcgcatatcctctcttatctgttccttcgtgaggtggtgttagattggtttaatttacacgtggcccacaaagttaaacacacatggaatttacaatctacagggatgataatatcatttatttaatcaatggccagatctttctgattaacgtgagagttcgtagaaagtgatttaatcaatggccagatctttctgattaacgtgagagttcgtagaaagtgcccaattagtataggtatagatggccagatctttctgattaacgtgagagttcgtagaaagtgatttaatcaatggccagatctttctgattaacgtgagagttcgtanaaagtgcccaattagtataggtatagatagatagatagatagatagattgtatccaatgcatacatagattaattaaatttaattgaacttactcaattcgaagcataatgtcacggatcttgcttatccaacaacttgtttgtgtttcttcnatttgtcctatgtaagatgctaagccaacaacatctgcaaaatgaaacggagacggttatgtatgtgtaattaatttggatgctagtaaataatgtaactaaacaacatattaccagataaatatgttttgctgtatactcttttggaaagactctcaatggttgaaaatgtaaaggtttgttcctagttttggtttgttatatagggttttgatctcgtgaactttggcagtgttttgagaagttgagaattttgtcattgtgaattggacgatattgtgctactgaagaaaccttgaaattagatatcatggacactgatccttcttgaatgccctgaacctattgacctgaaatttctttacagtagcatgcatcatggtgtcattcaataaataatataagtgagaaggcaaatgtaaatatcaacattatttgtgagaagaacagttatgctaacctcttcatcaatcagtatcatgtcaaggctaataagctcgttgctgttaggatttatggcaacccaaagtctaattacccattgttaacagctttccatgtttccttttcattgttaacagcttgaagcatatcacatgccattgtagttatccttcagttttgataaaaggaaaaataattttgaatcaggcaaccaatttatatgtcaatgggaccatgtagtaagtgagtctataatcagcaaaagttgatatgacgacaacggtttaagcaaatgaatataaaaaaatgaatattttcggttttgatgaaaaaaaaactctcaattaggctactatataatatctgtctatgggaccatctattaattaaactacttattaggaaaaaggtgatataaggatcataatccaaatatattttatctgcttcttctaccattaaacacaacctcaaaagtcagaagtgcgctttctttattaggcttttaacctagtagtttgttaatatagctcaacagcaatagtgatagtgtctttggtctattattgcgctattcagaaaattaccagtaaattttaacttctagtacaattagataactcgattcattgtcaaaatcacaatcggtaacatagcagtagaatatgttcgtcagaatagcaaacagtccattcaacaggcaaaagatcagcaaataattctttattaaaatcaaaatcacaaatcgagtcccagtttcgatgaaatacctttgtgtattacagatgcggcggagacggatgcaagtatgctcctttttgccaacgcaacgacaaatatgcgatagttgggaaaacggatgaactgtggaacaaacatactgatccctgaaatttataggattattaacgatggcgaaactgagtcttgtacggatcgtatcgttgcacatcagaaatcaaatttgattaacgaaaagaagcaccctatctggagttcaaatcggagtctagatcggtattgttaaatatgagaaactgatttagattagggaagagaagcaccagagttccagtcggagacggttcgctcgttgataaaagtcatcgccgcgagaaccgatgatctccaactcgcgctcgccgactatcccgcgaacggagagacggagagctggatgcggcgcgttgaagataaggtcgaccaatgcttctcctgcttcgttgaagataaggtctcagtcttatctgcctaaaatctagtaaatgtgcttgtatagttacgtagattttgatagaacccggcccacaaaacagtttttagacgcagctattaatccaagcccacatataactaaaactaataaaggcagatcacgtgaaaaatctacggtttagattaaatcacttatttaaccaacggtcaaaattctctgattaacgtgggagctcgtagaaagtgtccaattagtataggtatagattagaattatctccaaggttttgaaaattccattaaaaatcatgttagcctattttgacatgtagaactcaagaaa

SEQ ID NO: 15780 - DNA, 2134 bp, Oryza sativa
gtgtgacatggtctgacggttattgaaccaatactaaaaatgatctttcatcccggttcccgattgttgttaccaaccaggataaaagatcaaaaagtacccctgggcttttgaatcgggagtaaagatattttttagtcctggttcctattctaactagggctaatgtggttttttgagtaaccaagcaaaaatggtttctccatgcagcaacagggccatgcaaaaaaaaaggtcagctcgatctttagtcccggttggtaacaccaaccgggaattctacatatgtattgaaacatatatatgcatacatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttctacgtagtagtagtcgctgctagctcagaagctaaggaccggtgaattgtttttccgtcgtagtagaattcacccttgggatcaaggatttcttcgttgatgaatcccatgagttgttcttgaaccgccacgataaattccttgtgtatggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacgagagatctaattaatatacacttgtatgtatttgaatcggagaaatataaatgtagagcatgtgtactcacaggaaatttgaacctccgcctaagtctttctctccagttgccgcggaccaaatgacgtaaccgataccaagccctacatggagtttaaagatatgattcgtagtataaataattaacataacaagaatttcttaattaacagagaaacttatgccagtacctgtctataagttcgaaaaccttgtcaaacgtagactcttttttatccattgagtcatatacattgacggtgcaggccgacaggtcgaagaataaaagcacccagtggaatctgcaatgtgcgtgggatgcattacatatgaaacacttagcaagttcgtacgggaatgaaatttggtatgtaggaagacagtaaaattaaactaactctgtgttgtacggtaacagtatgaacgtcttgtcatgctgcgccttcaggagatggacgagattgtcctctgttcttcttgtggatattggtcgagcattgcgacgtttactttgcgagggtcgatgaattcagtatcgaaaaccctccgccgtcaggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccaaagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcaattccgccttttcgattggtgcaactcctagcaattgatcggtagttagaccggtgtcaataataaattgttctatcgtcatttctttcccggtcaccaacggctcgatctcctggtttggttgctctccaagctgagggactggtttggactttccagaagatgctttcttcagcgttcgctcatagtccgatagcttgatggcctccttgacaggtgcagacatacccctgaagaagttcatgacact

SEQ ID NO: 15781 - DNA, 2590 bp, Oryza sativa
ccagccttggaggcgtactgtgaggcccgtcatcgcggggctgcgatcgaggcggggagagtatgaatcggcattgattcacttgtgcataagtatcggtagcgtgtatttgacattatattaactaattgatttacaattgctaatgcaggtacttcaaccgctccgagtcagagctcatgcccccccagtgttcgacgataggtacatcccgtacctaagggcggccgggttgcttggggtggccttggtcgtgagcagaggaatgccagtgttcaacgctcctgcgttgacagcacttgtggacagatggaggcctgagacacacagcttccacctccccagtggtgagatgaccatcactctacaggatgtggctatgatcttggccctcccattacaggggcatgtcgtgacgggcaggacagagactcctggatggcgtgcacaagtggagcagctgtttggcattccactgaacattgagcaggggcaaggggggaagaagaagcagaatggaatacccctgtcttggctgagtcagaacttctcacatcttgacgacgacgctgagccatggcgtgttgagtgttatgcccgtgcatacatcttgcacttgttgggaggggttctgtttcctaatgctgggggtgacattgcttcggcgatatggattcctttggtcgccaaccttggtgatctgggccgtttcagttggggctcagcagtgttggcgtggacatatagacagctctgtgaggcctgttgtcgtcaggcactatcatccaacatgagtggttgtgtgctattgattcagctgtggatggggttaagactaccggttggaaggcctaagtggaggcaaagcttcactccttggccctacaatgagccagacatggagaagacagtggcctacctttttgagagtactgccactgcacatgctcaccgggatgtggcatacaagcattatgtcaatgagatggactgcttacagcctcaacatgtaagtactttcaatatcacttctagttagatatttacttctttaattgagatactaaccaacgacatctcttcaacttttgcagattgagtggttaccataccacacaaatgaggcttcaagcctgtccttgaactcgatgtgcaatcgagactctgactatttcatgtaccagtgcccattggtttgtttctgggcagttgagtaccaccttccgcaccgtgtcatgcgacagttcgggaagaaacaagattggccgcttgaggacatctcaactggagttaaattacacaagtaaatatttcttatctttgtttgctttcattgtcaatgttcaattttgtaccatttaacccttgtcgatgctcactattgtttcatcaccttctacttgtctagatatgacagggtgagaacaaagaaggtgaaagactgggggctagagcataatagatacattgatgaatggaggacagccggaaggaacgataggtacatcgagactatacaccaaaatcatcttttctcagagtatcttcgttggctgcataggacatatagactgttcctccgccctacttggacggaagccgacatagaggatgaccacgactccgatgaggggcggaatccctatgatgtccggactagagttggatatcaaatggagcacgccccacttagagacagagtcgtaagttttcttgcatttgtcaaagttatttccatttgcaccctagaccctaacatatatcttctcacgctttcagtcgagagagctcctcaggaatgtgaatgaaatggggcatgccctccaagctccgaggggtggtgaggacacggagaacacactccacaatgttttagaggtaaaatttatttagcactttgcattacttgagttatgcctaacaaacttctttttttttgaaatgcagaaagttcgtcaaaggtgccgaaaacttgcagcaagattaggttgcaggtcggttggattggacgacgtgtaccaaccgcggagactaccaccaccactacctcaatccgtgcgtccaagtaccgctcgatactccatcaggatagaagagcgtgaaggagttggtggctcgtcgtcgtcacgcattaagcaaggcgccggcaccacctagcgatgacgatgacgacgaggacgaggaggatgaggactacgtcgcaccagacgccgaggagatagatatgtcgcagcttcccgacgcgcctcaggggacgcaacccacgcaataaaacttgcgatccactcaggcagcaaaaaagaggtaaaatgagcttaccattctcaaatgttatttgatttcccttattttgtttttaaaatgttttaaacattggattttcaaatgtaggtacactccgggctcgcaagcaattcggcgccaacggaagaagtgatttgtatgaagttaatctattggttggtagtatgacatatgtggtgcactttgtgatataaaatgtgatggactatgtgaggactatgtgatggacttttgacattgtttcatgtgtggaatataggatggacttttggcattgtttgatgtg

SEQ ID NO: 15782 - DNA, 2489 bp, Oryza sativa
cccatgtccatccattaacacatatacggaggaggacactgagaacaaagctaagtgtctttattttcctttttatgtaatattttccattgagcaattttttatatctgctcatgctaactactcgtccagcgccggacgcctagttttatcattatttatcatattgatttttaatctcagattaatctcttgctattttttgttgttgttcgcatataattacgcggcactattgaggcgattaatgctggtcatggagtcgaggcgtctcagctttccggtcgatcgggcgcgagtccactctgtcggcttgtcttcgccaccgccattgctgataacaacaacgacttcaccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccaccgctgttgggcgtctacgacttcaccgccggcctgcctccgtcgccgccgagtggtgtcctcgcctatacggtaggttggtcacaccaccgttcatgggcgtctacgacttcaccgccggcctgcctccgtcgccgccgagtggtgcctccgcctacacggctggcctattatgccaccgctgttgggcgtctacgacttcaccgccggcctgcctccgtcgccgccgactggtgtcctcgcttatacggttggttggtcacaccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatactttccgtttggtttgccaatgaatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttagaccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccaccgccgactggtgttttaccctgcacaattggcctattatgccaccgttgttgggcgtgtacgtcttcaccgtacggcttaccttccccgccgccgactggggtttcagcctgcacggctggccttttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctattatgctgccgttgttgggcgtctacgtcgtcaccgaccggcttgccttcgccgccgccgactggtgtttccgcctgcacggctggcct

SEQ ID NO: 15783 - DNA, 7370 bp, Oryza sativa
  unsure (1)..(7370): unsure at all n locations
aacacaagctgcctacgtttgccatggctgccgactggtttcttcacttccatggctgcatgattctgccagtgttgattggcctattatgccgctgttgttgggcatctacatcttcattgccggtcgtctcgtctgctgctgactagtgcccttacctctacgtctggtttatacagctaccactactgatggacatcatcatcttccgtcgccgactgattatgctgccgtcgattggtgcttttatcttcacaactacgcgtcttcactaccggtttgcttctgttgccgccgacttgtgttcacttcattatggcaatacaactttgtcatcatggtggagcgacttcatctttattatcttcggcaccggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttctcaactaaccaaagagtcgggggctacacaaatataaggctcaaaatttgacaaattttatgtcaagctgaagaaatcaattaatcagccaatgagtcaactccaggagtctttatcttcatctttgcttcggagcagatgttctacttcagcaacttggagattatggatatcccatatctactcagcgctgccataatctactccaaaattctcaagtatcaagttcaagatttaatctacatgttcgggagtttggagttatcaaccaatcagctcggtttagacgagttggacaacaacatctactttcctccaagtgaagcatctacaacagctgtaacactaagttctacagtcatcttcgtaaatcaagaagcattgcatcagttttctttatgcacacgctcacatcaaggaaacttctcaagcttcgatatcttctcaatggtttgatggattgttgtcactgacatcatcaccagcacgtttacttcatcggccctgacgtctccgccgttgctaaagggtgactacatcctcgccgtcggttacttttgtcatcaccgactttcatcaccaacttgttatttcatcttcacggttggcctactatgcaactgccgatagagggatctcatcgttatcatggactgctacattactattgactggatcaacgacatggttatcttcatcaacatcctgtcaagtctcttcaacatagcctactctgctgccgttgatggacaacttcatcatcataaccggctatctctgttgccgctaatcatcattaccatcagatgcgtttgccatcgccgactatgttcttcatcttcataattggtggatttcgccatcaccgttgatgcgcgtctacgtcttcatcgttggtttgcttttgtcaccaccgactgttctttcgttgttgttgggcgcctacatcttcactgctagctgacctgactgttgccgactggtttcttcacctccatagttatgcaacttcattacatttgattggcggcatctttactaccactgacatcttccgttacttctgatgagcaatttcgtcttcatgttggtcatttcatctccatgccgaatgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacacgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtgaaaccatgtgtcttctagggacttaagtacatctgttaaagcagtgtgcgcatggcgtatgcccaatactttggaaatttctttattcacaatatgcaagcttctttatagctattttgctatatcactcatcatattttacaaagcggttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgtatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattgtgggtaccccatacccatacggcatggttatccgactagtcataggggataacttatatctatggaatatgtaataaatcatgactcggtattacgtttccttgtatattacggaacggcctaaagtcctggtttgataatattgtaaagtaaatttaggaaaccgataccgtattggttaaggtttctatcttgtaatcctgccccccatcctatataaggtgggcaggaggccctctagggggcagatgacataacctgatcatcagatcaatacacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacaacaagagatgcctttgtggatacggtttgtttcaatatgcttatcagttgccccaaggtgatcgagcgatgcctactccaggttttcaaccagaatggtcgtagtgatcttttgacacctaacgcgccagtcaacattgtcattataaccaccaccgaaactgacaggattgccgtagtcacccggacggcaacgtttaggactaacaagattaaggcgacaacggacaaggtaacgacatcatgacatcacaaggcgacgacgaaactccagatcccaagacttccaaagggcccgaggttgaggccgtaggtccgggagtttaacctttgactacgataatccctcattgactttgtcattgtcaggaggcagtttctgcaggtcacgagaacgccgtccatctgtttgtcacgcccggaaattcactggtaatttctggacttatttgtgcataaaatcctcgtccaagaatcagccgaggtacacaaactgacaatttaatatacaaatccatcataataataacgttatatacttacaaaagaatagaaaacagcagcggaaaaacagtctagcgatggctccagctccactcccacaggcagctcaactggggtataagccaaacgtcttctccttctggatcctttttcttcaactgaggtttgattgattattgcaaggtgagtacatggaatactccgcaagccacatagcaaatatgcaagtgcacaaggataccaaaaggatggtatattatagggctcatttgcaaaagcagcatttagcaaacattcagagtagtaaaacagtagagtaattaatcattaatattaatcaacactaaacaggcttgtacccactcaatttatgacaggataaagttgaattgttagttggcattctgggatgtaagattggttctctaccttctttgggattacttttgggcaccatatggcctagagtggtggactttgctctgttagtagacagcatagaaagaaggctgacagcatgctccatatttctgcctcatggaggaagattaacattgatcaatccagtcctttcattaatcccaacctactaatgtccttattgcagctaccagttctagtcatcaaggccattgacacagctcgaaagaactgtctgtggagggggaataacccttcttctacaaggaaatctctaacctcctgggacagggtgtgcacccctaaagagaaaggaggtttaggagtgatcaatctgagagttcaaaacacagcgctcctcctaaagcacatggtcaaattctataatggtgctgatttaccctgagtaaagctgatctcacaaacatattatgattctaaagttccacacttgatcgtgaataaggattcattttggtggagggatatcacatctcttgcagacatcttcaagggaatagccaaatgtgaaatcaggacaggaacaactgcccttttctggaatgatctatggaatgatgattttaaatgcactagctaccccaatctttttgctgtgaccatgtataaaactgattcagtgaaagccatgtgttcaagacctttagaagaatcttttaccctacccctctcagatgtggncctattttgaattttgcagctactttcatctgaacatacagtcaggaatgggggatgctgggaattttatctggggttcagacaagtacacagctaagaaattttataagcttaacttttctgcgttacaaccctccagacccatgatttggttgtggaaaacaaaatgtgtcatgaagataaaagtttttgcttggctcctgttctgtgacagactcaacacaagagatatgctggatagaagacattgtgccaaagaaaatgatgacctcacatgtgttttgtgcaatgcggattgcagagaaacaaggttacatcttttcttctcctgtccgttcagtatcagttgttggcagcacctgggaattgagtggaatcataatttggagtttttccaaatgatcgccctagcaagaatcaagtttgctcagacgggcttcctggagattttctttttggtagcttggcacatatggaagcaaatgaatggtttaatctttcaaaacgttcaaccctccttccaagcctagagatcactttttgtcaaagaagttcttctgcatatatgcagaatgaaggatcccttaaagcaatttgtttttaattgggtacaaaccatatagtctttcttgcggtttcctcttgtaactctgtaaccttgtaaatatttttcaatctttataaaattacaatgttgggcaaagccttggcagtaattccggtaaaaaaaaacactgaacagcacacccatgctgcacaggcccaaccatcctgaataaccatacccggctgtacagatctaactccaaaccaggagctaagtaaattattattagttatagcatcaataattatcgtgagaggtcttagactaatcatgaaaaacatggctcaacccgtccatgaccgcgggtacggctattcgaatagttttactctggccagaggtttacaaatttacccacaagacacaactccacaatatgtcaccatatcatcatgtgcccatgctgaacatgtcaccatttgtatagttgtgacaagacccctcacatagctcaactcaaagcagtgcacctttcctggatcataatcaccccctcaaaaaaccagacgcatggactccacagcgacccccacggacttctcgccgcttcacagtctggcgcaccaaaatgagccttgctatacaaagtgtctagccgttgcccattctgacttgtcgttagtatggttaatgtctcacaacagtagctcgtgaactggtccttaattgttatgagcacgaccatcaaaaccatgtgctcacaacccaccattaatcaagttttagttcacaattagttaataaccaatcacgattgaccatcgtgagctaccattaaatatccataagtcatagtgaaacatgatttatctcattaatgagctattgtttctaagcatggctaagcatctattataagcatatagctgacccaaaccaatatataaggtttaagctaatcaaattataacccatacgaaaataaagtcatcttcggccataattaattgggaaaggctcaccacccgatgacattcgaaaataatgtaggagttcaaataaaacaatagctttaaacgggttcaacatgatcaaagggttatttgggatctgtgtgacttgccttgcaataatcggtctccagttagtcttctggaacacttccgatgcactcacgaaccttggacacaacggaaacgacaagctaacacacaaaatgaggaaaaagactaagaaactccaaataaacagtacataaaaagtaaaaaaacatgtagatcattattttagatgaattatgagacttgaacggcctcattccgactttatatgaattagttatgaattttacaaaattaattccaattaaagcctattaaagaaaaaactattccaaattgattaaacaatttacaaacgatttataactgagattaaagattaaaacaacctccagaaattattggaacgaatttagtacacgacatatagtaaaaagaactaatatgccatcgaaaaggaataacaggatttatattgatttttggatgggtggaaattaaactggaccgagtggcccaaaatcggatggctcggattgatctggcaagcgaacctcaacgagtcaattttacgggacacgggatcacccaaatgatcaaccgaaaccagcgaacggaaccggcagctctgaacggtctaaactaaaggacgactcaacgtggatgaacgaacgaa

SEQ ID NO: 15784 - DNA, 693 bp, Oryza sativa
agggtgcaggaggcggctaaacaggaggaggaggaggctaggggcggctgcaacaaaaacaggaaacaggaggggagaggacggcttatataggggaggattgaataagattaggtggggctgagggaggcacggcagagggggagatggattcctacttggaacgcaaggaaccatgccgggaaaacctagggtttggcggagagataaactcgaaaatgaatccaaattcgcgccggattcaaagggataaagtcagattttgggggccataggtagaggaggataagaggaatatttcccctcaaccaattttcgaaatgagccacactatcggccggatttgatggaggaggcggcgatgcacaggctcgggacggctggctcaggctctgtctggcgctggaagatgaacagtagcgtgggcaggagaggtagactttttgctgggctgaaaagaaaagaaggaagtgataagaaatagacttccccgaagaagaaggagacctggctttgtctggagctggaagatgaacagtagagcggggacgaatagtagactttctgcttggccgaaaagaaaagaagaaagggaaaagaaatagacttccctgaagaagaaggagacaggaaggaagcagagataggcaaagaggaaggacgggctgaggacaacagatagacttttccagt

SEQ ID NO: 15785 - DNA, 18074 bp, Oryza sativa
aatgggccgacggcccatttgacaaaaaggaggaaaaagaaaggaaaaaagaaaaagaaaaggaaaaaggatttttccctggaattaacaatattgcttgctcaattttaattggttaaaattatttctagagctctgaaaattccactaaaaatcctgttaatgcatttcgacatgtagaattcaagaaaaattccacatgtcaaatccgattattgtttgcattgttttcttagggttttatcctgatttcctctgcattttcttggggtcatttgtaatttacaatttggcttgggaggaaaacttcggggtgtgacacgcgccgcacgcacgctgaccgcgcgaccgcgtgggtcccactcccggtcgtcgtcctcctcccgcctggctcctccctctcccgtgaaaccctatccgttccctccctcaaatccgcgcgaatcaattaacttctttccaaattgattagggggaattaattccctttccttcctcttcaattccccctaattttcccattgaatggcaccctcaatcgcccggaacggccgcgccatccccggccaccttccatggccgccggccgccatacccacaaccgttctgacttcctccttggccggctccctcccctcatctataaaatggaaccccctcggtccgtcctccagttttagcccccttccgcgcttttccgggggcttaacaacttttcccggctttctccttctctctctccggcgccggccacctccagccgcacctcccaccacgaccgtgcgccgtccggttgctccatcgccaccctcggcctcgcaggtgcatcctcttccccggcgtcgcctccgtttcgtggggaaaccaccggagacgcgtcctcgccgatgaccagtggtgtcgccaccactccaccgcgtcctttgcaccggccgacgtcgccaccacttccctcggctccgcgacgccgtcctcatctccggcctcacctcctcctcgcccgaagctcgccggagtggtctcctcgtcggcgtccagtacctcacctcctccgggcggctactcttcctcgccggtgagccagcctacgctgccgtctcctccctcggcacggtgacgtcgcccttcaccccgccctgccctcggttttgccggaacgccgccgccgcaccggcctctccttcctcctcatcgacgtctcctccggcagccccttccgccgtgcctgtgcgccggccgacgtcgtcgtctcctccttcagcatcgcagtggcaaggtcgtccttggcctcgcctcccctccacccgaaccccactggcgttcatcgtcaccaccccgccggtcttcgtcgtcgtcctcttgtcgttcccggttgcgctcgtcgtcggccctcccttcgtcaagccgatcgcgttcgccgcccgcgtttcgtcaagtgtgcagcagccccgtcgtcgtcttcatcctcggctccgcgtcgtcaagccttatgctggccgcgtctcgtcttcatccaaggatcgccgccgaagtcgtccccttgccgtcatctccgtcattcccgttcgtctccgctgcccgttcaccgtagtcgttcccacgcctcgtcgcgtggtggtaaggatctctccttcgctgccccgtcctcgttctttttgtgtcgccctgtgcccgttgtgcggttgtcgaccctggtacccgtgtaccggtgtcggtagtcgttcgtgtgtgcgtgtggtgaccgtgtttgtgtgcccgctcggtagccgcgtggtttccacgtgtgcagcccgcgtggtgtcaagtggagtccgtttgtcggccactcgcctcggttgacacacggggtccgcttccgccgacccgtggaccgtctttgtgtactcggtctaccgtagtcctttaggttgacatgtggggtccgcatgtcaacagcgtagccttcctgtcttttccaggctagcacttacacatgttttatagttgtaaaacctaattacaataatccgtaaatctccatgtaacagcattaaacttcggatgaccatatcttggtcatacgaactccgaatcgacccgttcaagtcttttaatgtttgttataacctaaagaaccttgtgcttttctttttatgtattgttattgcttctttatagggtttagctttgcttatgtgcttcgcatagcttctgtcattctggaggttcccgaagcgtggttcgcgatcgtcaccaaaggttcggaaggccgttctctctgagcaaggcaagtcgcattatccttgagcatattgaatcccagtttataaaattattttgatttaaattaatgcattatcgctttatttaaattcccgcgttatcactattttatttagccatgactatttacctttgttatgaccttattactattgctattgttattattaccttgttcaccctagaataaataaaacccaactagtgggtactctatacatggttccactagtatgaacttaggtagatgcttcgttggttaattaggcaacattaggtggttttataactttagactttgggaattctcatatcacttggacactatggaatggttggcttatggtggaattggacatacccctctcttcctctttcaaaacccctaaaacctattttccggtggggtttgggtgcatgccagttgtgggaagtagcaccccggccaatataaggattaagctcggcctctgttgcaaagcactaccgtactaaccacatgtctaatggataaggcttaactcggtgctcagtctagtcctgaacaaaaggacacggatagagatggatgaagtcgttgcgacgatggatatttctgaggcaaatgaaggctacgcgagctgcgtctcggtaatcgagatgtctaggcaaatgaaggctacacgggtcggtgcccgttagtcgagatgccatggcactggactagtacgcgggtggtctcacccctatatgtgcggcgcacccggtctagatcctgttgctaggggctcaatcctagcctgcctgtccgggataccggccgtaggcagggttgggtcggtacttttgttcacggctaggatgggtgaagggttatgtcacatgtttacgacggattccaaggccatggaatgcggagtaaagatgtgtcttgtgggtaaagatgtacacctctgatcagagtaaatctattagaatagccgcgccctcggttatgggcaagcctagcaatgtacccaagttagtggtttaattcttaaaacttgcttaacaactaaaatgtgtaatggttggcctgggttggcttgggacgagctgggacccaggtcaggttgccagttcggtctgaatcatcgtaggccttgggttaaggcaggttcgtgagggttcacagccttgattaataatattgtgtagctctaggatcgtttttacaaaatagctttgagcaactaagtgacttttaaatgctgtttactgcaaaacctagcccctatattattaccccttgtacccccttgcattaatcatgcatcttccggtgtgacttgctgagtactgtggttgtactcattcttgctctatctttccccccttcagtaagagaagctttggagaagaaatcctaggtggagtcctggcttataccccagttgagtgcctgtgaagatggagccgtaggcctgctagtccgctgctgtttatttttgtttgtcaggcctgaagtgcttttgtaataatgtaaatattatcgatataataaagatgtgtcttttatatcatgtttgtgtggtgtaccccggcttttcctgggatggggactaatacactagcgttctggaaaaggtatttttccgggcgcggcaaccaggtatcgcaaacccagccgatgcattcattgagccttgctgctgaatcggctgaaccacctgttgccttaatggcgtctgttgaaccggctgcaaaacctgccgtctttgtggtgtctgctgaattggttgcacaacctgttggactggggatgtttgttgaatcggctgcacaacctgctgccttggcggtgtttgctgaatcggctgttgctgggttggatcaatggcatgttgaggaggtaagaacatagatgcaacctggtcttgggttagccgattcacattctgtccactgtgctgtggttgttctctcaccaacaatcggggattaactaattggcctagagccgaaagtggtgcggcaggtgtaggagctggtgatggtgccgtcggctgagccgatggtgcattaagagggatcgactggacaactggttgattattgatgactaatggccgataattcgagaagactcctcctggtaagtagactggtcctgtagcttgatactcggccattgaaccatcaaccattgacttcaccatatttgccaaagtattgattaatatcctagattgattgatcagagcatggtgtacagcatagtcaacctgatcttggaaattgttaaactgcaactgtgctgcattgccatcttgattaggtccttcacctttaactccctgagcaccatcaccttgaactccctgtgctccctgagagttatcaccttgatttccttgagaatcatctgtagcacctttgttgctcggttgagccgagccatctggggcttgtttcacctctccatccttagaagaaccggtcccaggaacatcagcaactacttttaccttgtacttttgcaccactgtccccttgcgggtctgcatgaatgagctcaagaactgattccctgcctgctgcatcattgcttcgaaatccttcttctgatcaggtgtcaacttgtctggagtaatggtcacgatgttgccctcattaacatcagataagcccagctgctgaatcttctctttaacagaacctggactaaccgaagacggcgacgctggcggcttctcgtccatgaggaaagctgctgacttctaatctgtcccactgggcgtgccaaaagcgtgttgatggaaaacacgaggcctaggatatctgcttaactccagtgcaggtccaaaactcgccttcgggtatacaagcgtgccagttgatttgatcatgcaatcaacaagaaataaaggcaaagaaactgtggttaaatctataaacgatagccgatcggctaagtgctgatgacatatcatttatctttgagccgatgtcatatatgcatcgatcggcagttatagataaataataaagaactaaatctgttcgatcggctgtagatattaacaatatataatccttatgtcgatatatacttaaatcaagtgattgggatagatcggtcaccatgccgggacagtataaatcacttagattgaaatatatactaacaacgagactatatatgttcatggcataaccgatcaaatagatctagcacgtatcggctaatactccgatactactctatactaagatattaaaagcaagtaggatatatcaaacaaaagcttaatatacttaaatgctacaagatcttaatataaagggcagattcaacatatcaatgaagcatataaagcaaatatagttaaatcaggtaagattggctgaaaccccgatgctaccctaatcggcaaccagaaggcaggctaaagattcatattctaagcacgacttaatagatcaaactcaactgatgcagcattaagtatgaaaagaagaacaatatctagacaatcaagccgctggaagttttatagagtggtagatatcctatataatctaagtcaacatcgatgtctaacctaatcggctaccctctaccgacagatgttagccaattgtaggttagatagcgatactgtcagagattacgtaagatatatgataactcgacgaattacataaacaagattagagtatcataaagatggaagcattaatcccgagaacgcaagctgccataacaagttttacctcttgttgaatatcgaaaccgatgcagctcaacccgaaagcaagaactcgtcgaaacaaaacgaaagtaaaatggtggcgatgcgccgagattgtattgaacgtgtgtgttcattaattacatagggttcggggtcaatttatacccgcaaattacaaactatgcccatatcggacatgactcttatctctaacaaactctaagataccataagtctttacggcagacttttgcccaaacatatctctaaggaaattacataaaatatcctaattaatagatacaattgccttcccaggactctatccatgcgtggcaatcatcttgaagcatatcaactcaacccgacgttgtacaccaagtcgtattgtcggaatcgactgcatcaccaaaccaagtctgactcgaatttagccgatccaatcatagccgatccggactccagccaattcttactctgttcccgtgataatccttatctttgattccgcttcgatctaatcttcctttccgatgctgatattaccaaatttggtcattaacagtcgggtccgcccctcctgtcaccgtcaccgcgcgggagggggagcaagatctaccgtccccatgcctcccaactgctggatctgccactgccgcacctccctaccgcctgatccgccgcaccgcacatccccaccaccagatccgccgccgccgccgtacgggggaggtcgaatgtcatcggatctgcttgggcgacgaccgccgtgcctccccaccaccagatctgccactaccggcgcatccctaccaccggatccgccgccgccatgcaggggagggcggccaccatctgagccacgcgggcgacgaacgtcgccaccatcacgcgcttcctacgccctccctagctacccaagccctccaccgccgtcaggagggaggagaggggtgagcaggagtggggagaggaggaagccgtcatcgtcgcccttaccctctgttgccaccgccgccacaggagcccgccgcgaggagatgtggtagggagaggaggaggccgggaaaggaggagtgggagagagagagaggaggggagagaaaaaaaagagtgggaactaggggggatttttgcatgcgagtaagttaagagtcccacatacaaaaatacccttatttttgcgtgcagacatttcaagtgggccattggaaaaattaattgttacatatgtgtctgttaaggagccatatgggaaaataagggaaaatgagggtatgcagacacttatggcatgtcttcaacctattaaggtgctagccagaaaaatcatttttgtcatccatcccatctttctttctcatttataggagaagaaaattaaaaagacctgctcatactaagtcttacttagatgcaatgtggacgttctaatctgcttaaagaaagagatggagctgttcgctaattggtaacccatctcatctttcgccattgtagaataagaaaagaagaatagaaaaacttgtattacatagcgcgtgcatttcgttatgctgtacatcgtgatcaggtatatcgactgcaacttcaactttcacagttgcatgatctaccacgtgcaaaatgaattaaacggccaatcttaacgaagccttcattaccacacccaaatttgatacctagagtcgaaatagggaaatatagccaaaatcacgaagcctatggaccggtctagctaaccggtggtgtgtgcctggtcagacctgcagaatccaattcagaaacgttttcatcggttcaaaggtcttcttactcgggaaggcatgtttcaggttttcattagtttatattccgagttggacgtggacgaggacttataggaggctaagaccaaccttttagaaaagccaaggttcggttctagacccccatccccaattcaaaaacagtatggtcgtacacgataattgaattaaaggaattcagcgtctgcttggttcaatttcacataaatttcatttgaaacagccacatccactacacattgacacattgatggttttcagaagcagccacatgcgccgggaagctttcccgtcacccgaatcctctctgccttctccctcaccttcctctctgcgctcctccgcttctcctccgccgtcagccttgatgctgcggccaccttgttgatccttgtaatctcgtcgttgtactcctccagcgccttctctcgcttccgctctgaattatcgccctgacacagcagatttatcaatttaagcagcatacatagagagctcacgatttttttacatgtgaattttgtgcggcgaattatagatactatagtcgtgtgcagaaattaacctctttcaactccatctggcgtttggccttggccttcttctcggcctcccattcgacgatggtatccattgtcatgttgtacctgcagatcaaattgacagctcaatgtagaatgaactgcagcaattttgatgagaaaattcagtgttttttgttgacaggtttacttactgcttcttgatttttgccatcttttccttctcccacgtatctgccattgcttcagcctcactagaatatgaactcgtcggcgcggaagccaaagatggcatttgatttgccttgtcttgctcaaacttcttgctctctttcttctctcgggaaaatgaagctgttggcctaacatctggtggcacccttgggattgcctggtcttgatcaaatttcttgctctctttcttctctcggggaaataaagctgtcggcctaacattcggtggcaccgttgggattgcctgctcttgctcaaatttcatgctccccttcttttctggtaaaggcttggcgaagctcggagcctttcttatgcttgggacagaatcaagaaccttccctaccatattttgacctgaaattccaccttctggtatcttttgtgccgttctcaccggcctcctcaccgatacattagctaaaattcaacaaaagttttttagtacataatggtatagctggttgcaggttgtgctacagtaatatatcattgttgcccaagtaagttgttttgaatcttgtaccttctagtccgtcgtcttcttcatcgggtacaatctccttaccactaaaccgccttgtgattctgctcccctcggtttgcctaggccttttcaagattccttgtctgttgggtggtagtttgagagttggtgtggtcgaaggctcatcgttcgcgacaggcttcttttcagatgttaacttctttttcacacgggtctcttctgttgcctgtttctcctcctcttttgctgcaatagcatacgctaccgcagccactgtggctgcatatgcagcatcgtattctactccattgctcatttcctctgaaatgtcaattcagtcagtggttaattcagttcttcaaacttagaaaagcgcattgatgtagggttcaccaaaccgttttgggtggggttaccaaaccgttttgggtggggttaccgtcaccccatggtttgacggttaccacgaggtatactgtggtttcaaaaactgagaaggttactgtgccataactgcacggtttgtaaaccctgatttgatgacttacctcttccaaaaaatctaccttgttgaggttgcattcttatagtctggttaccaccttgatcttcctgttcctgtaccaggaaatcggaccctgccaagagatatcaattgaaaaataataccatcctatttagagaatttggcattgtttggaaagtaaataactattgtgcaatgctaataaactccttgggtcagatcatctgttctaaaactccggaacatttgagaagaacaatggaaaaaaatgacgatgagatatggaggaattagtaagaacataagttgtaacaatctggatggcaaaacgaacagaacagatttatgaagtccaaaagagccaaaggccctttatttccttactttcaatcttattcctgggcctgtggcactcaacgttcaagattaacttgtaagttaagcattgctccatgaattggatgcaactatatatagagatgggtttagatggacatggagagggatgtagaagggggcaagaaagcagtttgcatgtcttggaggcaagcaattagcaagggaagggaagaggaatcgctttgccctattgaagtctctgagaatcctagccttttgcttgcagtgtggttgctaccaacctgaattttctgagcagtttatcctctgaactagccttggcttgccattcagattacaagtccaacaccattgctttaccttataatattcaagctaatatctgtcggcaacctgatatctagcttgctgcattagaattattcatgctggtgtttgtgagagatgtagaacaaaccgtatccattgtacaaatatatgctgtagattgtattctagcgacatatgtatatatttgtgcctctgaaatcatggactcatgtactactttcatttggatgtatatatacatgacaatgcattgatatcatgtcatttttttctaattcaaaattttgtaattaccagtgtgagatcagtatttcatactcctactactccctccgtcccataaaaaacgaatctaaaactggatgtgacacattctagtacagcgaatatccagtattatgttggttttttatgggacggaggaagtatttcctagaaactactctctctgtacacttttatatggcgtattttgattttaaaaagtcaaacttcctgtaatcaatccagtctgtagaaaggccttggatcttccggctagccagaagaagtgggctagctgacctcacccctcttaataaatttcgatacaagagtctcttctctcatatcctgcgttttttaaacatccaaactggaatatggagagggcacgtagcttggaatgtggaggttattatttctttttttttatgtaatttgtctgtaatgggaacatctgggctgcaggtgtgaacttgttgagaacgatgcaatcttaaataagttgaacgaggacagcaaaactgttttatatttgtcttttttaaatgcaatttaaactcactgcatcaagagatttagaatcaaggtctggctttttttccgtgtaaaatggaagcatgttaaatcagggtcatcaggaggtgctcttctcatgtctctgaatatagtatcatcaggttagttcgggaggcccgtcaggggtttgttcatgcggccaaaataaaatggttctaataagagaaaaaggaaggaataagttcatctaaggtcccttaacttatcaacgaatccgattttcgtccttcaatcaaagaaaaccagatatcatggatccctcaactatcaaaaccggtgaagatgaggaccctcgacggtttagatggtggttttggctgacgtggcgcctactggctaatttgactcagtcttcatctgacgtggcattaacgtggcgcttacatggcaatttgattcagaaagataataaaaccagtgggacccacgtgtcagtttcacacacaaaattttaaaaatggtgggacccacgtgggccccacctgtcattctcacccctcctttcttgctctcttcccatctcctcctcatttctatcccctttcctctctcatctctctccagcgtcaccaccaccgactccgccgccgctcccgcctcccgccaccgccacatccctcgcgccgctgccgctaccaactccgcctccaccaccaccctcgccacctccgccgccgccgcctgcgcctccaccatcaactcctagctcctctcttgccttcagtggcgtctccgtcatggaagccgtggcgggcggcagcgggaggccgtctccgccgcggccgcctcgacgccgaggagctccgggcggcacgccagcgctgcacggcctgcctatggagatgacgacgggggagatggaggccgccatcgtcgccctccctacgaagaaggaggccccttcctcttcccctcgccagtcgccgctgcagccgcgtgccgccgtcgagccgactcgatccacacgcagaactggagggaggaggacgccgctgcctccgcgcaactgattgcgccgtgtgcctcggcatgttcgtcgccgccgctgccgcgagatcaagaccgattggaccaccgttgagattgtgttgccgttccttctcaaccgccgccgccgcctcggccggcgacacctccacccgcgcgtgcctcggccgcttccgcatgaatgacgcgccgccgcccaacgaagtgcgccgccccccgcatctcctctcctcccgccggccggcgcccgcgcgttctgcggcttgtcgttgatgacgaactcaccgcggccggtgtactcgacgtggtcgagtggccccttgacgtcgatgtaggcgcccacggggagcaagtccaggtactgcgtcatgagcccgccattggggaacttggggtgctcgttcttgaagtacaccttgatgaagaggtcgaagtggccgacctcgtcgaccatgctcgtcggcgtgtacgctcgcatgcacagcttcccttcgatgctggcgcagatcaagatgtgcttgccgacggggaggccgagcacctggtcaaaggacggcagcgcgaagcggaagaggcggacgtcgcgggagagctccttcttgtcgatgagttggcaggggaccttgtcgcccgggctggagagcgcgatgggcgccggggccttgatggcctcgcggatgggggcgagctgggagaggttggacgcgccgtggacggagttgtcggagctgtacccggagccggtggtgatgagctcgccgatgcggtaggtgtcgaggagcgccttggccttgtcggagtggatggcgtcgaactcctcgtgccgccgtcgagcactcgagccaactcgatccgcgcgcggaagtgcagaactagaggacgaagaggatagagataagaggggagaaagaggatgacaggtggggtccatgtgggtcccaccattgttttttattattttgtatgtgaaactgacatgtgggtcccacgagttttattattttttcggatcaagttaccaggtaagcgtcatgtcaatgccacgtcagacgaagattgagtcaaattagccacgcaggcgtcacgtcagccaaaaccaccatctaaaccaccgagggacctcatctacaccggttttaatagttgaggaccagggtatcttttcgattgaaggacgaaaatcggattcgttgataagggacctagatgaacttattccaaaaaggaatcaccacatgacatagctatgggccaaatggcccaaatcatctgttttttttcgttgtatttatgagttatgactcgggtaaggccttcagaaatcacaaagataaatcgtaacatgacaacaagcacattttaaaaagtacaagacaagttgcaaatgttgaagcgtgtcaattgaacaagacaagtatcaagcggaagaaatgagaagggactctgaagaaaaccagttaaacagtctgaaatagtctccagtatagacctcaagcttgacccgccaacatcacagatccacagagaacgaacattacgcagtttattcagttctactggatatgcattcatcacacgaaattcacgagcttctcagtcattaccgtctatgatgcatgcaggtcacgacgatcccaaataactaaacatagagaaaagatgcatgcaggtcacgacgatcccaaataactaaacatagagaaaagaaacataagatccctaagcatagattacacatatctccccactgttcaaaatgttacacataagatggcgcgaataagcaatcagtggggagaccaagcaatacatttcttgcatttagcaacctactgcaagaccagactaaattatcaagcccatagagctacaagcttctaaacacacaaatgctaattaaatacacaggcagctaaacccagttccttcagttcatctctcacgaagtcggattataacgaaggcactgctcgtagtagctaataagctggaaaaaaaacatgagagcattttggcgttagatgtttccctcatcatcaagtaataggagaagacaatgggatgtaccagcaagggattatttgctttcaattctttgtcgtccaccatgacttcctgcccatcagacctgtcgaaacacttggttagaaaaacagttcaaacatatcaaactaacaatatgaataactacataaaaatggtcataaaaaaatgcagaatatattatttgattagtgaagagaccagaggattctttttgcgacatctctaaatgagtgaaacataaagcactcaatttgtagccaaataataattcattgctagatatagtcactttcctttttgtaataaaagtagtcagaaagggagcaatatcagctagcaaaaaaaacatgtctgagatttagaaattttaggcctataactacgaaaagaaattacagaaaatacctgagtgctttgaatgtaattgaaacttgctgcacatcgttgttcacagctgctgcaaatcgcactggcttgatgatcttggtgatatgaactcggttaggacagccctctgtctttttcttatcgccagtttctccttcagtggaaccaacatcctcagccaccactaatgctccacattctccttgtccttgtgttggtttattctgctcaaacctcctcacatttccagatttacgcttcttggcaccagttacctggccaccctgagatggaggtaccttcactaagttctcagaattagacgaaccattcacaaggtgatgctcgttttgttggtccgtcaacctaattgagagcggtagctcctgacatggtgtccttgaaatcacactggaactaccctcctgtacaatgttctgtgcaagctggttcctcaccacactccctgacgcatcaagccctgcaactgtcttactactacaattagtcgctctcctacaacttgtccgacagggcagttgcttaggttctggtgcaggagctcgagtgtgggacttagcatccaagcgagggcggccccgtttaccatgagatgggtttgagcctgctactggagtagttgttatcttccgcttacgcttccgaccgggccttggagattgtaacctgaattgcatacaaccacaaggacaaatcaatcttatttacttattatcttctgaaaatgtgaatagaactacagacggaagtgtgacaagtacataccgcatctcgaaagcatcaataatgtcagagcaggcactcaggttttctaggggctcccatgtgttagcactttccggccatccacgcctagcaaatcatataaaattgttaggaacacaagaattatcaccaaatctaaacgagtaaaacaagaagcttccacgtgagccaaaaacgtttaaactgcaatagacaagccagcgaataaaaatcatataagaaacaataaaatacaagcatcagctgcgttcagaatatatctaagctctaaggtagtgtttggttcatcaatttgagggtgtaatcaaattgcagtacgatctggtctcacagatgtttttttacagggtaccctgtaaacagaacacagctcagaacatgacacattaccaagttgaccagtacctgccgtactgctgcttcttctgaacgcaatcctgttcttggtcttcatagctctaaaggcagttaatacatccatcatctccagtgaggtaagttggttgcagtattggcagctaggatgaagaaaacacaacagttgcaatgtgcagtgtgcactagggagcatgtgtaaaacggaaatgccagtttcttgctcctgctgccaaataaccaatggagaggtgggtagtggatctagattgatttctagccactactgcctctaaatctggaagcttacgaactcgtagaggtgtattgtcccaaatatggcaatatgagtgtccacagccattctcaacctgggcacttttaccacatggtccacatcaacacgcacttgctaccgacaaacaccatcatactattaacgcatcaacaaattaaaagctgttcctgctactcagccttgccttgagcattatacaagggcatgctataaaagtcacccaagatgttatgtggaggtggctgtcctacacagctacaaccaagcgcgggaagcagccaaagatttgtttgttataacttagcttgagattcattaggagtttgttaagtgagactcctataaaaggaacaatggaaagattaattactttaggcaaacaataagttatttcctcttggtctttccagtcctctgttcttatccttcctgacagctccggggctgcgaggtcccatgccccaccctcccattgagaacccctatgctgttcaccaccttgggacgccactagcacataacactaacatttagcttgtaaggtggtccttggtgattcagatggattccacattctccaaaccactaagctcagagtgtaagctagtgatgctttcaactacaggagtccatcagcagcactcaaccgcttcacctagaagcacaatgtgctctctcacaaccctgtttgcacagtttatgctgctccaatttggttcattgctattacaagaatcacttttggcagtataggaatattaaaaggaaagggatggagttttcttgttttggtgtagtaggggaggctggtgttacaggctatcagctcagcagccatgcccctgaaattgcatctatgccttggctgtgggatggaagtatattggatatatccaatccgcctccaaatctgtttggaaaaggatatggtgaaaggttttttatatatataatcggatgatacggattcagacaatagttgtaggtgcagatatgctattccaaaatccagcagatacggattaacagacattttttagcagataacccgacaaggatctatttagataatccgataaactagggtactagaccaacttcccacggcttcaaagttaatctagtctactgtctgctgcttggcttctgggatagtgggtactacctgcagctcctgcacgatgctttcattgtgctgtttagcacctgctgctggctgatgctactttgttgcacagtagcactactagctgatgctcttattgtgctgcttgggctgatagttgcttctcaattggtacattcctagccactaatgtagtaatgttcttctttactttttcttgtatatcaccatgtacacactaccagagagctttggtctatttgcaacctaactacgttccatatccgtgccatttatagcatcccaaacaatccgttcaatatcagcatccatagatcatcagagccgaatctgaatccaacaaaaaaagtatggtaatacgataaagtacaactattatctgtctaaatctgacccgttttcgtccctagctgtgaaggctctctaactacatggttggctacttagcgcaatctggtcatcagagcctaaaccaaaatgtggatcatccaaggcacattagcaaatcaaacagtacctaaaccccaaaagctacggatgctgagcacacaaacccaatccatgaatccagcattacgaccttcaccttctaccgagtgctagagcccgtgcagggactacgagaatcccaatccaagaatccagcattacaccttcacactgttgcaagaaccgtgcagggattacgagtggggatcggaaaacccaatcctagaatccagcattacgcctttcaacttcgaccgtgctagaaagcgcgcatggattcgcgagaaaacggaagggcgtgagagagaggaagcgaaagcgatctcaccatttgacaaggtactggagcttccccttgcggaggcggcggcggcggatgtcctcgatctcgtagtacccctccgccagcttcggcggggagccatccaccaca

SEQ ID NO: 15786 - DNA, 4451 bp, Oryza sativa
ctttctcgaatggatctttttctgctgattttggttccttttggcccgtttggtggagcggccacggaacggggaaaaaagctccgaccgcggctgcccgcacagaacgatttttatattcccgttttgccctccggattgtactatgtgctaatcgtgtttcttaacaaaaaagtataagggactaagggagggccttttatggtatttaccacttgggatttggtactgttttcacccaaacgatggtgttattatcctacccatttagattggattcatcacacttgtaataatataattcagtaaagcgtgtactccctctgtactcataaagaaattgtttaaaataatgtttaaatcaaaccttgggaatataaatcatgaataactctcaagttatttagtttgaaaatataaaaattatatgaatagatttgtcttgaaaaatacttttataaaagtatacatatatcactttttaataaatatttttatagaaactaagaagtcaaagttgtgttttggagaccgtgtcgctgtccaaaacgacttcctttacgagtatggagggagtatacataaatgtacgtagtgtacttctacaaaatccagcataattgtgggcaactagaaatctaaaaaaagaagatgctatcacaaagtctattggaggggttgaatgttgacaaggcatagtaaaacaacttaggttgcattcgctcgttatagttgggaacattcccctcttgcacggtaaacgaggtagtttattagcgcgtgattaattaagtattagtaaaaaaattaaaaaatagatcaatataatttttaaagcatttttcctatagaaattttttacaaataaaacacatcatttagccgtttgaaaaacgtgcacacgaaaaatgaaagaggagagttgggaactcttagtgccgaactcagccttagggaactatatgagaaaataaaacaagaataagttttttttttcatagaactagatttagaaaccaatccatccctgccaaaggtatctcacaatgccaactaatgcgctggttagcccaaagtgacctataaattcctatattatgattgcattaaatcaaatcacttacgagctatcaagtatcaatcatcgagcgaagccaaggagacctctttcaactgctccgccaaccacccttgaacaatccagtttatctaaatccctgatccctgatgaggttaattgacaggtctagattaggtctatataggtatagattaggtacatatactccctccgtccaaaaaaagataaaccctggtttccgtgcccaatatttgaccgtccgtcttatttaaaaaaattatgaaaaaaataaaaagacaagtcacgcataaaatattaagcatgttttatcatctaacagcaatgaaaatacgaattataaaaaaatttcatataagacggacagtcaaaattggacacggaaagccagggtttgtctttttttggacggagggagtacatccttataaccatagtgtttccatatatcaatcacaacagtagacatagcgttatatcactccaaagagggcacgaagctatgtaaaaataagtctctacgtttttaacttgcatatcacgggaggagagtaaacaaaacataatcgacgtatatattttaatatattcaaatgtttatcgacaaaagttacaaccgcaagaatatcaattctcaaaactattaaggagaatcaatatggctgtgtttgttacttcttgttggaagcaaatccctttcgcatgaaaaacagagcgatccattaaaatataattaattaaatattagctaatttttttttaaaaatggatcaatatgatttttttcaagcaactttcacatatatatatatatatatatatatatatatatatatatatatatatatatatatatatatatatatatatatatattgtcagggttatggataccacatacccaatagtaatcgactaagctcagcagagcccaccatataccatgtcttatatggaatcaaacctcatatatagaaggagttccggataaggaatgatgaatagagttctatatggaaacgacaaggactactcatatcgtatccatatttatctccctagttctacttggacaatgggttatctgtgggtataaatacaagccccctaggagaagaggggacagacccaccacaatctacgacgccacaaagccacaagccaatacgccgtcagatctcgacatcagatattagtctagccataccccatccggtacctacggaggccggcaagagggatccagcgtcgtctctgatctcgccgagtactgattcgaggaggaagactaccctgtcgtcgactacgagttgattatctagccgtcaagtcgatgacggatagatagattatcccaaatattggatttgtgtgatccagatgaataaagggcaacaccggcttcggccaacaggatgtagggctattacctgtaagatgaggggcccgaacatgtataaaaatccctgtctccatctcttttacctcaatctcatatatgccctgtaccaacgatccccataccatccaaataccttagtcgtgactatcaaatgttgacatatatatatatatttgaaaaaaaaatacaccgtttagtagtttgaaaagcgtgcgcacgaaaaacaaggagagtgagttgggaactcagccttagaagtgaagtgtgcatagctcaattagttaggtttctaatgatagaatagtgaggtttctaatgatagaatattctcaccgaagtttaatttctagtcttggtatatgtgctcatatctacagctaattattagtgaaagatgaaacgtgactgttacaagaaagggtggggtcacaagcaacatccaacatgtagcaaatattaaacatttgaaatatttatttctatacaagatttaaagcgaagcgcaatcgtcctccttcaattccatcctcgcaccgggtatccatacgctagcacgttcagtactttatccttaatcactcttcaagcccacgtgatcaaataatttatcctttatcacacttcaaacccatctactatgggtctctctacacatcattcgataaattttcaggccccaaatttgtcagatttctgagcccttggattagcatccaacggcagaatctaataatgaagcaaacatcaaagtgggagtacaatcaaactaaaaataacgtatgggccaaaaaaaacatcattttgggccaacacaaattttaaaataaacaaagattttcttaaaaggcctattgatactatggatcaaatgaaactttctcagcccaaacaaataacgaatcttggcagtcaagaaagctcgacaaaaatagaaaaacaagatcacgtgacttgtacctgctccaccccatcaccaccaaccctatttgtacctgctccacccctcaccaaccccgtccacatccaaaaaaaagggagatccaaaccaaatcagatcgagaagcaaccatggagcagcagaagaagaaaacaaagaagagaaaagatgaagaagatatcaaaaatccaaacccaagcaaggtcagtgcagatccttacatccttttcccattcaaacttcattaaaaatgaacagaatttcataaatctttcaaacttggaagatatatttcctgagaatccctacaaaaattgaaaaagtaagacctagtttgtacagaaatagtacaaaaatgacatcaaagtgtagtttgtcaacatgctacaacaaacaaaaatctgctacattcagaaacttgccattgcaatcatcaatatctgcatctcataataattctctcaacaatgtggtaagaagtagaaaaactaatgaacttagtatatagtaaagaacatgtgcttgaattgttaatgagcaagttacatagtaaaattgctgaagttacatttgtaactacaaaaaacccaccctgtaactgcattgctacagaagaggtgtatggaaaccaaatcacactaaaactaatcacttagtaaaattacagaaaaggcattaaagttaacaccctgtaactgaaatcacccttgaaaactgaattattataaaattacatacaaaaaagcataaagttacagttgtaagaataatacattgaacatgtaactatactgaaaactttcaaaacaaattcaccacaaaaaaatgcatataaaaaatgcatataagatggtagaatacaatcaagcatctgaacatgcatacatgcaatttcatcactttcaattgcagggccgagaaaaaaaacagaagaccagctaacatctaaaactgaacatgcatacaaaattaactttatttgaaagaaatcaccctgtaactaccaaaaaaaa

SEQ ID NO: 15787 - DNA, 22933 bp, Oryza sativa
cagttgtaagaatggtacatttaacatgtaactacactaaatttctcatgtttagactaattgataggctcaaaaataatccaccaaatatgggcacatttggctgggatctagcttcagatccaccttttctagagctgtagtgtaaccaccaacatgcatactagttgcattcacaaaaaatgactaaaattacacatgtaactactgtttatctgaaatgtaattacagaataactataaaacagaaatgaagccaattcacacataatttacttttttttgcaggaatgaagccaatttcagaatataaacataaagtgagcttggagatagaggggactaaagaaaaacacaagatgaaagaaaatgcaggtatcagatagaaacattaaccaacaaaatagtctgaacaagcataaaaaaaaatccatacatttggtttttacagtgagtcagaaccaaaaatacatatgtatatacagttgatttgtaatgtaactttgtttttcacagtatttgtttctatatttttaataaaatagagaaagttacaatgagaatttaataaaattacacatgtaattatagtgtgtgtgacatgtaacaaaactttaactaaatgtaaaagtactctctgacactttgaattacacatgaattttgatgctataactatttttttaatatttcgcgggagcaggaattatttcaaatgcagaatcaaatgagaatagcaacagtatgacccaaggtacaaaagaaaaaaaatacaaatttgctagatcgtaaaaaatctgacatgccagtacttaccaataaatgtgacacttcttgcaggtacagatattcatcaactacaagatataaggggaagtttaaaagaaccagagaaggacaaaacagaaacaaagcatattcaagaaagaagttctaccatcacacaaaattcaggtaaaaaaaataatattctttgactatatgtattctgcaccaaatgaaaaataattttttaattacaaatagccaatccttcatgcattttcaattgacaggaataactgcaactcaaataccacagagcccagcattgctacatgatgagttaaacatgctaaaactctcgagcaacaccggtaaaatataaataaataagcaacatacaaaaaagacaattacatcattttctctgatactaacaaattgaaatgcaggtagcacagttatcatatataagtctcatgcaccaagtgataaacagtccacgcataaacatacaacctaatatggtaagaatatagaatgacaatatgaatatcattgtacaacaacaaatgtttgactatgagaaaaaataaaaatgatgcaggcaagcctagaaagtttcacaagtctccttcagacaccctcggcctttcatgtaagtatttttctgcatttaaatttttgtagagctaatttatcatattcattgtacaaactaatttttttttaattttgatagtgcagaattcaatgatcctaacgacaagcaggttttctccttaaaacacagagctgaatgacagaaacagtgcaatatcattgaccaaacccgaaaatctatccatccatctgtgctaatcttacagaaaaatcaacggtccaaaaaacgacaaatccagccaccaaaaatcattcgacaaatgtatagcaatttcgtctattattggtgctaccaggggagacataagacgcattgctaaacacattcttgaacaaagggagtatcatccgacggtgaaatatacaatttcgaattgacgttttgtcattaaacaacagggctaaattcacatagcgagggcaacattctgcaatcttggattggtcaataaacaactggaagacaggcacaagacaaccttcgctccaaactccgactacttatctgcggcaggcacaaagagcccaaataatcttcaagcagtttagctaagttacattcattaggagtacaggagcttgtgcattctgttctctgttgcaacaaaatagaaccggagaaaaatgagcaagcatagttgctttccacctcaggctataggtggctgcgcttgctgtttctgtaccatggccttatgcttctgaccaattatgtgaaactcataaactttctggctgttgacgaccacattgcacacggtacatattttcacttctccttgagctgctccagcgtcaagtacacgcctcctcttcacctccagttcctctggggttgctgcagcactcttcttcttcttcgtttgtgcagcaggaatcacactggtagtgacactagtagtgacaggatcaggtgccatatttgctgcaagagcaacagtgtttggagtacttggaggctttactggtttaggtgtgatagagtcttgtagcctctctaagtttttcttgtgcttctttcccgtcttatggatccttagaacttctggagtatcgcactgaatcttgcaaacttcacaagtcaatggttgcacaacctttggctttttctttatatgctttcttgaaacaattttcggcacaggatgcccgaaatgggcattccactgagcagggtgcatgcctggggctgcaattgctggtgccactccattcgaagatctggcggctgctgcctacagatacattgttgttgtgaagctaaaagcaaagaataagtatgaatataaaacagataaccagcagacttatagctccctccttgataagatatggcacataaacaaacaattacaagacaaacagaattatggatttaaacaggattttggcaaatgaatgaaggatagatgcgacatatcctaaataggttcagcaaatgcttaaggctaaaaatctaaaatcaactacaggaattaaaaatgacacacgtgtgttataccagaatgacacatattataaggattgcatatagaaggaaaacaaaataaacaaaacacaatctatggaacatttaatctttgataagagtcagtaaagcttccatagagagaatgagctctaaaataatacaaggatttttgttctcatcctatgtcaacatgtatcgttataagtcgattattttagcattatttacaaatttcttctagtcacaacaggtatgatttattttccaaggtgattgttccaacggacacttgatccaagacttctgctgtgttgtgcaggaaaagcttcacatactactaataatgttcacttgatccatacttaaggttctatttggcacagctccggattcgagatttattggagctgagtatttctagctccacaaatccatagatttagatctacgattacgttgataacatttggattaatcattttattcccattttatatgaaatataaaattttaaacaactataatttgacatacaatcttcaaatccagcgttgatctgggatctatagttgtaccatacatgaccttaaataggtcacaactcttgctttctgctgacactatggcagatagggaccaaaaccactttaatgacgagaaattacagcaagctcaacatgaactccactgaaacagattatttggagggaaaaataagaaaataccaaatggattatatattatacatcatggctctaacaaataaatatattgacagattatttcaattatatgttcatctttttcagcaaaaaaatattttgtaagttttttaatcatataacactcgcagaccatacatgttctatagcttggcttgttaaccttgaatttattgggacctccagaaaacacgtcaataataggaactacagtagttgctgtctgaggagcataagcaaagttcaagtaactaagatctgactgcaagatgagagatgcttcaacttttgcctttgctgccttctatgtaaatacacactttagatttgcagaaataagagaactaactgaggaatcatatgtcgcattccaacaaaacgtgccaacgcaagcagtgtggtatgggagcattacaacgtgcatgaacatcaaatcagaccaccaaaactattgctcaattgatgcattggctgtctaaactctacagagacatctagcaaagaagaaaatcagcaaccttttactaaaaacctaatcagtagtagtagtctagattcagatattagagcactgctttattttaattttcaaaatgccttactttaatcagtacagaggatagtaagtttcaggatgacataagacatatcttcataaacacatattgtaagatcaccacaagcaattgagtgcatattgattaatttattgtatttgtttcatagtttgacaagatcaactttgtggtgtgaattgtgatccaagtgtgcaattacaactacaacaaccgagttattattattgttctaattggtttttcatcatagaatagaatgctataatcaccacagtagtaacatatcgaatgactaatcttgaagactgtatatggtttgttttgctgcaatcttttgcccgacattccaacatgtgcaattgaagaaaacaatctcaaggacctcagaaatgaaatttctatttctatatgtcccaacggtgtccacacaataagacatgaactttactgaaagaagtgaactggtgtaaccaagttagcaaagtttttcaaacatgaaaaaaacatacaacaggctaaaataactataacaggcaaatggtatacttgattatcttttaactttcttgaaacaaaactcctgctaccatatgctgatacaatcctttggttggcacataataaatacaaataacataaacattaataaataaattaattaaaaccagacttcgcatatttgaaacatggtgtcaggtcaggcaagttaccacttgtttctactgtattatatatgtaaaacccaataaaattgtaatattatgaaagtgctttttagcacaatccaaacatatgaatttaaagacccaaattaactatttcaaatattcagttttggaagtttgccatgaagtatgtccagaatgacattttctacaattgtttcaaaggaaaccaacccaactaaaaacataagttattcagttaaccatacaggcataagttctccaatatctccaatatcaatgcgtttcaacgatacggaaaccataagatcgaactccagatagtcaaatgaggacaggtaaaaagaatgaatgtttcaccaagtaaaaaaaaaatgaggttacgtgatagccaaaaaattaggatgcaagttttgccattacttaggatgcagtatacacttaatatgtctcactgtgaggtccaaaggaattgcgcgtaggcaataggcatatgaaactgtggcaagtatctgagtaggctgcctaagctttgggtggcacggtagtggtcaagtgaatagtactcaatatacgccatatatttttacaaatctttttacaaatattatctctaatatatgccatatatgccatatatttttacaaatcttatctctaatatagaatgtatgttatccttcaaaacaaggcttcgatttaatcgattcatcatcttttaagatttcacggaacaaactgaaattcgtgtgtcttggcttatccacaaacaagagtctttcatggaagcaaaaaactcccatgccacagaacatttcagtttgcacgaaagaattgtgcttcacagtaccatgattccacaaccgctaccaacggatgaactaaacaatgtggaaaacacctaatccatgcaaatgtctgagtctcacatataaaaccaagttaggactaatcgaataacaggtaatcccttagcgagaaaatcgccaataggccatcaaattcttaatttatgcctaaaaatgacatctcaaaccctaacacgcctgaattcaccacaaaacaatcaggaactaagggacattgaatcaaaagagaagcagggtggatcctgacctgcgcgtagcgctgaggatcgaacccaaagtgcttcccggcctccttgccagccgccgcggtagccgccggagcaccctgcgacgccgacgatgccggggcctgaaacgcctcaccggcgccgaagtagtaccccggcaggcccccggcgccgccgctgcctggcccggccgcggcggggtcagcgtagtactggtacgccgcgtaggggtcgtactggccggcagaggcggcggcggagaccgcggtggggtagtagtaggaggatgaggcggcggtggcgggctccgaggcgggggcggccgggttgtacgccgcgtaggggtaagggtagccggcgtaggggtgagggtagtgcgggtggtggggatccgccgccggcggcggccccgcggcggcggcgtgagaggcggcggcgccgtagtccatgttggtgcggtgcgagtgcgagtgcgcgaccgtcagatcgcggctgcgggcgcacgtaaggcacaggacaatattgtcgtgtgtttcctttttcctctctttttttttacgcgtcttcacaaaatgcttgctcgtttcaaatttgaggaagaagaatctcgttgatggagggtcaaatttcatcagggagaagaatttcatttgtggtaaatttcaggggaaaaggacttgctaattttggttgcaacattctgttatctcagaatgcagataagctgagtcctacgaagaatgggtagcaagatccttatatgttgtagtcaaattagcgaaatcatctcaagcacatatatgaccgtaactattttgaacacggttaaaccaaatgtataagtattcttggttagatttattttctgttacatcatgagttttatgtgtttccttagtcctatcaatcattgcttgagttaggattgtgtctagtctgagccattatgttgactttcatttaaaattattattccatcagtcccaaaatataaatatctagtactggatggatgggataatacatattttcatattccggatgaagatagtattaaactttccattctctgatttaagaatttgatatccttgttatatatttaatcatacccatagctgtatggatttgatttcattgtgtcagtggagtcaccaacttacattggtaagatctcataggagcttggtaaaatgattaagtgtgtgtgactttcaagactgacacctaatagtttattggaacatgcatatttttacttgtattcttgttttttactaaccatgatagggatacacaaaacaactagagatgattgtgcacaacttcaacatcttcattaagacatgaggacattgagatatgaggaccgaccaacattgggcatataagatatgtgatgatgttctacataaaatcattagtacactcatattttgaaggaaattacctcatgcttacattaaatgggagctagcaatagataaagaatttcaaaagcatgatttgtctaaaaaaacaaaagctttggtgttctaattttaaaaaatgcttcatatgattgagaatatttttataggcatgataaaatacctcaaccttggaaatacatgaaacatatttgagatatatttatgtttccatggattatgccaatattttgttcattgaaccataatatttcgaacaagagagccaaatcgttacatcatacaccatgatcttctttactacaatgtggtttacacgaatgcaaagaaactaaagaaatgaggtttttagggttaacaaagaaattttagacaagattgctcgttgaagttatagttatctttctcatttattacaacttgcttgcaatgctgaagtaaaaataaggaagacataagtgttgatgtgaaaacacgacggcctgggagatctgcttaattccagtgcaggtccaaggctagactcgagagtgtcaagggcgtgtcagctgatttgatcttgcaatcagtaagaaagacaacagcagaattagtcagccgataaccgatcgaccgagaggccgataaggtattgttggtaatctcagccgatggagttagaccaaatcggctatggactgagtatataaaagaatattgaactccaaatatgcctaattgactgtaatactgtctatcaagtttgataaattggtttaagacaatatcataaaagtagccgatgtgacagtatttagaacaagaaagaaatgtactagttaatactccagtacaaacctatataaataaattgatctatataaacatatcaaatagaaatcagcttgaaggtgcaagaatctagccgatactgactaaagcttaatatgcttatataaaatgatctatctatataagtggcgaatatacatgaaacaagtagtaaaacatgcatattaggtaagatcggctgaaaccccgatactatcattattatgtctaattgcaagctggtttgaatggttttaaacacgactagggatgatacatctcaaagtatgaaagaagcatacagtctagacaatcaagcaattaaacacttttcaggatggtagatgccttagctaatctaatgtcacgcccagaaattcccgaatagaattccaagtagaatgtgcattaaaatccccgtccaggaccggccggggtacacaaacaacaaagttgacatacagatccacgtcttacaaacattataaaagtcttacatacatgcagcggaaaattaaaagaaaattggagctaagccttgacttggaccgcagcgggatcacctactccacaggcatcctcgacggcacgaacgaagcctactcctcggagaagctaccatctgacgcatactcaaactctggtgtttgggaaaaatagagtaagactgagtactacccactgtactcagcaagacatgccggaataggggtatgatgcagggaaatatcgagggatggctatagtggttcatttgcataaagcgagcatttataaacagtagttgaaagcagtaaaacaattgtaataattaatcaatattaatcatccactgtccaacgctataccacgttgcaacaggcccaaccatccacctatactattcaattccattagactagactagggtgaaactaatcacggtgaatctggttgaccgctcataaccgcgggcacggctattcgaatagttttactctaatcagagttgtacaactgtacccacaagacacagccccacgacacgtttccgtgcaccgacatgccaccacgacatacctgatagaggccgtgacaggacccttcgcataaccccctctaaccaagcacaccacacctcaggtttcacccccactcctcgcaaggcagcgggcagtcccctctcatgcctaggtgaatccggaagccgcataggccgtcgcagggcccatccaaactccatcacacccacccttgcctggatgcgtcagtcagaggaaagctacactacaagcccagccgttgcccacgttggcttgtggtaagtacggggaattctcccagggtttcctgcgaaccggtccttaagtgccatgggcgcgactagcaaaaccatgcacccacagcccaccatttaacatattttaatgaagcaacaccaggacggtggctctaatccaatgtcaacactagaacctgaagtctagacattaatataattttccccattgtgtgctagttgaactaagtatggctaagcaatccctagtccaatatctagtcatgttatatcttaagctaacaaaggaacatggtacaaaatagcatggctataacagtaggtaaacatcccatggtaatattataaaacaatgcagtatttgaaggaaaacaatagagcatttgcaatataggatcaacatgttcaagtgacaagcatgacttgccttgctctgctgctggaggaacctcggcgactatttcaaagtacaccggagcgtcgggagagccggaatctaagcgacatacaaagcaaacaatacaaacaagctataagactactgaaacagagagcaaaaccatttttaatggattctacgcatttttcttgatttactgagacttgaatgggcttaaacggagctcggatgaattagatatgaattttagaagattcactgtgtttttactataaacagaaaaatccttaattgatttattgcgcaataaataaatcccgggagagagagaggcggcgccgaaatgcgggccccacatggcagtgacatgggtggcggtccgcggtggaccgggtctacggaccgggaaaggggcggcgcaccacgtggcgctgacgtggcgccgacgcggcggccacgcggcagccacgcgggcggccgaacggatggccctgatccactcggggtggatcggacggcggagggggtggcactcggccggcgcgcacgtgcggctcaagctggcctgacggccatggcgcacggcggcgcggctcgacgcagcggcggcgttgcggcgacgcggatggcgacagcggtggctaagcggctaggcggcggctaagcggcgtaggagagagggagagagagagagagagaggaagagaggcctcaccgacgacgattgacgacagcgagcgacggagggcgatggcgacggcgggacgagctccggaaccacctagtgaacaagatgagaggggttagagggagagaggaaaatgggagagggcgaggacgccggccgaaggcggcggccatggcggtcctcaccggcgcacgatgtggagtgggttccggcggcggattctgacggggaagaggtggacgggatgatccacacgacggcgaacgtgacggcgtcgacggcgtggctcggcacggcggctagcggcgaccggagcggcggcgacgccggcggagagaaaggcaccggcgttagggtggtggagggcacggaagagctcggcgaggaaaaagagagaggggatggcggtggtgcttaaataaaggaggaggggtccggacgtggccgggagaggcgggaatcaccggccgacatgggggagtgggagaggagagagaggcgggattcgaaaatcgaatcccggccgtctcgagcgcgggcgcgggcgggagagagagggaactgggcgcgggggacgctggtgcgagggcgacgtgggcgacgtggcccgggagacacgggagcggggtgcggcggcgccggctggaggtgggagacgggcccgacaggtgggccccacctgtcggcgacccggggagagaggagggggctcgggcggctggctgggccgtggtcttcggctggcccagcggggagggggagagaagagagaatgggccggcggcccattcgaaagagaaaaagggaaaaagaaaaagaaaaagaaggaaatggattttcctgggattaaatattgcttgtgctcaattttaattggttaaaattatttctagagctctgaaaattccactaaaaatcttgttagcgtatttcgacatgtagaactcaagaaaaattccacatgccaattccgattattatttgcattgatttattagggtttactcttgctttacaccggtattttcttgagaccatttataacttcaatttaggcttgggaaagaacttcagggtgtgatatctaatctagcaagacaatttagctgaaaccagcataaaccctaaagtgagcagcagccgatagaggtaaattgagaagctaagaatagattaactaagacacatgatagcaattactcgcgatatcgagcctaacacgtctaaagcgacatgttagccccaatagcaccggccattgagatgggttacctcttgcgaagaactcgccgaaaacgaagaaaagtaaaaagggtagcgatgtgccgaagttgtattggattgtctctcgtattgcaatgttatggggttcatatttataccccgaatacaaacttagtccattatggacatgactcaaacctttctaaagttaagatacaaataagaccatatatggcggtttcttaccaaatctctaacaaaccgactcaatatcctaattaatagatacaattgccttaatcgagctctatctctaattggcaatgacggttatctcaatcttggcccatgtcgagcccaagtcataccataatggttgtatcagccatctgcctcatctacctagatctgactcatactctgttttcagccgatacgatatccagccgatgcgcagtccgactcgtagatcaactcgatttcacaccgaatcctctttgatcttattcctttttctccgaatctaatgcaaaatttcgttgttaacaataagaaagcaatgtctcttacatgtttcctaatgaaagggcatattctagaacaataaaggtctattggatttggctaaacatcggtacgtggttgattgtattagtgggaaaaagttggattttgttgtattttagagacaaggaaaaaggacatgtctaagacaaatccagattgcctcacgggagcgtggattttatctagcattgtcttcttcctcgtggacaatcttggggtatcatcctatggataaaatgctttaaagatggacatatctctcattgttgaaggtaggggtgggcacaataaactgagaccaaagaccgaaaccgaataaatcgagaccgagattgaagtaccgatctgtcagtcctcagtctgttgatcggtctgggacgtggaaagaccgaacttttatttggtgcttcggtcatgacccttggtcaaccgaacagaccgaactctagaagtagcagcaggccataggaccacagttgctccagaaccatagcccacttcacccaggagatcaggatccaagagataacagactgaggcatcagagagagtagtacatgcacaactgcaccatcgaaaacccaaatcgttccccactgccctcctagcaaccgccgcttcaccctgcgctcgtgctatggtgccttcctgccgccgactaccaccagcgccgcacctcggcgtgcctgcgcctgctgccagcaccactcgttcacaactgcattgctgccgtctcctacgtccccctgttgttcggcttcttcctttcgctcgaatccacataagaagagttggccccaacgacactcttctcactgctgctgttgtccatgtcctgcgggagcagtgcgagacgactcaatcttcgtctcagcggcggcggaggcgagacctcctgtaatgtcacatcctgatctttgtttcaggatttataaattatttaataaattattattagaatttatattaaatgttcattaatttacaagtgaagttaaatgtgggaaataaaatttcctaaatataaagcatggatggatttaatttttattaaattctccatgattaagtatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattagtagaaatgatcttaaaagcctaaaagagaagatttttttttaatttgctaaatctcaatataaaattgggctagataaaattttgttaaatacttctcttgaatctttagttcctagatttttttgggatttatttgagccaagaaagtatttttaataaatggaattgcatttcatgaataatttaaattgaaaaaggtttttaaaaagtctcttttggctttgggccgaaagccggcccaaaacctctctctttctctctccctcctcggcccagtcggcccagcccgccgtcgcttccttctctctcggtgccgctgacaggtggggcctacctgtcagggctgtcttcctcctccagccgtcgcccggccgaaccctagccgagctgcgccgccgccgctgcccttccaaattccgtcgcccctctctatttccggtcaaattgattgagggcaaatgatctttgagatctcctcttccttttctcttttggaaacatcggctaattttctttggaaaccggtggatttgagttggattcggattcatctatctcctctaaccctagactttcctcctcgccgccggtcgccgtgggcctccgtcgccgcctcctagcctctataaaagcatccctgggacctcctctatccgccgccacctttgccttagcccgccgtcgcgtctagcgccgcctccgcgtagccctagccgtcgccgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgtcgccgcttcttcctcatcgccggcgccgtccgttgctcttccgccgttgttttggtcaccggtgagttcgccgcgtcgccctctacccgttggtgtcctccgtttgcgtcgtcgcgccgtcgttcgccggtgagcatgcgttgccgagccaccgccggtgatgacgtcatcgctgacgtcatagctgacgtcatagctgacgtcatcgtcgctgtccccgtagacccgctgtggaccacggtagatcaagtcgatctcggccgcccgttttggatagaatcgatctcggccgttcgtttccttagaccgtcccgtgcacccggaccgcctttgatgacgcaataattcccttttctttttcaaaaataattcattattgcgtcataattcaattaaaatccatataaatgctttaatccgatttaatctttgaaaattcataactaattcattgtaactcagtttaatgtggttcaagttgcaaaaattatataaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgtgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgggctatatatattggttcagctagatattaaatatgattgcttaaccatgcttagaaacattagcacactattgggataattaatgtttcattattatttaatgatagcttaatgatagctcgcgatggtcaatcgtgattggttaattaattacttgccaaccaaaacttgataatggtgggttgtgagcacatggttttgagagtcgtgctcatgacaattaaggaccggttcgcgaggtactgttgtgaaacattaaccgtgccaaccacaagccagcatgggcaacgactttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcagaatggttgggcctgagtagcatgggcgtgttgttcagtgttgattaaaattaatgattaaagtactctactgttttattactcttaaatgtttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgatttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacatgtaatcctacctgctgttgtgtcctatactccttcctactaattaagggtgctcggtcaggtcaggtaggaccgaagaccgaaccggtagttcagttaaccgaactctcggtctaagaaattttgttgtgttgatcggtcatcagtttctaaaaaccgaactttaaatagactgaacaaaccggactgaaaattctgtctagaccgaatgcccaccctagttgaaggcgaatgttacctaaaattccatctgatcaacaaagaggataatttcaaatggattctcatggcggtatatagactggcacatactctaagggggatttcttggttgaaatggttcggacatgccaaacaaaatcatcttcccactctaatggcaggtgattttagtatactcaggaaaagtactaaaaaatgcaatgatcgccgcaatagccgttgtccatttctttccagtgttgtcattgacagctttgatttgcgagaaatcgatctcacgggtagaaaatttacttgggcagactcactattgacaccaacttttgagaagttggatagggtcctcatgtctacggagtgggagtccaagtatcctttggtgccggtacatgccaaaaaaggcttatttgatcatacccctcttctcatggacactgatgcacatgttttcacggggaatatgaagtagttcaagattgaacttggatggttcccgcgggatgatttgtatgtttatgtggtcgagatatggaataagccaatgaaacggggaaatgttgttcaaaggtggaacattaagatgaatgccttacgacatcatctacgaggttggattgcacatgttagtggcctttatcagaaagaaaaggaaaaattgcagcacactattgacactcttgatatcaccgcagaagtttgtgttctaactaatcttgaaagaccgactcttattcagtccagagatcggctggcgcacctacatcgtgaagaagaaattaaatgatatcaaagcgataaagctaccaatgttctttttggtgataatctatactctaaaaagattctaatggtggtggcgttggtatttgtcgcgatcacagataaatccgcaagagcatggataccgctgtagcacttcactttagagtatttcaagggtatgaaattacagggaacgtgtgtgtataatctaataacaggttcatccaaggacaacatgtaaatggaaggcttaggatagagaagattcctatggattaagattcttgaattaatttaaggtaaaactttatctcttgcttcggtcaccggctttcccttggtcttccaagtgaatctggaatatagttctgtgacataccgaacgtggaggattacaaagaatggacatggttgtctccacctgccgcctacctctatacccgcggagtacacaacaaacaaatgtaacatctaacctagacatcacgtctctatgttattgattataactctagcctcgcacaagatctttcttctttatcctgaggtttagtactatagcgctttataaatattaaatgatgaacaagtaaggatgggaatatatcttacttaaacaagaaaattaaatgaccaaaagaaatctcgacttacttttataaaagaagtatccgccgaggtacaagagttgagagagtgctgacaaccccaagactcctccaaaacttcccctcactctctacctatttcctaacactctactagagagttgccttgaatgaaagtcacagtccttcacttgagttgtgtgttgtgaagtgaagtgagaagctccttttatagtgcttaatgacggttgctaatgtcggtggttaaggcggtttcatccacaattgccattagcagccaataggggatcaccacgcggaatatggtggcaaggggcgccaaccacccctggttcagtcgaatcctggtttggccgaactaggataaccgccacggcccaccgacttcctccgtgcgtatgacatgtgggcccttatgatgatgaatggtgactttggcctaaattatgttggtttgctctgatttgtgggctcttcaatccgtgtactcgcgtctaattggtcagaggtgtattttgtcacatggcgggtgcgttgtaagggcaatatactcccattgtagtttttacacattacccttgaactttttaatattacataacaactaaatctaaatagatagccacatataaaattaatttgagatgagtattccttgtagagaaaaggtgggtaacataatcatgaaaaacatgctttcatttttttaatgcattgttatgatatttttttccttttatccatatatagcaaagcaagggcacttagctagtcatactaaatattatcacttgattgctaattgcaaacataggaataacttttggtttgcatttaagcagcgttgctggactgccgatcttcttcagaagtgtggtatcgatagccactctgcttgccccttttgcgctcaggagcttgagacggagaaccacatcctcattgactgcgtgtttgctcgacaggtctggctccgtgtgatgtcccctcctggctgggctgccttctctccccctcgtggcagctggctctaggattgtagtcatcctccagggcctgtttacctgagcacctccgcatcggctttgacttcttggttctcctagtctcctggcagctgtggaaggaacgaaactccagggttttcgaatctgcgctcacttcggtcccagtggttctggagtccatccgcttggagggccagctgtggtctttagccggcgttgctatttttggggatttcttgggagtgtagcgtggctctgccccctcccgctgtctggcgttgcatttttaaccgtcatagtagttcctagcttcaggtttttttattttgccttttctcccccctgggcataagccagtctggctgattgctttgtgtaacaaaaactcttttcttgctaatatattgacgtgcaatccatttgcgcgttcacgaaaaaaaaggaagaaacgaatcattagccttgactaggatgaaggaaaatttgagggaaatgaagccttaaaaatttacatcacagagttttgtattaaagattttggaccactagatgtgaattccttctctctcaatgaaaacagaaaagaagacatcccccaagtgtctaaggcataaaatgatcattttattgcatctttctctaaggaggaagtaagagagctgatttttggtatggaaacaaataaggcgtcgggcccagatggctctccggctgaattttaccaaaaaatttggaatgttcttaagcatgatttattgcacatgttcaatgaatttcatgccggagatttcccaatgtttagcctcaattttggagtaatcacttcatacccaaagtaaaggaggacaaccaaatacaacaatatagattgatttgcctcttgaatgtcagttttaaaatctttactaaggtgaccactaacagaatcaactcaaaggctggccatatagtgaggccagctcactaaaagaatcaattcaaaggttggacgtatagtgaggccaactcagtcaacctttatgcaaggacggaacatccttgatggggttgtgatcccacatgagactgtccatgagttacacagtaagaaattgagtggggtcatttttaagattgactctaagaaggcttatgacaaagtcaaatggactttccttctacaaaccctacatatgaaaggattctcatcaaaatagatatcttggattgagtctttcattttgggtggaagcgtagctatcaaagtgaatgacgatgtcgggcgtttctttcaaacaaagaaaggacttcgacaaggggaccctttctctcctattctttttaatttggtagttgacatattgactgttttaatccaaagagtgaatacaataggaccaattgatggcatagtgcctcatctgattgatgggggcttaagtttgtcgattctgcagtacgcagatgacactgttcttttcatggaacatgatttatcataagcacataattaaaaatgttgctaaatgttgtcgaacaattatcgggcttaaaaatcaatttccataaaaacgaaatatattaccttagcgaggccaaagtcatgcaagggcaatatactgatctttttggtcgtgccatcgataacttcccattttgctatttagaatttccaatgcactattggaggctaagtaattttgattagaaagaagtgctagaacattttcagcaatggcttgctagttggaaaggtaagattttatcacttgggggagactcacactcattaattcagtgctcacaagccttccgatgtatatgatgtccttctttgcaatacctaaagatgtgatcaagaaaattgattactttcggtcaagattttattggcaaggagatggtcataaacgtaagtatcaacctgcgagatgggatgtgttatgtcatcctaaagatcaatggggtttggttttacatgatttggcatgtaagaacatagcccttcttagcaaatggttgtttaagttgctcacaactaatgaagcacaacaacaattgttgtgtaacaatcgggttcacaaccttcatctcaagtttggtggaaattgggggattcacacttttgggctagtcttatgaaggccaaaccggattttcttaagtttggcttcttcactattgaggatgacactcaagtttggttctaggaggataaatggtgctgggtaatgcaactttgcatgagcaatatccttgtttttacaatgtggtaagacataaacaagccaccatttcagatatctttcgaccaaccctttcaatttcaccacatctggataattggctctaagctagtggcatagaatcatttactcccacgtatcgctaaatgagcaagatgaatgtaaatggaatctaactaccattggtggattctcggctaaatcacattatagtgcttcacttcatactggtgttcccaatattaaaaaaaatctagaaactaaaatcccctcttaaagtaaagattttttcttcgtggtatttgcatcgtggtgttgtgtttacagaagataacctagcttaaagtaattagaaaggaaacaagacttgttgcttttctctgttttctaaatgtcggtttgcctgatcgatttggtctcaaatccactttgcggccaacatttgtgcgccaagggatgcgtcacatatgtttgggcaatggattttgagtcaacccttaaaatttcgaactctaatactgattggggtggcaacagcttgctggtctatttggctttgtaggaatgatgtggttttgaaagaaaactttatttcttctaatccgcaggttatattcttgattacacgatggcttcatgcttggcttaattttcaaaggcccattttgaaggactttactgttgcggcttgttttcaattggagcaggtagccaaggagtttttttcaccccaatgtttgggtggcgttttagttttcagataaatggcctttgatttttacagctttttctttagcgatgtgcatggggtgttttggttgtgtgaactttgttgtgcagagaccggaagtgttctcagacatttgatttcaataaagtttccgttatcttaaaagaaaaattcttgatgataaaaaactgtctgttgttttgcatagacctccaagatatagtcgttcacttataatggtcttgtataaataaaagtaattatgagatctgaacccttctgtacatgagtgttgtctagaaagtttgtatgcagcggtgtgaaatgattcctttgtcttaatgttaatcatcttttttttaaaaaaaagataagagaggaaaggctctcatagcaaaatttattaagagatcggtgaggctcgaacccgcctttctcaatgctaatcatcttacaaatatgtcacatgtattcatcctcatcatcccaatcaataaatttataaggttcatacttgatatcaacacaaggatgatttggatgaatgcacatgacattattgaaaacaaattctacagctgttctatctgacagagtagcacggaatccactgatgcttgcatggatttgtttgaggcttgacaaatgccctatgccaaaaggtaactccttttgt

SEQ ID NO: 15788 - DNA, 9568 bp, Oryza sativa
agtgcttgagaactatgaatgtcgtgccactgatgacaattctttctttagcggcactccgaacatgcaagtaaagatgagctagggaaggcatctctgcaaggataagaatgtcatccttcaaaagcttccctaaagaaagttccaagctgtgtagcacattgagttcgcctatccagcttggaaccctagagaactgccagtctgaaagaaagagcctttgaagatggtgcgcggacttgaacaaaccattcaaactatcacaacacatagtagacagatgatgatttatatgtagatctttgaggttgcaatctgcaagtcttgcaagagattggaatagaacatctttatatcccacaaaagatgatcctctagaacaagagagatgcagatctttcaaattggtaagctcttgtaagctcgcaatattatgtagggaattcgtccccagatcaaaatattttagagtttgcaagttcttcaagttgccgattccatctggcatgattgtttggtctggtataatcagatgtagcaagcgaggcaaatgaataatatctgatggcaaaatgatgtccaaatgatggagcgaattgaacccgaaatgtggtaccttttcgatttcaaatgtctccaaatgttgtagaccccgtatttgagatgggagcttaaattgttccatagtccgaatcttgaaatacctcagtttggtcaaggtgcaaattccagtgagatcttgttgatcagaattttctaggattaggacctgaagactccgaaagtctagaacatttggaatgaatccataacttaacataacaagtgaacgaacttgcgataggcaaatagttgcaactattttattatatttttccatattaatccaagagtggaatgagagccgtcgaaccttaccacacaaccttctcatgaactttgaatcattaacaattgtaaaaagattctcatctgttgacttggatatgataagatcaagtatcatatcatgtagtctacatgttaatacatcatcattatggtctagaagtatcgattggatcatgcttctgttgataagctcattgaaatagccacgtgcaacacagtatgcatcatgatcattatgtgctgtacgtacaaaaccttcagctacccatagcttgatcaaatcatctttttttattgtgaaatcttctggatatatcccgacataaagaaagcatgccttaatacaatgaggaagatttgtgtagctaaggttcaatatttttctcattccatctagtgtgagattttctccatggctggtgcctagagaattccgtgttattgctgcatcatgttgttgaagttggcgaactgcgcatcagcagattgttgccattcttgcgtttgagctgtgttccgtgaggttgtactggatctccccagtctgcacatcaagggtgtccattctcctagtgatttcaaccaagtcccaacgagaggaacttgagcgccattcacttggagatggaggcacaccacttgatctgggaggttgattgtcccccattggatgtcatgaggcgcacgccaccggtcctcactagcacttgcctagcttgagactccgatgctgtggcgtggagcttgggtccatccgggtgcatccccagttggctcccaacctgcctcatacatttgcacgggtgttgaggatgatgaactctctcattcattccttgtcatggtgcgctttttcctgtatgctccacctgcacgagattcttctatggtctgcaggggaatggttagttcatggcagttgtacaaatcataccccgcatttggcaacgggatttcatttgtacaaccagggaaaaagtaaatcaaagatccatctactccatgcttcagaatatgcccttgtactagataggtctcatcaatacacggatgagcggctgagataaaagcaatttgatcactaacaacccctagcccttttgctatccgagtaattagagaagtgcacttaacaggagtagagaactttatactttctaaccattgccttatcatacatttcaaaggagcaattttgatctttctaaccatggcaaacatgataatcaattcatcccccctaatgggtctaagatcacctctaggaaacaaagtcatagcaatttatttgtgcatgagcctaagtgtaggattatggatatcattcgtcctaggtttcttgcaaattgtagcaccagaaatgtcttcccaaaacctatttttctcgaacccagaaattcctttctgaagatcgattttacaggaatcgtgaaaccaagaagtgtactaaagcctttccatgtaagtgtgtactccttatggaaaaagcgaaaggaaattccatcttctatttctttcaaagtgcacagaaattgcaaagtaagcaaacgagaaccaggctcatctaccacagcaaatctctgccaaccaaccgctttccaaatagaacgaaattcaatatccatacctatctttttcagcagctccggagagtattctcgtgtgtgagaatactcctggtcgctcagcatgtagtaggcttgtctctcccgatcactgacaacgtcgaggtcggtgtcattcaggagtcgtcacggagcttcggcgtcttccatcgagacatcagctgatgaacaagtactagactcgtcatgatgacttgatgaagagctggaccccttgaacagacgagacaatcgcctcctcattctgtataatggacaaagaacggactaactcggtggggattaggaatgataagaatttcgcccgccggttagtttcaccaaagcaaattgtatatatgcaactaagtatttgaatttgagggaaactatcaaagcttgaatgaacttaagagcaaactttggagagggaatgaaaatgtgttgaaatggggtggagttccctctcccggccggttggcttaagtagtgcacccacaacggtcaaaatcgacctgtggggcccactagctgttgcctcaaagagggaggcagccgaccgttgcctggccagtttggccaaaccccctggtgggcccaaccagccccactttcgaccgttggattccaacggtcagtgtcgtcgtggcacaacgaattttcgttggaaattttattttggtttgctctgaaaaattcatttgaagaatttcctcaaaattcaaaaaatcctaaatgcaactttgaaattcaaacatgcgatgatgcaaaatttcaaagtgttgaaagcaaaaatgcaggtacataccaatttacctgttggcgaaggtcgcgtcatttaaagtctgacgtgcaagaccgtacctccttttagttcagtttgcggattttctacccgtcatcggaggtgatggagcgggcgtctttggcttctccctccacaccttcattggctttggtgcggacggtggcttcctctgagccgactgctctagcttcttggccggtatgggtggttttaccggcgtcctccaataacgattcctgggcattattgtttccttctccaggaaattttgcatgaacttcaccaggctgtccgtcttgggtggctccacttcgaccacttgaatattctgcggattcggtctgtactttatcctaaccatggaacattgttccttcctcggttgaaactcaaacttctcttccttcccgttgatgtggaaacggatactccccgtttccacgttaatgttggctcccgcggtgctaaggaacggacgccccaagatgagcggcgtctcttttcccctatccatgtccagcaccacgaagtcaaccgggatgaagaagtcccgtatcttgactggcacatcctccgctatccctgccgggtaacggactgacgaatcagccagttgaaggcacattggtgttggtgccaacaccgtaaagttgagcttgtcgaagacgtcttttggtatgacgctgacactggctccaaggtcgcacaaggcctggttgaactattgtgccccgatcgagcaggtgatcgtaggacaccccagatctttcttcttctccgggagcttgtggagtatcacgtcgctgcattgctccgttagctttacaacctccgttgttgggagcggtctcttgttgttgagtatgtccttgagataacgggtgtatgttggcacttgcatagcgtccaacaacggcacattgatgtggatcttctagattacttcaacaaaacaagcgaattgctcgtccactgatggtttcctactcctttggggaaatggcaacaaccgtgtgtcgcagtactcctgcggcacggtcttctctagctaggggtggatagcgagccagctcggctctgctcggctcgactcggtccagctcgttaggataacgagctggctcggctcggctcgttatcctaacgagctaaaaacccagctcggctcggctcatttaaaagctcgagctagctcgtttggctcgcgagcaaagcaaagcagtagtctggtagatggcaagaagatggctggcgacactcacatgacgacattggcgctggagttggaaacaacttgacttggagacgggcaggaagagcttgtgttgctacggctactggcaggacgatgatacctatctgcggtggccgcctacgggagatggtggcgatgagagcaagagacgatgcccaacgaagagaggctagaaaagcttgaggaaggtctcgaggaccgtctcccaccgcacctccatctccatcgtcgccaaccacgggattcccctcaccgctacacttcgctcgccgccatgcgccgcccatggaagcacccgacgccggccaccactgccgacgctgtggcttggcaccgcgccgccgacctcttcctctgcgaggtcgggctcctccttcgccgccgtattccactcaccttgcttgccgccatgcgctgcccgtccaagcacccgccgccgcagcggctcggcacggcgctgctgacctctgcctctgcgaggtcgggctcctcctccgccgctgcttcctccgccgtgcgacagcctccgaggtgcccccacccctcggccgacgaaatcagcggtagcgagctcctcgcctgagaggctgtcgtctcttctccgtttccatctttttttttcttttttttgtcttttggtttatccatctgagattacaagaggtcgggagctaggctggccagtgaccacatcacaatgtgctgatgcacacatcacatgaaaccggcaccgctgtatcgtggccgatgggcctagttgggccgtcaggatgtccatcctggcatctgacatgatttattcttggctcgtttgggctcacgagcggctcgctcgttatctctaacgagctaaaaagccagctcggcttgttaggaaaataaaacgagccgagcttgtcacgagctgagcgagctaacgagctacgagcttttcgtccacccctatctctagctgaacctccttgtcaaccgagtcactagatggcgctttttttgatatcccattagctcctgcagggttaggatatggcggatcatgagtggacttacctcccctcgttgtgatcgccttaacactttcaacggaggagtcgggttgccccgaaatcctcccagtttcatttgcagggactaaggatgctaagtgagctagctgggtctctatcattttattgaagctcagttggttttggaaagcagaagcgaagccatctaacttaacatttatattctctaggatcttgtcattggcaacaagcattttgcttagcgcattagtggttttagcttgcgcaaaaacgagatccttcaaggagggctggttagaaaagttaccgttgttgttacctccttgataatatgggcgtggttggttccacccctgacctccttgtggacggtacccattgttgcccatgtacatcgcctcctcacgggtttctgggcagtcattcccagagtgacccgtgccgccgcagacctcacacgtaacgtgtgagtccaaggccttgacggtgccttgtggccttttgtcgtggtcgtccaatcgcttcatgaggaggtccagcttggcagcaagcaactccatctccttgacggtatgcatgcctcactgacgggtctggagtcgttcctcgctccaacccatgttggagaccatcttctgtattagatcaacggctccttgaaccattttagagaagaaagctcctctagctaccacgtctaggtgatcgcgggacattggggtgagtccattgtaaaagttttgtaggatcagccagtcgtacatcccatgatgagggcaggcggccacgtactcctgcagtcgttcccatgcttcaggaatagacttgtccctcgtctgttggaaactggaaattcgtccacgaagggcattggtttttcccatcagaaataatatcgagaggaatgccgtagagcatttgtcccaggtattgacagcagcacggttggcatagaaccacttcttcactctcccgagaagggagaacggaaacagccgcagcctgacggtgtcgggactgacgcccttgatggtgtacgtgctacagatctccaggaactgttgcagatgagcattggcatcctcattaggcttgccacaaaacgggctagcctacgccatcgtgacgaggctggacttcaagtcaaaatccacatctcccatgttgatctgcggcccaatggctacattgtcagcagagggaacagcgaactcgtggagagtcttgttaattagccgtagtcatgaatgtcggtggcgctggtacggctggtttctctgtcggtagagttttctgcggagcagtgacttgcggcctgacgctccggaagaaagcttctgaatcttctttgaagttttctggcaagttgaaaccagtcatgcactaccctgttttcacaacaaaagtgaaaacaaccaaggttagcttgcaaaggaaaatgattatacagaggtaaatataaagtattagttcaggtaatctctattatgaatcttccccagtaacggcaccagaaatgcttgttggtatttcataacgtcattactagaaatataactcccagcaatggcgcagaaatactaatggtatattatggttacagagttcatccgcaagcgcacggatataccattgtagcatttcacccgagagtattccaagggtatcgtatttattttatcccgtgggaagatcatgtagagaggacttgactaatagtttatatattacttgtgataatcatattctaagcaggggttaagataatccaagggtagagtgacacacaagcattagttactcattctcataatatattatctaagctaagtgcaaaaaaaaaagagaaagaaaatctattcctatacttctaatatacatagtatacatacattctagttaaccgatatactagctaataccttctatctaatgccctcctggtactttgagaagccacccctgactgtcgagttccttatgatagcctgtcatgaccataccactggggctaaatacggaggaataccctccccagggaattaacttaggattatatacaggcgcggaggaatacccgtactaagctgtcaccatcagcgacacacctctcatccgcagcatataaccccaaataatgatatcccgtaatctagacaccacgtctaaactaccagatactactctaatatcatcgtcatcacatagagtaattgcataagcaaacattatacccgctccaaagcatctcccagataaactagccgtatattcagtataacatgaacataatgtaaagtaggcattcatatactcggaaagtatttcaataccataaatgtatgtagaagagtattctaataaaagtacaaagcttacaaaagaggaaaggaaagctactagagccatacccgaactcttccgaaggcttctggactcctgatttctactctattcctattccaccagctagatactactaagctaaacttgagagaaatgagagagctcttgcttgaggtgtgtgttgaagtgaagagagtgaagcctttatatagaggtggttatgacggttgtggaaggggaattgcccgaagtaccctccaaccgtcattggggtgcaatcttggacgtccatgccgaaccctggcctcaacggtggagatgggggttcggccgaaccccctggttcggccgaaccatgggctggcaaaaaccagcccatcttcggctggcaacctcctctattgcttcactttgtagacttgtgaattttggcccaattcatcgtgtcaattctgagttcttggcctattcatgcataagtctgattcttgacatcgtccgattgatttatcattcgagttgatgtcgattctcctccactttattgttattgtctgcaaaaagttagtagacctaatactagtggaatattattattctaacaaatttatgcattgcaagcatcactagttctcctctattttagtaatattgacggttcaaactgatcgataatgaccgtcaacacccaccacaccttatgactatggtcacaatgtttaagacaagaagtgatggtaagatgcgtcccacaactatgtaaaaaagtcctacgtaaaaataggtcccagcatatcatagagtcattctcaccctcgtctctagtgtgcttgtgtgttttatcttattattttatttctcgaggttgagccataagcgcatccataatgttgcatgcaaagtaaccttaagaaataaattagtatttttgttctatctttatgcattgggataagagaaagcaagaaatgttgttatggccaatcttaagcttaagacttaaggctagaccataagaaataaaaaaataatttatatatggtgctctttcattcacgttgaatagagttttctcataagtgggtcctaccttaagataaaaaaaaacatacacattgtagcatgtgctatatacaaatgaatataaagctgtgggtctcattttattgctctaatgaccataaacattgaggatgccctaagcttattactatttttggcatttaatgccttatgactaatgtccacaatgaatatgatttgttatatggccttatgtctcattcttatggtacattgtggatgccctaagagtggtatttagatagttattaaaagtagatgtactactctgtgtcattataagtgcagatatggtttttcgtgtctgacgtttaatcgtttgggcggttgtagtttttttttttgaacgactcgcatgagacggtgcgaagttctatcgatagagtaggaaaaaattacaagaatacaaccctggagggtcgtaacatggaaaaaggaaaaaatataccaccacctgcacaccgacagcgccaacactgaaagcgtgaccgaccgccgctagaccaacaaagaaacacagacgagatcacccccctaggggatgctaaaacga

SEQ ID NO: 15789 - DNA, 741 bp, Oryza sativa
agccttcatgcgccgaagaccgcgccacacctaccggcagctcctcttcacaccgaggtcccctcctccaccgccggccgcgtctctcgcgccaaaccggcctccatctccgccgtccgcgcctctcaggatgagccggcctccgctgccatcggctgcgcctctctgcgccaagccgatctccgaccccacctccaaacgatgctgcgccggccagatgcagccatctaccatgccctcggcttgccgtccaaggctgccatgcctccggtgacctcagtcacagtcaccgccaccgcagccgctgctgccaaacgccaggccacctcgccatcgccatcctcaccttgcacctgaatccttccccgcatccaccgacgtcgccactgcctccacagtcacagccaccgcaagtcggccgccgttgccgctgccaccatcaccagccgccgatgctagccgccgcctccgcaaaccgccgccaccaccaacgcaactgccgcgccgtcaccctccgacaccaaagcagcctaccgccatgtcctccgccgttgttgccagccgccgccaccccgccaactaccgcgaccatgtcacgcatagaaattcccgaatagaattccaagtagaaagtgcattaaaacccctatccagaaccggccagggtacacaaacgacaaagttgacatacagatccacgtcttacaaacattgtaaaagtcttacataaatgtagcggaa

SEQ ID NO: 15790 - DNA, 476 bp, Oryza sativa
cttgatcaatcatcttgattacacgaagcttctgtatcttgttatgctgccgtttccaaatatgtctcaagttgtgcggtttcactccctcaacattgagctccctgacattgttcatttcctcaatcatctgtggggagaaaacccactgtgtgtactgtaggtctagcacccacaaaccatgaaaacagttccaagactgaacctcctctccagcatcaatgttcagatcaaggcagttatcaagcccaaggaatctcaatccgcggcaacagaagaaaggaggtgaagcaaatctaaaagtacagaggctaagttttagcactctaaggttctctgcatgttgaaacatgtcattataattttgtaaaagatgtgcaaggttgagctttgacttaaaaaaatattctactagttccaccgtgtcttttgattctgtgtcaatttggtgtgctgccaagaaaaatgatgacact

SEQ ID NO: 15791 - DNA, 1015 bp, Oryza sativa
agctattccaacatcattgatcacgtctctggagctttcatcttttccattgatatcatcagcctcatcctgctcatcaataagatcttttgcttgggtcatctctagtttctctgcaattttcctctgcatttcccttctgcttttccacctcgagcaatcaatgtggattatcttttcaaacttcaattctgggtctgcgatctggaccgttgtaagccgtttggcaacagctctgaggacagcagatgcacccaatccttcccaaccatcaaagtagaccacatttgatacatctgatttctttagtttgtcaattatactatcaacagcctcagcaacattctctgcggtaattacctgcagtggttaacagtaattaactgaggttagctcagctcagctgggttgcgtacaaagtaacacgactgtctagaagaagaaaaatcaaatgaacactatattcagagaaaaaaaaatgaaactatatatttagagggggggaaatccttatttgctatactccactttgagctgtcaccaaactaggtatgctgatgtaggcgaggctggtgatgtggagacttgttgccgcagccaccgtcccccacctcgtccatggctggcgccgcctccccatcctaagcatcatcgcccagatctagtttggtgtcaagcgcatgcgaatggctgctacttggggccatcagcaactggatggcaactgtggcgggctggcggcaaggtcaggaagccgatggaggcgggagaggaagagttgatcagcaaatgggagacgaggatgggcggccaacggccatactgcccatcagccatggggatgggagaaatagcaagaaagaaaatgaagagggaggaaggcgatggttcatggaaatttaagtatttgctactattctatttatcaattatccaaatgccaattttaattttgtgctggtaaatttaacgccccgcgctttgttacgggatatatattagatagcgtagaaat

SEQ ID NO: 15792 - DNA, 754 bp, Oryza sativa
cgtctgccactgcagcatgcaaagaatcttttctttgcttatttcttcaaaagattttttatcgtaaactatttatctaatctacaatctgattacaccactaaattcattacaattaaatctttacaacaaaaccacacatgattatatttcgacaaaaaagtattttattttttttattgatttttttaatgttgcatgtggtctcttttgatgtttcaactagtagttttacaatgtttcagctagtgtactcatgatgtttcactgtgtacggatcaaatgttgcagtggaacgtgccgttgcaataaatcacccacatagtttggaaaaccctttattatgggaatttggtttattttttgtttcacaaaaaatgtttcacctagtgcactcacaatgttccattatggatagatctaatgttgcagtgaactgaaatatttcattgcaacaaaaaaacccacatattttggaaacctccaattaaagaaattcgtttcattttttgtttcaccgaaaaatgttccacctagtgtacttataatgtttcactatgtatagatctaatattgtagtgaactgaaacattattccgctatttgctgaaacattgtttttacataaggtgaaacaacaccagatttaaacgagggaaacatttttgatctacttagtgaaacaattccgatatacctgatggaacatcgtgcaacatttaaaaataattcaataataagctaaatttttttt

SEQ ID NO: 15793 - DNA, 228 bp, Oryza sativa
aggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcct

SEQ ID NO: 15794 - DNA, 1075 bp, Oryza sativa
  unsure (1)..(1075): unsure at all n locations
acatagaaagcaaataatacaaacaggctataagactattgaaatagtaaacaaaaccatttttaatggattctttggttttttcttgatttactgagacttgaatgggcttaaacggagcacatatgaattttctatgaattttagaagattcactgagtttttactataaaagaaaaaggcttaattgaattattgcgcattaattaaccccggatgacatcagtgagggggggagcgccggcatgcgggccccacatgtcatcggctcagaggcgccggtccacggtggaccgagtccacgagaccaaaggaggggagcaccacgtggcgccggcgtggcggccacgtgggctgccacgcggacggcgatggacggccctgatctacccatgggtagatcggccggcggaggtggcatgcggccgggcgtacgcgcgggcggcttaagccggcctggcagccatggcgcacggcggcgacggcccgaggcggcgagcggcggcacacctaggcggcggcccaccggctaggcggctaggtggcggcttaccggcacgggagagagggagggagggaggaggggaggcctcttcgacgacgatcgacgacggcgagcggcgcgatggcaggacgggctccgggatgacctaaagaacaaaatgagggaggttagagaacgagagggaggccgcagcgagttagggcgctggccgaaggcnnnnnnnnnnnnnnnnnnnnnnngtgcaagagggatggcggattccggctgcggattcggccgactgaggggtggacggggtggcgctcgaggaggtgaacacaacggcgttgacggcgcggctcggcgcggcggctagcggcaaccggagcagcggcggcggcggtggagaggagggcgacggcgctagggcgatggggtgcacgggagcggtcgatggcaatgtgaaaaagagagaggaggggccgggggtgctttatgtaggcttgagggggcgggacgtggccgggattggcgggcgaggccggcgaagtgggggaggtggagagagagagagggctcccggccgtttct

SEQ ID NO: 15795 - DNA, 23492 bp, Oryza sativa
gagtcggcctggccttcgggaggaggagggaaaacgggccggcccggtaaggaagggggcgcgggaggtgatgggccgacggcccaacaagagagaaaaagaaaaagaaaaaaaaaggaattcccagggattaaatattgcactttgattattctaatgggttaaaattatttccaaggctctgaaaattccactaaaaatcctgttagcatattttgacatgtagaacccaagaaaaattccacatgcctttttcgattattaaatgcctttattatattagggtttctctcatgcctttacacttgtaatttcttaggaccatttattaatttgatttaggcttgggagaagaacttcagggtgtgacagaccaccaccgccaccgccgtcgccaactgccatcgccagccgaccaccaccgccggtcaccctccagatccggccaagaggtgcggatctgagggccgtcgccgccacgaccaccaccaggcgccgctgtcgtctcctccactcctcgtcgccagctacccctccgccagatccggccaggccaggcatgaatctggcctccactaccgccgctcccgaacatgatacttcgccgtcgtcgccaccaagcccctcgtccccacgactgccaccagccgccgccgtcgccaccttcgccagatctggccgggcccatcgctggtctggcctccaccgctgccgctccgagcatcgccccctgctgccgccgcatagtatggggagggacgaggccccaccgcccctgtccttgtggccgcccagctttgccggcgcctgctcaggcggcggcgaggcggggaaggaggcgggtgaaggaggaagacgccggcgtggtcgcctttcgagtcgcccggggaggcgacgtgagagggttttctcaagatactactgcagttgtagtttaattccccaccaaacacagggtgcagaaagcatagcaagcaggcaatgggatggtttgacttcgccgagcaaggatagctatgcacgattcatttcgggcgtgtttagtaagattcatttcgggcgtgattagtaagggaaaagaaaatttttaagcgtcacatcggatgtttgactagatgtcggaaagggttttcggacacgaataaaaaaactatttcagaactcgccgggaaaccgcgagacgaatcttttgagcctaattaagccgtcattagcacgtgtggttactgtagcacttatggctaatcacagactaattaggctcaaaagattcgtctcactattttccccataactatacaattaggttttctttttatttatatttaatactccatacatgtgtccgaagattcgatgtaatgtttttgggcccgaagtaagaaagaggtcgattaaaaacaaaaagaaaaatgaagaaatggctaccgcctaccgtagtggcaagctccgtaaaaaccacgcctccgtccgccgccaatgggtgcatcggcatatgccgcccttcatcgcctcctccctcattcttccggtgggggtgctcatcttgaggatcgagggaaggggaggagcccgcgcgtcgtccggtacgcggtaaccctacttttgtcaacgggatttctttattcgagttcagatggattagatggggattcgagtatttcggtgtgtgctaaagtacaagagagtttccggttgcaggcgggaagctccgaggctggatggatggaggaggccaccatcatggctgcggggagaaaggaacaaagacaacatggcgcaaggccaaaacggcaagaggaagttgggactggtttcaaaaggaattgaagtcaaaaaagaggaggaataagacgagtttaaatcagtgtggcaaatgctaaataaatgttttctaaatggtgggaaactgtaaattaagctttgacagcagcatgtcctgaaagtttcaaaaaaaaaaaatgtcatatgattagttatcccactatggatcgaagatgttgcttgagagtatgacaaggagaaggcccttgaagaattgagacaagattgactgtgcaacgcagcagtctgcactgcagttataacacttgctttgaaaggagatacgcagggtgcttcggatcttgttcgcaacaatggttggtggaggactggaggcacctaaatattctcagctataattattattattttactttgatcaagactaaacttccagtgctaactgttgtcagcacacctactacaaatactggcgagcctgctgagttttcttgaagcagaggagtgtaggtaattggtgcatgttgctatctagaatggtatgagattgggaaaaagtcaagaaaagcgactgcaacggaaataggaaaacagatgtaatcctcttatctccttgatacacagagacggtgcctccatttttctctttttgcacaggtacctttgtggtctgttctgtgttattcatttttcggagttcaaattgcagcgatgttttgctactgcactattaaactttttttctgacatgtcacttgtttatgtattagttgcattgtaaacagatatactggctatattttccttctgctaatgtttgttttgacttgtccatatctttcaggatcctcctttagttttctatcatcatcctctattcaaaccccagtggtatcatcaattgtattttttttatttcgtggactaagctttcttgatgtaagatttcgtcaaagtactcacctaaccaccgatgtttacattaggtacatgcaacctgccatcttcatgacttcatttctcagctgccaaagagtcgctagcatgacctttcacccatacatatgagctacttctcttgcatatttgtttctttgtgttcccttgtcgagagcttgtcaaatttctgcagatctgtttttgagcaagatttacacataggtatgtctacaagttctggacaagccatggtgagtgtttcgacgggagtgatgaactgccttcttgccaagcttgccaccctgattgatgaagagcatgttaagttcagcaacattcctaaggaggtgggcttcctcagggatgagctcaggaccatgaaagctttcctggagatacttgcagacaaagacaacctcgatccactcacaaaagagtggatgaactaagtaagagagatggcttatgagattgaggactggattgatgaggccatgcatcatctcactaaggacgacagcaattctgggttcatttcgaagatcatttttcgtctcaacaggatgagaacacaaaatcgcatggccaatcaaataaatgaggtgaaaacacgtgtggtggagatgagccatcggcacaaaaggtataagcttgatgcaagtatctctacatctgactatacagccattgatcctcgcctctgtgcgctatatgcggatgcagaggcccttgtgggtatggatggtccaagggatgagattaccaaatggtttatgggtgcagatcaacagttgatggtggtgtctgttttgggaattggtggtctaggcaagacagcacttgctaacgaagtgtacaaaaagattggagggcaatttgattgtcatgcatttatctccatctctcagaaaccagatatagtaaggatcctcagtaatatactctcacaactgggcaaggagacatttactccatcttgtgagatacatggtgttctcaataatctgcgggagaatctacaagacaaaagataccttttcttcttcttcttcttttttttttttgtttctgcaatgtaatgtctcatggatggttatatattggtcatgagtaatctacaacttatctcctcttaaaaacttaattggaacagttctgctctgtccaaaatgttcatagcaatgaactgagaatgagtctttcctttgtgctatttgctctgtttttaaggagagtgtagtccttacttactcttagtctaatttgcttattttatatgctgcatgtgaaacatttgcaggtatttgatcataattgatgatttatgggacaaatctgcatgggacatttttagatgtgccctccccaaaataatcatgctagcagagtgataacaacaacacggattgaaaaggtggctatggaatgttgcagctatcgctgtgaatttatttataagatgaaaccactgaatgaacatgattcaagaagactattttttaatagaatatttggctcggagaatgcctgtccagaacgatttaagggagtttcaactggaattttacaaagatgcggtggtctgccacttgcaattgttagtgtctctagcctgttagctaatccagcaacctctgtagatagacaatgggagtacgtaagcaattctttgagtgataagtttggaataatgcctgcattggatggaatgagaaacattttacatcttagttacaaaaaccttccttatcatctcaagacatgttttctttatcttggcatttatccagaggactacataataaggaaaagtgatgtggtcaggcaatggataactgaaggttttgttcataaagcccaggtacaagatgcagaagatgttgcaggtagctacttcaacgagctagtcaacaggagcatgattctacccacagacatagactatcagaataatgtagtatcctgtaagctacatgatatgatgcttgatcttatcttgtatgaggcagcagaagagagattttttacagtaacagataatttcagtacattgctgggcctgcacaatagtgtccatcggctctccctccaatatgacaacggaaaccatgacaccgcagcagcaactactagtctaacatatcttcggtcgcttgcaatctttggaaattctaaatacatgcacatgcatcatctttcagactttaagtttctccgagttttaattacagtgttttcagatgctgtccaccagatgagtttggacctaacaggaattcgtcagttgtttcaacttagatatgtgaagattgaagccaatattcatgtgcagatacaattgcctgctcaaattcaggagctaaaacttttggaatccattgatatagaatggggatcagtttgcattccaccagatattgttcatctgcctcacttgattcatcttgttatcccagaaggaacaggattgcctgatgggatcggaaacttgaaatctctgatcactctgcgttcttttgatctgggggagaactcgttacataatatcagaagtatcagagagctgactaatctgaaagatctcaatctctgttactctggaaaaaatgtagtatctaatatggagacatggattgatgttttgcgttcttcccttgaaaagctttccaacctcaaatatctacatttatattggcctggtacttgtgaaaatggcctatgttctttgaaccctccatcccgccatcttcagagactggagatggcgtactggtggttttccaaagttcctaagtggattggagggctccatgagcttcacgtcttgaaacttgcagtgaaggaggtgtcagatgatgatatcactcttcttgcacaactgccttccctgacaaaccttggattgcgcatgcgaggagcacctaagcagaagataattatctataagaaggcattcccagttctcagatacttcaaattctggtgtagcacaccctgcctggtctttgaggcctccgtgatgagcgaagagctgcggaattagcgctacaaaatgccattgatatgcatcctggtcgtcctagtgttaaggtcgtcagttgcccgcatacacagttccattctgacatttccgattaggaggaagtggacagggataacatatgccatctgaacaaaacctagtaaacgtcgctacttgataccatacttgtagtagtaactgtatgcagaaatttttttattaatgtgaaatacaacagaaaatcgcagagcaaacatgatcatctgctaacagcattttgagtactttgatggtaaacaaaccccactgtttggatgtgctgctaggctgctagctagctatcgaatggccttatactattgctatttagtggccctgaaatcgatgtaatcaccttctgtcttcaggcaccacacatttcactacctgttctcaggaaacacatcctccctctgtctctaaatataagtgattttagtaggatatgacacatcataatacaatgaatctggatatgcttctgaccagattcgttcgctgtactaggatatgtcacatcacactaaaatcttttataactaaaatcccttatatttagggacggagagagtatatatctgccgcatctgtagctgcagagctgttgacttgtttttgcactctgagaagatgaactatgtgatgtcatggaacttcctgaaattatcatacatcgaggattcctctgctgcaggttgctgtgagagcaactgcagcatgtccggaacttggcaagtgaaaaataaggttcgccaggcccatttgtggacaaaagtgatttcctgctaatactattccaggactatatttgctattgtttgtgtgtaccgtggtttctgttgtttatttgatcacttgagaaggctaaccctaactaatctcttcaatcctgcatacaaaattgattttttttccccttttcgcacgcaccgtacgtgttgagcagtatacccataaaaatggcacaaaacatgatgattgatgaaatcctgtatgtatgatatgatatgatatgacgaaacacgaaactgcgatcgagtgattgatattgcacgttttgcttgatcttgatcaacatggaaatggatcggtctgatgaactcacgttgtaactcctcactattgagttgaacatggacgaaattaatatggtgatggatcagcgatgggtttataacttcacctatcaaaactaaaatattgacgtccacgaatatcatgcacaaggggtatgctttcaatctgaattttatggggttaagaactgccgctgatcctcgtatcttgaatcatatattagggacacacttgcggatatcctccgtgagaatgtgtgcatgcgtctttggggttaaaagggaaaatgacaagggtatacctaagcaagaagaacctataattttgtagttgtgttccatccaatatgggaaggaaaaatgggaccgatggcaagcatgcacaaaaggaaaagcgaagttaaagggcaagctaaagatggaacgtgtggttgggacgaagcagtgggggatccagtccctcttccccctctcgccgctctcctctatttatagcttacatatgcgcgcctcacaacccgcgacgaacaccgaggagccagcaagagacaaacctgaccaaatccaccctagctacaaattttcttggccgcgcgcggcaggcagatcgagcaggcgagcgaagatgtcgtggcagacgtacgtcgacgagcacctgatgtgcgagatcgagggccaccacctcacctccgccgccatcgtcggccacgacggcaccgtctgggcacagagcgccgccttccctcaggtaacaaaaccaccaattcctcgatcgccgccggccgctgttgttcttgttcttgcgtgatcgatcaccggccaccgttgtgaattcgtctgtgcctgtgcagttcaaaccggaggagatgaccaacatcatgaaggacttcgacgagccggggttcctcgccccgaccggactgtttcttggaccaaccaagtacatggtcatccaaggtgaacctggcgctgtcattcgtggcaagaaggtacttatcgtatctgatttctaaccatgatgggtccgcagtttctcattgtctctaacctttgattgattaaatttgcagcttcttctcatatgtaagccatgggttcttgttgcaatgtttggtttggcagggatcaggaggcatcacagtgaagaagaccgggcaggcgctggtggtcggcatctacgacgagcccatgaccccggggcagtgcaacatggtggttgagaggctcggtgactacctcgtagagcagggcctgtagatcgatcgatcacatccattgtcgcgcaccgttcccaaatttcaccaacaaattaactcagccaaacgagtcacattactagatccatatgcaatttttctagccaccaccgcgcatgcatgggattaattgtggtttaatttttttttctcatcttcccctgtcaacaccacacattgcagatcacttcctgcagtgccatagtccctctcgtttcttcgtgtcgtttcggctaataattgtgtgtttttttttcttttttgccggtttggtcatttcggctgccgtttgagttgtgaatctggaacaacatatatgtgattgccattgtttcattgcaatacaaagaagacagtatatacattcatccggtctgttggaaaaaaaaacaacgaaaactatatatagttatttcttcagtttttgtttctaattgtatatgcatcactcataagtatataataactaaattaaagctagttttctttgcataaatggggcaaactaaatttgagtaagcatcagattgttttggttcttagagcatctcaagagagactaaaaaagtagcctccaaaaaccaaggattgttacaatccataaaaaaatggggcccaaaacctttaccatctttgcgccctagatgaagaggactagcggcgccctagatgagaagacaagttgatgacggcatgagcgcaatgctgtttggaggtaccaaaaataagagccaggccgacaatggcggaagaggaaaaaaatggtatatgggtggccgaaatgatatgtgattactatgaatgggggcatatcgaggtgccgaaaaagctagatcagattggcaccatttttaggattgggtaaatattgagatgatatttgggtatatctgttcgagacttttttctttttattaaattcctgaaatttacctttagggaacctgtttgggcctctcttgtagatgctccaagagcatatcaccaagagattggctaaattcccccctccccccaaaaaaaataaatctgattttaggaatcctaaatgaaatttgatatctgaaaatagctatccctcgaagagaccggctaaaattgactcccaaaaaccaagaagcggacccatgcaaaacaaccattatataaatcagtttattcctcctcccatgtgacgattgccgacaatgcaagagatgacaagacggtgagcaaagcaaacgcattgtaggctccaagcttgcataaccagacaaacaagtcaatgccttctgacctagctaggccatctcttcatatcattctcggctgataaatgaagaaagaaaaagtcagagcccagagggatcaaggaggtaggagatgtggtcgctggaggattgggacctagaggtggtcgctgttggcagcgatgcggtggaggggacatagatgccaacggtggggttgatctgatggtgacgacagtgggtggtgggttccaagtagcaacaagacggaataattccaggagtggtgttcctcggtaggtggcaaggagggcctgttcctcccggcagcggagcggaggcctgggacaagcacaatcacagcctaggcggcagtgtttatcaagagaagacaaggcggaggaggcgtggggccaagttgtcgacggcgacctgtgaggtaagtctcccgtgtgcgacgatggtgaggatgccaagaaggcttaggtggagaagtgagccgtggagccacatgtggccaaggatgaccttcccaatagcgacattggagatccggtggaggggagttggggaggctggcagtggagacgatttgcgtgggctagctagcatgaggttcgggaaggagacgtcacccaggtctgcatgagtctaatggatgtgggaaagagggtcgacgcggagggatgaggcccctggcccggtggtaggcagatggtaaagatccagatggagggtgatggatctgaccaggtcgaggtagcagtgttggttagtgacgaatcgacatgtgtggaggttgaagaggacagtgatgaagcttgcagttgcaccgattgattttctgactttctgcgggaagatgaagccaatgtcagggcacatcgagctaccggcagctaaggttgccaagaattgccggacgggaaaattttgctcctcatgtaggaacaagctgagaagaccgagagcgcaagattgggagtggaagaggagcccttgcttggcctcatatgttgagagcgaagactataggataggaactccaaaagttaaggagcagagtagagaatctctcggagcagcttttaaattaaaatcctaaaatatcagtattggaaatggaataggggtactggtgatgctcttatgcatgtctagtcattgttcaggtggtttttatattttgtttccaggacctcggtctgactagagaaaactgaaccacactctaggacagggctttttattatggttaaaccttgtggctttctcggaagcactgaaaactaggatggtcttagtaatcgagtagttaaaccatatggtttttctcgaaccacctaaaaacttgggtggtccacccagttaggtgtgacgagggagttgaacactacacgttgtgttgcaatttataaaattattatttttttactggtgatttgatctgtgaaccgttggtggttaactactaatttcaccgttttaatcactataatgacgcaagatgttgatagaggatgttaattcctttcaagtatgtttgttggggccaatacttgtagtcctctcttttcgatttgtttggacacaacagtgtgttggagggatgaacacccttcatggtccatattactatattggcccaagaacaaagccgtgtaaactggttctgggtgttttagaggatgtggaaatgagacggtgtgtgatgttgcttgtttggaggagatcaaagagagaacgatgtcatacgtgtctcacaatgtattatcactacaccagaccgggtgactggtgatgggtccaaaccatcatctcttatagttatgaccctcatcagagatgagtgatcagtgataattctatctcatctctgaaaggtgaagacccgtgagaggtggtcatcacctatgacgggccgtataaaggacccatcagaggtgagtctgaccaccctgacctagtggtattgccacccgtcaagttgattcatttgtgatgggttggttttgacacctgccacaggtcagggtaatcggaaattggtggagtcaataccgctcatcactattgtaattcactggtgaaaaaaaaatcatctgcccttcctagtgaccaactggtggcatcactcacaaaaaatcacatgaaaaattatagtggatatcaatcatcccaatcacacattcacattgcatggactcatcactcacaagtaccaggaaacacaaaaaatcacaagaatcagtggatctcaatcatcacaattactgcttgaatttcttgacaaagagatagtcacagttggaggagacgactgcagcgaggttgatagacaagctgagggaggacagcggtgacatcgtcgacgagctgctggtgacgctgattcatggttgactgcacatggttgcaggcgtgcagtcagttccgcccttacatcctccgcatatactactgtacgtaataacatgttaaaaatcaacacacatatgtgttgatttttaacatgttatggtgattcaacaacataatgggcctttttgtgtgtggggggggattctgagaagcagctggttggtagccagcttctgataatctggaaaagctgggtttcctaccttctggcgtctagttcattttttgaattctacaactacaacttatcataatctggaccaaaagcttgactatttgggggaacttctggttctggcagaagctgcagcaactagaagttccccgaacaggcccaatatgctcattcaaaagttgtgataaggatataagtgacgcatggcacaactcctctttatcacttggagcatcaagcaaattgtcctgtgacaaaggtatttcatcaattatgttataactaccggacatatttaacacatcaaaattgttcataccttgaataagtatagcacatttgtcaatacctttgttctcggtagttgtgggtgtggtatcaattaaaccttattgaaatatgcatgaagcaataggtatttctttttccttattaacttggaggttcttaagtacatgcaaaatgttagtatcgaacaagaggtacaacaaagggtcactcctccaacacattcacatcatcttagcaagtagttatatctatttgaataacaatttgttttcttagtattatcaggcaatgtatcatgtgaaaatgaaactaaactatgtcaccatattaatactaatccaattaatgtactagtcacattcctaattttctattttttcatagacgtggcactatgcaaaaatttgatcatttcttttcccaatcaatgtttccatccttgcaaattttcatcattaccaactccattataataatgaatggaagaaaggatatagctagacctcaacgcagtagatgcgcagtggtacaactctcatctaacttcttcatatcatgcccataagtggtctaacctgccatagttagtagaagacaaaagataattcaaaaatattatcccttatcagctactatattggaaataaagtcacactctctcaagcattttaccatgctcttacaagtgttcttacttacagaacaagagatgtaattggtggctaactgaggcactgtaggatgtgtagtgtgaaaattgctagaggatgtcaatcctgatcaagagtatgcttagcttgaaaggcatatataatagcaaggatgtgctaaatttaataatagagtagcaaagttgaataagtatactatatacttcacaatcactagcagagacacgtccctaaaactagtataagcaagcaagagtaatgaaaaaaggaacttaggatgctactctctcacgaagtctctcaagatgaaacaagaatggcacaaagacttccccttttttctcctttttttatcctctttttgtccctttctttcttctttttttttcttttcttctttctttctttttcttctttgtttttttgattgacacctttctttagttataatagcaaatacttcaaaacaagaaagacccaaagtggattcacaaaagaatcaaagatgatgaaaggccttaaaacaagaaagacccaaagtggattcagaaaagaatgaaagatgatgaaaggccagcaaaaaatgaattctggaacttgtaagggccaaaacaccttgcaaagcaaccttgttgcttcggctagggcaaacatttgatttcacaatctcgaatagcttacgaggaattttgatgtgatacgaaaaccatctgaaagcatacgatcataatcttttgaaaaagtactcatgggtcccaagcaaccatatgcatcaatggctaggtccgtttcatgttgatactgttaggaggaccaaatccgaccgaaacatgttgaatcatatatcttggcttatatagctcaatagttacgttatataaatggagaagacttgggagagtgttggtatttcttaacgacattactagaaatataattcccagcaatgacgcagaaatacttctggtatattatggttatggagttcatccgcaagcgcacggatataccattgtagcatttcacccgagagtattccaagggtatcatatttattttatcccgtgggaagaccatgtagagagaacttaaataataatttatatattacttgtgataatcatattctaagcaggggttaagataatccaagggtagagtgacacacaagcattaactactcattctcataatatattatctaagctaagtggaaagaaaagagaaagataatctattcctatacttctaatatacatagtatacatacattctagttaaccgatatactagctaataccctctttccgatgccctcctggtacttcgagaaaccacccctgactgccgagttccttacgacagcccgtcatgaccatataaccggggctaaatacggaggaataccctccccaaggaattaacttaggattatataccggcgtggaggaatacccgtactgagctgtcaccatcagcggcccacctctcatccgtaatatataaccccaaataatgatatcccgtaatctggacaccacgtctaaactaccagatactactctaatatcatcgtcatgacatagagtaattgcatatgcaaacattatacctgcaccaaagcatctcccagataagctagccgtatattcagtataacatgaacataatgtaaagtaggtactcatatactcgggaagtatttcaataccataaatgtatttagaagaatattctaataaaagtacacagcttataaaagagaagagaaaagctactagagccatacctgaactcttccgaaggcttccggactcctgatttctactatattcctattccaccagctagatactactaaactaaacttgagagaaatgagagagctattgcttgaggtgtgagagtgaagtgagaatgagagctccttttatagcctcccaatgacggttgtgacggttggaatggtcggtaataccctccaaccgtcattggggagccatctcagccgtccaggagaaccctggatcaaacggagctgcggaggttcggccgaaccatgggctaggctaacctggcccaatttcgacaggcagcctcctcttttgttctcatacgcagacttgtgaattttggcccaattcattgtgtcaattctgagttcttggcccattcatacataagtctgattctcgacatcgtccgattgatttatcgtctgagctgatgtcgattctcctccactttattgttattctctgcaaaaggttaatatacctaatagtagtggaatattattattttaacagatatatgcattgcaagcatcactagttctcctctattttagtaatattgatggtcgaaactgatcgataacggccgtcaacagagaggttatggtttggtcctcaattaacttcgtttatcatccatgcattccatgagcctattcttgcatcatcccttgtttaaatatatagtaaataaatcttacatagagaatatgtacctttaatttattaatgtgtaatatagccttggtcatatcatagctagtgatgtactcgtcattggtatgattgttagggtgactatttaatagctatggaaaagtctaatttgccttggggatggtaggaacgttgtaattttttttattatattgttcgaagtactagccaaatagccatgtgtttcaacagattcttgaaaatagcaaaactaagtgtttgttaaaaaaatgtattttaattggttgaaacaagacttttcatattaaaaacaaactaaatgccatgtttagaaaattaaagagctgtagtctacatagtacggactgtagactcacctgaaccctaatgtcagtgatggtattggtggtgacagattcatcacccccactacttttttgtagtatagattagatattgtactcataagtttgtaatgttaggtagtattcatgactaagtagcatattaattgtgacttctacagcatatgtttaacttacatattcaatattgtactcataagtttgtaatgttaggtagtattcatgactaagtagcatattaattgtgacttctacagcatatgtttaacttgcatattcaatatatactagaaaatcagtgtgccggctggcatgtcgacaaattgaccgcatatatggctatatattaatttgcacaaaattcgtattataagattagagattgactgcatatatggaaattttacgtggagatgagtgaagacgtgcaccaacgattaatttacacataatttgtgttataatattattaaaggttgaccgcatatatggctggttgtggtaaatctggattctttctgatttctctagaatcgtccagtgatatttcatattttgcacggcctgttaattttgcagttgtccatgggcccatttattttttttagcaaaagtcacaccaacgcaagcgcgaggcaggagctttttccagtgaaaccagttgagccacgtggcacgagcagctgcgagagtttttgcacaaatttcgatattagagattcgttgtaaaagtatcacgtagcaatgttttttaaaaaaatgtcatacatagactgcacaaaattaaactttatgttcattgcatacataaggataaaatggactttttcagtatcttttaaatataatggtcaactgacagaatgggcagaagacatcaaaattaaaaattaaagggtaatactaattttagcaaaattagcataaaaacataagggattttagcggcgtcaaaggaattttctcatgttaattacatttgttgttacatttccaaactccaatggaaatcgaaatgaccacgtcagaaagaaatacaaaaagttattagccaaaaacggcatgaagaaatgggatcaaacaaaatatggcagaacgtacaagaggtgatccagaacatgcttgcggaggtggacaaggaaagaggagaggaaaattaaaccacaatccccatgcatgcatgcacggtggctagaaaaatgcatagcatagagatctactatgtgctgtgtgtgtctctcattcgtctccgtttaatttgttgctgacgaattgaactgtggcaacgacgacgatgatggcgacggtgatctacaggccctgctctacgaggtagtcgccgagcctctcgaccaccatgttgcactgccctggggtcatcggctcgtcgtagatgccgaccaccagcgcctgcccggtcttcttcaccgtgatgcctcctgatccctgcaaatccaaccattgcaacaagaacccatggtttacatatgacaagaaattgcaaaatcaatcaaggttagagataatgagaaacagcaaaccatggttagaaatcagatacgatgcgtaccttcttgccacgaatgacagcgccaggttcaccttggatgaccatgtacttggttggtccaagaaacagtccggtcggggcgaggaaccccggctcgtcgaagtccttcatgatgttggtcatctcctccggtttgaactgcacaggcacagacgaattcacaacgatggccggtgatcgatcacgcaagaacaagaacaacagaggccggcggcgatcaaggaattggtggttttgttacctgcgggaaggcggcgctctgtgcccagacggtgccgtcgtggccgacgatggcggcggaggtgaggtggtggccctcgatctcgcacatcaggtgctcgtcgacgtacgtctgccacgacatcttcgccgccgcctcctgctgcccaacgaacgactcgtcctcctctcctgcggctgcaaagatacgggctcgatcaggtggtttctttctcctcgtcgggtgttcgtcgcggtggtgaggcgcatggtgggtggatggtttgattaaatagaggagagtggtgaggaggtggagggagtggttccccgctacttcgtcccaaccacacgttccttctttcgcttgcccttcaacttcgcctcctttgttgggctgctcgcaatagctaatggtcgtcccaattttccttctgcccctggattgttggcccagactagagatcaatagatctagtatctctgtgaatataatagtaatatttagctatgtatttggacatacttcaaagtttctatttttttagaacagaggtagtagttttttgtttcggtaaatctaattggagaggcctctccaattagtattaaccagagacacccacgtgctagtactttaggagttttggttgctattaatctattgaacaagtacggaaaatattcctatcatctatgcttcaaaaaaaaatttctcttaaattactcatccgatttagaatccgattacaccgttgtgttcgtaataattaaatctttacaacaagatctcacatgattatattttgatgaaaaatcacaaattacttttatgatatgtctaaattacttttagatttcactaagttacttcttagacatataaaagtaaattcagtaaaggctaaaagtaatttacatatattatagaagtaacttataacaaaaagaaagtaactttaattaatgttttttttcattgaacaaattatcatatatatatatatatatatatatatatatatatatatataagttacttttagatttgataaaaatacatcctatacattcataatgctctgaggtgattacttttattattattttagttaatttcataatttgtgctgattaatttaatttctagatagagtcatgttcttatctccacaacggatttacttcaaatgacatgctaaagttaccttcgttttgttctaagttacttctataatatatataaattacttataggttttattgaatttacttttatatatctaagaagtaacttagtgaaatctaaaagtaatttagacatatcataaaagtaatttgtgatttttcatcaaaatataatcatgtgagatcttgttgtaaagatttaattgttacgaacacaacggtgtaatcggatcgtagatcggatgagtagtttaagagaaaaatgtatttgaagtataagtggatgatgcctcttatagatgaagtggtagctagtttagacaaactagctaccactagctgtgtagttacgtcctttttgtttatatgctttgtaagagctctcatatcacttccacccatggttttcaatttctattcggaactgtggaaattttagtaattttgcaccccacaagcaaccaaatttctcacccaaaatttcctcttttttccaaatttagttaaaatttattcgaattcagtcaaaattgttaaattttcaagtaatttcgggaaaaaagtttcaaaattcccaaaattattggaaatttcggtgcaaccgaaatttccggtgccgaaattgaaaaccctgctttcacctcatgttcttctcttttctttcacttcctaagtgttttttttattttgatttgccaaatatggtgccatgtcattgaatagcagtcttgttcaagaccaggaatgaaatgtgaatggtactgaaagttgatagaacaatagtcactactggttttatatatagttgaggggaaaatcagaccaaatgtgcgcctttttcttgtagcatcaaaatgtatctattttattattacaatctgtgtttattcagtttttggtgcaagaatattatgaattatgtacaacaagtccatgcatgatatctctttatacaatcaatgaatacatgaatggtcactgctcggtatgcaatcctgcgtgtataaatcacaactaggtagtagtagggtagcaatgatcaaggcatcttgatatataggcgactcaatttgatcaagaggaggatgccaagagattcttgaaccactgcactgaattctttgggtatctcttccggttcttgtagtctacgtagtataatccgaatctcgaggtgtatccagcggcccactcccagttgtcaagaagagaccatgcaaaatacccgcgaacatcacaaccatcctccctgcataataaagttattagagtgtcaaccataacagggaaaattagtcctcgactcataaccgaaagttcaattgtgtcattgtttaagcaccttatggagtctgctaagtttgtaagatagtcattgtggtatttggtcctcttgtcgtccttgagggcattcttcagagagatgaaggggctgttgccatcatccattcctgaggcaaaagaagggaatctattatattacttgagtttttgttcttgcgaggaaacttcaatgaaaattttattcgaaagattatactttgttatgttaaacttgaagcaatttttatgtttgacattttttattactgtagtatttgttttaagcatacaggaacaaatcacaaataacgtaagtacacttgccattctctgttatgtagacagttggtttgttgtatctgtccttgacatagttcatcaagatcctcatgctacgaggcacgatgtacaaccatatcgagttggcctgcatggcgaatcaacagtcatatgctcagtcagttcagaaaccaagttcagttttacaaatcaaggttttcaaatcttgcagtaaattaacaacaaaagaaaaaaatattaatgtcaattttattttcacatgagaaggatgtaatgttgcagaattaattaccctatccccaattggctgtccatttctgaaggctgaaaaatgcaggcatgagaaatgaattagtcatgagctagctaatttttcaaatttaatcatccaaacttgcaaaaagaacacaatgggcgactagttttctcatagcacaagcaatctgagaagtagttagcccagttgtgtgctttgtgctttttatcatttagttctcttattattcagaaaacagtgtgaatgaaaagtggaacttacggacactgatggttgcagtatctgccaaggtgttgttcagcaatttttctattacagtagattggtcatcctttgtgtagaatgtggtatagtgattgatccccatgaagtccagtgatccgttcacaagtgcagcctctttctccgtgaacttcggtagcctgcttcccactctcgatctcatcgttgccggataatctccgaagaagaagggatccgcaaaccttccataccaaattgagcatttcatcaatggtggttctatcaaaattcagtacagggttgagtacaaaggaaaaactacagtagttacagaacagagtgcaatggttctgtccattttgtcacagtagtggtactgaatgtctcacagctgtggaatttgcaagaaaatatgaagcttgtgagttgtgaaccttaccatcctagctggaattcctgtgctctcttggcggcttcaatgtcagctgtggaatttgacattggttcgtaccatataacatcaaaagatatccccagctccccattctgacttgcctgaaaaacatgaaagctaggcctttgcatcattgtgttacctaattacgtactgaacactgaaaatgatctatggacaaatcttcatgcaggattgacttgagaaagcattgcaatatcaaagcagcacatacatatgcttacagttacagaagcctgaactatatgcagaagaattgttcacctaccttgtatttcttcctgtatatgtctgaaaccgtggcatgtgagaggatcatgttatgagcaactatgtagggctcggtgcctgaattccctttcttgcagtagaggtgcaggagcaccgagcaccggcccggtgcatgcatcccgctgtcataggcctgcaccgcgacggtgtggggctcgttgaaggtgatccagtgcttcaccctgtccccaaatgcctggaagcacgtctcagcatataccgcataatcattgctgcaacaagatcatggtacttctgttacagatcgaatagccattgtaactgcatgagaagtttgcaatgcttacatgatctgcctgtcaagccacccagtgtacttgtcctccaaagcttgtggaaggtcccagtgatagagcgttacatatggttcaattcctaggggagatgttcaacttgtcagtaaaatttaagaaaactttagattcagtagtgaattaaacctatgttttaataagtagttagctcaaacatttcaatttgtaggttttggggagtcaattttagtgtccacctttagctagtaatgcgttgattagcttgttgtagtgatcaatgcctgcctggttgacctcaccagtgccatctgaataagagtgcagatatgattattgttagtagtgcaggtctgtttatccacagataaaacatttcataatgaagaaaaacttcaaaggttatgtgtgaccattaagttaacataaagatgcaaattaatgaagagatccaagtggaaatacccatattaaccaatgaattattatattacatacttgggaaaatcctagaccatgaaattgagaatctatatgcatccatccccatgtctgccataagctgaatatcttcctgaaatattgatatgacaagcacagtaatctcaaaatttgaactcgatcaaaaaaaatagatagatatactttcactttctgtgttagagtgtagtgtccaattgtctacctcgaaacggtggtactgatccactgcaacatcagcattgctgaagtcaatgatctttcctgaaaataagtaaggcaaatatttgcttataatattgaaccatgggtgattaattttcatgatcaaaggtcaactcttaatgatttctttgttattccatatgttcgaccaagtcaatagtcaaagctatttactatatggtttcacacatgcccagaatgtacgaatcaggaacactgagattaagtgtaatgacaaagaaaaatatctaatctgtggtagcataattgcatacaggttttgaatatctgacctataaattatacaacatgagagtcgagagatgcttgttccatacgtgaagcaggcataactattgatagtaacagtagtactaagatagtagaagaaacaaggtaaggcaaggatagccagatatatatcaagaatccataggcatcttgagtcgtataccactacatatattacgtatgtttctcgaccagaattacaaacctaaaaatataattactgaatctttatcctgcttgacttggccctgaggaaactagagatgattaaatactgattacagtgattgggaaaaaagataccaaatgtatgtgcgaatttgtcccaaatggttggcccccttccgtcctccttgacagcaccttcatactgcaggaaaaatagataaatatgaaacaaatattttttttgcgtgaatatgaaacaaatattaatcatcttaatagtcaaattgaaacgtggatattactgaattcaactgttttacttatttatgatcagtactttgtgtagccaaaataagcattctagcgagcggtgccaatcgattggtgtaatagatatacacttgaa

SEQ ID NO: 15796 - DNA, 1053 bp, Oryza sativa
attcatcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcatagctcgatacccggaactctagctctgcaatcttcgcctcggtatctctcttgctcctcatccgactcctgtacgtgtggatgtcctccttgaaaccaatcttccaaggaatcacccctttcccccgtgttcatcctggatgctctggagtctgcagggcgagtgtcagctcgtctctatctctgtctggtcggaacgtgccctgagaggaggcttccactgcatctgttagtcgtcgtgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatatatcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgatgtacatagttcttggcggcttcggccggggcactaggacgtccatctt

SEQ ID NO: 15797 - DNA, 16419 bp, Oryza sativa
ggttctaatggtaatgttggatcaataccaccgctccggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagaatcaccgtgattagtctcaccctagtgtaatctgttgaacttggatagtttaggtggatggttgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagttcgagtcaaggcttagctccagtttcttttgttttccgctgcatttctgtaagacttttatgatgtttgtaagacgtggatctgaatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatcctttttcattgcatatgttctttgcaattggatttgttccgggaaaattgggatctgctcttgtggttcaagggaaaaatcttgtcgcttgtttaagtgggatttttccaaaacaagtcagtttagggttttagtaaaattattgggatttattcgtcagtcagttggggtttgatgggtgaaatgcattaggtcctagctctataacatgggttgcaaggtgtttatgcttcgtttgttattattaatatgtatctaatttcccattattttatcgttatgtgagtccgtcttatttattcgctctcatgcaaaatgatctatgcataaaatttcgcttttattcgattcccttatttgagtcctttattgctttacttaaatttggatttgagcatgcattgatcctactcctttgtcttctctagatggccggtcacccacccaaccaccgcggagaaggcatgatcgattttgtggcagagctggcacgcatgacactggtggtgggctaccccaacgcgccggagtacacgaccattccgccgctcagtggcgagcttcctcaccgtgtccgcttggaggtccatggctacgtggggacttgcctcgctaacatggcggttgaggcgtcaggaggcacagcagatcatgcctgtcaggaggcagcctacttgatgatggccaggttacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaggagaatgctcagttgaagggtcttccagtaccaggaggagtccggatccgcactacgccccgtaagaggacgactgcacccgtgcgcatccagcttgcgcccaggaacccacctccaccagcagctcccgcagcacctccagttccgcccgcagctccggcagttcccgcagttcctccagctccagctccagctccagctcccgcgttcactctctccttcgctccagcatcagccgccagaggtccagccagtggtaccggaggttggctgtctgctactcccagtggcagcggcgagactgatccgtcaggctccaggagtcgctcagagggaccgggtgacgagcaggaggacgctttcgactccaccgaccgcaggagccgttccgagcattaggctcgtttttcccactagtttatcgatggtctagcttctggttgttagtttgtgtgtttaggttgcttgtttggggtcagttgacggtcgatatcatgtgcctatgatatggctgtcttaataaggatgtttgcttgctcttttaagtgtttttaattcagatcagaacaattgcagttttaattcctttataataaagcttagttcttgagcatctgtttttcttcttttccccgtctgctcttccctccagatggtctacaccaggactggcaaccgcacgacaggcgagggcagcaacggtgaagaacgcgctgatggtgtgcaccccaacggtgattctggcaatggtccgccaccacttcccgagaatccgacccttgcccaagttatggcacatcagactcagatgatggcagccatgatgcagcagatgcagcagcagcaccagcagatgcaccagaggatgatgcagcacgccgaacagcagcaccagcagtttggtccccctccccctcagtccaagttgccagagtttctacgcgtcaggccacccaccttctccagcaccaccaaccccatggaggcgaacgactggctccatgcaatagagaagaagctgaatctcctgcagtgcaatgatcaggagaaggtcgctttcgccacacaccagcttcagggtcctgcgtcagcttggtgggacaaccacatggccacccgcccaccgggtactgaagtcacatgggcagagttctgccgtagcttcaggaaggcacaggtgccagatggggtcgtggcacaaaagaagagggaattccgtgcgctccatcagggcaacaggactgtgacagagtacctccatgagttcaatcgcctcgcgcgatatgcaccagaggatgtccgcaccgacgccgagaagcaggagaagttcatggcgggtctggatgatgagctgaccaaccaactgatatctggggactacgccgactttgagaggctggttgacaaggcaatccgtcaggaggaccaacgcaacaagatggacaggaaaagaaaggcggcgcagttccggtccaaccaaggtagtcagcaccgaccgcgcttcactcccggacagcagggtggacctaccaccatgatcgtccgccagcaccgcccgttcaaccctagcaacttccatcagggcaccagtggcagccagaaccaccatggaagtcagcccaaccgcggtacagctccacgcccatcagtggcaccggcacaatcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcgtctgcggaggaggcacaagcagcaccagaggtcgtactgggtacgtttcctgttaactcaatccctgcaacagtactttttgattctggtgcaacgcattctttcatctcaaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcattcttctcgaatccaaagacctagatgtcattcttgggatggattggctgaccaagtttaagggagtcatcgactgtgcgagtcgcacagtcaccttgaccaacgagaagggagaaacagtggtgtacaaatctctagtctcaccaaagaaaggggtctcgttgaatcagattgagacggaaatcccagtggataccgtagagaagaacttgagaaaattggaagatatacccatagtctgcgagtatccagaagtgttccccgaagacctcactaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacaaagaggatgtgcgtcgattatcgcgcacttaacgaggtcacaatcaagaataaatatcctttaccgcgaatcgacgatttatttgatcaactgaaaggagctaaagtgttttctaagatagacctgcgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtattcatcgacgacatacttatctactcaaaatccgaggaagaacatgagcaacatctccgtctggtactcgaaaagttgaaggagcaccagctatacgccaagttcagcaagtgtgacttctggttgacggaagtaaaatttctgggtcatgtcattacagctcagggtgtggcagtcgacccatcgaacgtggagtcagttaccaagtggaccccaccgaagacagtgtcgcagattcgaagttttctaggactggctggttattaccgccgattcatcgaaaatttctccagaatcgcccgacccatgactcagttgcttaagaaagacgagaagtttaaatggacagctgagtgcgataagagctttgaggagctcaagaagaaattagtatccgcaccggttttgatcctgcccgaccagatgaaagacttccaagtctattgtgatgcatcccgtcacggacttggatgtgtcctaatgcaagagggcagagtggttgcatatgcctcgcggcagttgcgtccacacgagggaaattatccaactcatgacttggaattggcagcagtggttcatgctttgaagatctggaggcactatctgattggaaaccgctgcgaagtatatacggaccataagagtctgaaatacatcttcacccaaccggacctaaaccttcgacaacgaagatggttggaactaatcaaagactatgacatgagtattcactaccacccgggtaaagccaatgtggtggcagacgcattaagccgaaaaagttactgcactgccctatgcatcgagggcttgtgtgagaaattgcggcaggagtttgagcatctcaacgtgggaattgttgaacacgggttcgtagccgctctggaggcacggcctactctcgtggatcaagtcagagcagctcaagtaaatgattctgagatagcagagctgaaaaagaatatgagagtcggaaaggcccgggatttccacgaagatgagcatggcacaatctggatgggagaaagattgtgtgtacctgacgacaaggaactgaaggatctgatactcaccgaggctcatcagacccagtactccattcacccaggcagcaccaaaatgtaccaagacctcaaggaaaaattttggtgggtcagcatgaggagagaaatagctgaattcgtcgcactctgcgatgtttgccaacgagtgaaagcagagcaccaaagaccagcaggtttactccaacctctccaaatcccggaatggaaatgggaggagattggaatggactttataacaggactgccccggacatcatcgggacatgattcaatctgggtagtcgtggatcgactcactaaggttgctcactttataccagtacataccacctatacgggaaagagattggcagaattgtacctcgcaaggatcatgtgtttgcatggggtacccaagaagatagtatccgaccgaggtagtcagttcacctcaaagttttggcagaaactgcaggaagaaatggggacccgtttaaatttcagcacggcctatcacccgcaaactgatggtcagaccgagcgagtcaatcaaatcttggaggatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgaacgtcaactgttcggaacagaagtattagcggaagcagaagagaaagtcagaatcatcagggaaaggttgaggattgctcagtctcgacagaagagctacgcggataaccgtcgaagggagctcacttttgaggccggagactacgtgtatcttcgtgtcactccgctccggggagtacaccgttttcagacgaaaggcaagttggcaccacgcttcgtgggaccatacaaaatcttggaacgaaggggagaagttgcctatcagctagaacttccatccaatatgatcggcatccatgacgtgttccacgtgtcccaattaaagaagtgtttaagggtacctgaagaacaggctgattcggaacacattgatatccaggaggacctaacctatgtggagaagccggttcgcatacttgatgccagcgaaaggagaaccagaaacaaggttacccggttttgccgagttcagtggagtcatcattcggaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaattgtaaattacaaatgaccccaagaaaatgcagaggaaatcaggataaaaccctaagaaaacaatgcaaacaataatcggatttgacatgtggaatttttcttgaattctacatgtcgaaatgcattaacaggatttttagtggaattttcagagctctagaaataattttaaccaattaaaattgagcaagcaatattgttaattccagggaaaaatcctttttccttttctttttcttttttcctttctttttcctcctttttgtcaaatgggccgtcggcccattttcctttttccttccctcctccttgctgggccggccgcaggccgaggcccagtccggcagcccaggccgccccgctgcctcctctctcggggtcgccgacaggtggggcccacctgtcggacccgtctccctcctcccgccgatcccggcgcgccgccgcgcccgaaaccgccgccgcgcccacgcctccgccttccccgggccacgtcggccacgtccgcgcgtgcgccgcgctctccgcgcccattcccctctctctcccgctcgcgcccgcgcccgagatggccgggattcgaaaaccgaatcccgcctctctctcctccccactcccccacgtcggccggcgaatcccgcctcttccggccacgtccggccctctctccccctatttaagcatcgccggcgccccctctcgctttttccccatttcgccgacctctctcgagctccccatcgtccccgcgccgtgcaaccacccgccgccgccgtttttgctacttcggccgccgctagccgccgctaggctcgccgccgtcttgcgccgtcgccgccgttagattcgcggggtcgagatctacctcggccgcccctcctccgttgaggttcgccgccggagacccatccccgtcgtgcgccggtgagtgacgccatggccgccgccttcggccggcgctctcgctctctcgcgctcttccctctccctctaatccctctccttttgttcgttaggaggctccggagctcgtcccgccgtcgtcatcgttccccgacgcccgccgtcgtcgatcgttgtcggtgagaccctcctcctcgttttctccctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccgtgcccgcgcgccccggccgcgagctcccgccgccgtccgatctacccttgggtagatcggggccgtcggttcggccgccacgtggcgccgccgccccttccacctcccgtgccactgactagtgggcccgcgagccgccacccctttctctctctcccgggtcgctgaccggtgggtcccgcatgtcggcgccgcacccctccgtgctgacgtcagccctggaatttattgcgcaataaagtatttaaggtttttcttttatagtaataaacacagtgaatcttctaaaattcatagctaattcatccgagctccgtttaatcccattcaagtctcagtaaatcaagaaaaatgtgtagaatccattaaaaatggttttgttctctgtttcagtagtcttatagtctgtttgcaatgtttgctttgtatgtcgttagattccgatccctccgacgctccggtgtacttcgagatagtcgccgaggtccctccagcagcagagcaaggcaagtcatgcttgtcacttgatcatattgatcctatattgcaaatgtcctaatgttttctttcaaataccgcatttgttttgcaatattactatgggatggttacctattgttacagccatactattttgataccatgctcctttgttagcttggggttataacatgattagagtttggactaggaattgcttagccatgcttagttcaactagttcacaatggggaaaatcatattaatgattagactgttggttctaatggtaatgttggatcaataccaccgctccggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgttgtcgcgaccgagaaaattgccttttcccgaacgctagtgtattaatccccgtcccaggaaaagccggggtacaccacacaaacatgatataaaagacacatctttattatatcgataacatttacactattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggcagatgcatgattaatgcaagggggtacaaggggtaataatataggggttaagttttgcagaaaagcagcatttaaaagtcacttagttgcccaaagccattttataaagacgatcctaaagctacacagtattattaaacaaggccgtgaaccctcacgaacctgccttaacccaaggcttacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataacccaacaattccatagtgtccaggtgatatgaaaattcccaaagtctaaagttataaaaccacctaatgttgcctaattaatcagcgaagcatctacctaaattcatactagtggaaccatgaacagagtacccactagttggggttttgtttatcctagggtgaacaaggtaataataacaatagcaataataacaaggtcataacaaaggtaaataggcatggctaaataaaacagtgataacgcgggaatttaaataaagcgataatgcattaatttaaattaaaataattttataaactgggattcaatatgctcaaggatgatgtgacttgccttgctcagagagaacggccttccgaaccttcggcgacgaccacgaaccacgctttgggaacctccggaacgacgaaagctacgcgaagcacacaagcaaagctacaagcctataaagaagcaataacaatacataaaaaacaaagcacagggttctttaggttataacaaacattaagagacttgaacgggtcgattcggagctcggatgaccaagatatgatcatccgaagtttaatgctgttatatggagatttgcggattattataattaagctttgcaactataaaacaggtgtaagcgctagcctggaaaagacaggaaggctgcgctgttgacatgcggaccccacatgtcaacaaaaaggaccacggtagaccgagtacacagagacggtccacgggtcaatggaagcggatcccgtgtgtcaaccgaggcgagtggccgacaaacggactccactagacaccacacgggttacacacgtggaaaccacgtggctaccgagcgggcacactaacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaaggcgaggacggggctgcagcggctcgcttgacgaacgcggacgacggacgagaacggctcgacggagggacgaacgccacgacgaccgggaacgacgagaggacgacgacgacgacgaccgggaccggcgaggaggcgacgagaacagccggcagcggctgcacggggacgaggacggcgtggaacacgccgcagcgatgatgatgacggaggcggcgccgcgagacgacgagccgggcgaccgacgggacgtcgatcggcgaggacgaacggtgacgaggaagcgacgatggcagccagcagcggctgcgtggaggaggggacggcgtggaacacgccgctgcgatgttggtgaaggtggtggtgcagcggggcgacaagccgacgaggaggaatgggtggccgaaaggacgccggcgacgaagaggatggagaggccggcgcggcgacggcgttccggcgaaaccgaggagcagccggggtggagggcgacgccgcgacgtcgacgaaggagacggcgacgtcggccgacgctctgacgcggcgatcggggcgactgaaggcggtacagtggcggcaacgccactgttttgccggcgaggacgcgtctccggtgatttccccgcgaaacggaggcgaagccggggaagaggaggcagctgcgacgccgggagaggtgacggcgcagccggacggcgctcgggcgaggagggagaggcggctggaggcagccggcgcgaaggaaagagaagggcgacggcgggaacgtagctccgggggtctccgcgggaaatggagggcaagccgtgggagaggaggcggctgcgaggccgagggaggtggtggcgcggccagccaacgcacaggcaaggagacaggggcggctggaggcggccggcggcacgggagagagaggaaggtgatggggaggtggctaggggcttgggagagagcaaaatggaccaaaggaaggaggagggcttcgttttatagggcaaggacggagtgccggacacgggagaggccgaaaacggcgccggaggaggtggccggcggcatcaatggtggtcaaagaagagggattaaatcccggtgattgggggcgggattaaagggggaaagttgggggaaaggaagaggagattgagaggattccattcccgcaactaatttgaaaaaaggagcaacggggaggcgagatttggaaggaggaggcggcactgtgcacggcacggctggagagctcgggctctgcctgagctggaagaaggagcactgtagcgcgggggaggtaaaacagactttcggccgggctgagaggaagaggggagaaaccttgggccagacttggcccaaagggaggagggggattatttttagctttttctttttaataaactttgatcaaggttgttgttgcttaataaataattcccatgctctgaaaattcaagtaaaatttgagggctccttttagaccaaggagaatttaacaaaaattctccggaccacattcgaatttttcttgtacgtattttagtgtttgccaatttcttttcgaattttaattaattctattattccttttagaaaatgatttttatttcgggatgaatttatcaggacgtgacagtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaactattttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagttcgagtcaaggcttagctccagtttcttttgttttccgctgcatttctgtaagacttttatgatgtttgtaagacgtggatctgaatgtcaacattgtcgtttgtgtaccccggctggtcctggacggggattttaatgcacattctgcttggaattctattcgggaatttctgggcgtgacagcgcgcgtgcgcgggagggctgcggctcggcttgggctggggcaggcccaagcgggaggaggagaggagggagtgggccgggaaggagaggaggagggagaagaggggcggcccgagggagagaggggaggaaaaagagagggaggagagagggactttggccgcgggccgagggagagaggggaagacttttggcccaaaggaaggagagggtttatttttagcttttctttttaataaactttcttaattgttgttgtttcttaataattatttccggtgctctgaaaattcaagtaaaatttgagggctccttttagaccaaggagaatttaacaaaaatcctccggaccacattcgaatttttcttgtatgcattttaaggtttgccaatttctttttgaattttaattaattctattattccttttagagaatgatttttatttcggtatgaatttatcaggacgtgacactagtggtcagcctgtgcagcatactgcaaatcaagttgtcccggagcacttggttcatcacgtacaaccagatggcacagtgattcctcaagttattcctgagcatttggtgcgcaatattcagccggatctacaaaattactaggggagcaatttgaattatcagtatcagccaccatcaccgcatggtcaataccaacaggcaggatcagctcaaccccagtttgttcctcaatacaaccaatttgagcccatgtcacagcagtctcaaggaacgccttagcaacgaccatgggccgatttgattgcggatgtcatgaaggagcaatttgggcttaggccgaaagatgctggaaatttataccgacagtcgtatcctgaatggtttgagagagttcctctccctaaccggttcaaagttctagatttttcaaagttcttaggacaagatagcacatcaacttatgagcatgttagccgatttttagctcagtgtggtgaagcatcggctgtggatgccttgagggttaggttgttccggttgtctttgtctggatcggctttcacttggttttcttctttatcgtatgggtcgattaacagttgggccgatttggagaagcattttcacagctatttctatagtggggtgcatgaaatgaagttgtctgatttgacagcaatcaagcaaagacatgatgagcctgtgcatgaataagtgctacaacttaagttttactaatgctcagttagccgatttggcttttcagggcatgattgctccaatcagggagaaattctcatctgaggacttcgaaagcttgtcgcatcttacacagaaggtgactttgcatgagcagaggtttgctgaagctaggaagaattctagaaaggttaatcatgtatgtccttatatgtatggatcggatgatgaagatgatgattctgaaatagctgcagccgaatgggtaaggagcaaaaaggttataccatgccaatgggtgaagagttctggaaaagaggagaggtatgactttgatatcaccaaggctgacaagatttttgacttgctactccgagagaagcagattcaacttcctgctggtcacacaattccatcggctgaagaatacggcaagaaaaggtattgcaaatggcataattctagatctcatactaccaatgattgcaaagtcttcaggcagcagatccaagcggctatcgaaggagacaaaatcaaatttgatgattctaagaggccgatgaaggttgatggtaatccttttcctgtcaatatggtgcatacagctggccgaacagcctatggaggtcgtgcaagaggttttcaagtaaattcggctaagatcattaataagtaccaaaggaagtatgctaaatagcaggagatgtgttatgaggaagatgatgacggctttgatcctcatt

SEQ ID NO: 15798 - DNA, 8221 bp, Oryza sativa
aagagattggccaaagggaaaagtgttgtaaccgcatcggttaacatggtttttacgttgcctgctgagtttggggtcaagcaatccgatgtcgatgaggttgaagaggaatcggctaagttgtttttgtcgccagaacaagcagtcttcaagaagccggaagggacagagaatcggcatcttaaaccactatatataaatggttatgtcaatgggaagccgatgtccaaaatgatgatcgatggtggggctgcagtgaatttgatgccgtatgctacatttaggaaattgggcagaaatactgaagatctcatcaagacgaacatggtgctcaaggacttcagtggcaatccattagagactaaaggagttttgaatgtggagctgacagtcggcaacaaaaccatccctacatcattctttgtcatcgatgggaagggttcttacagcttgttgcttgaaagggattggattcatgccaattgttgtattccttcaactatgcatcaatgcttaatttagtggcaaggcgacaagattgaaattgtgccagctgacaggtcagtaaatgttgccagtgccaatttggctctttgggagatggatggtcttgattgtttgtccgggaaaatttgggatggagattttctaaaagtgtccgattctgatacacacccagttaaagatggagaacccaagctattattttgagggcgtcgtggagggttcaaacgtctacaccaaggacacagtagatgatctcgatgataagcaaggacagggttttatgtcggctgatgatttggaagaaattgacataggtccaggtgatcgaccaaggccgacgtttattagtaagaatttatctgcagaatttagaaccaagttgatagaactattgaaagaattcagagattgcttcgcttgggagtattatgagatgccaggacttagccgatcgattgttgaacatcggctacctatcaaaccaggggttaggccacaccaacagcctccgaggagatgcaaagccgatatgcttgagcctgtcaaggctgagattaaatgattgtatgatgctagttttatttgtcctcgccgatatgctaagtgggtttctagtatagttcctgtgatcaaaaagaacggtaaggtcagggtgtgcattgatttccgaaacttgaataaagctaccctaaaagatgagtatccaatgccagtagccgatcagctggttgatgctgcctcaggacacaggattttgagttttatggacggtaatgcaggatacaatcaaatctttatggccgaagaagatatccacaagacgacttttaggtgtcctggtgcaatcggcttgtttgagtgggttgtaatgactttcggcttaaagagtgctggagctacgtatcaaagagctatgaattatatatatcacgatttgatcggctggttggttgaagtctatattgatgatgtggttgttatgtctaaagaaatagaagaccacatagccgatttgagaaaggtttttgagagaaccaggaaatatggcctaaagatgaacccgacaaagtgtgctttcggtgtatcggctggccagtttttaggatttcttgttcatgagagggggatcgaggtgactcaaaggagtgttaatgcgatcaagaagattcagcctccggagaacaagacagaattacaagaaatgatcggcaagataaattttgttagaagttttatttctaatttatctggcaggttagagccttttacaccattgttaagattgaaagccgatcaacagtttacttggggggcagagcaacagaaggctttggatagtattaaagaatatcttagctctcctccagttttgattcctccacagaaaggaataccttttagattatatctgtcggccagtgagaagccaatcgactcagtcttgattcaggagcttgaaggaaaagaaagagttgtattctatttaagtcgtcggctcttggatgcagaaactagatattctcctgtggagaagttgtgcttgtgcttatatttttcatgtacaaggttgaggcattatctattgtccaatgagtgcactgtcatatgcaaggccgatgtggtcaagtacatgttatcggctccaattttgaaaggaagggttggaaagtggatattttccttaactgaatttgatcttcggtatgagtcgccgaatgcagtcaaagggcaagctatagccatggactttattctttgatgggtcagtgtgcactcatggttgtggcatcggcttggttataatttcccctcggggggcatgttttgagtttgcttatactattaaaccttatgcaaccaacaatcaagctgaatatgaggtagttcttaaaggattgcagttactcaaagaagttgaagccgatgctattgaaattatgggggactctttgctagtaatcagtcaattggcaagggaatatgagtgcaagaatgatactttaatggtttataatgagaagtgccaagaactaatgatggaatttcggctagttactttgaatcatgtatcttgagaacaaaacactgaagccaatgatttggcccaaggggcatcggggtataagccgatgatcaaggatgttgaggttgaggttgcctcgataacagccgatgattggagatatgatgtgcatcaatatctgcagaatccatctcaatcggcttctcggaaattaagatatcaagcgttgaagtatactttgttggatgatgaactctattatcggacgattgatggggtattgcttaagtgtttgagtgccgatcaggctaaggttgcaatcggcgaagttcatgaagggatttgtggtactcatcaatcggctcatatggtgaagtggttgcttcggcgtggagggtatttttggccgacaatgctggaagattgtttcaggtattacaaaggatgtcaagattgtaagaaatttggagcaattcagcgagcaccggcgtcggctatgaatcctatcattaaaccatggccgtttagaggttggggaatcgatatgatcggtatgattaatccaccatcgagtaagggacataagtttatcttggtggcgaccgattatttcaccaagtgcgtagaggcgattcctttgaagaaagttgattctggggatgctatacagtttgttcaatagcatataatctatcgatttggtatccctaaaaccattataaccgatcaaggttcaattttagtgtccgatgagtttgttcagtttgccgatagcatgggaatcaaattgttgaattcttcaccgtattatgcacaagctaatgggcaggccgaggcatctaacaagagcttgatcaaattgattaagagaaagatttctgattatcctcggcaatggcatactcggttagctgaagcattgtggtcttatcggatggcttgtcatggatcgattcaagtccctccttataagctagtctatggtcatgaggctgttttgccatgggaagttagaatcggctcgaggagaacggagttgcaaaataatttaacagccgatgagtattataaccttatggccgatgagagggaagatctggttcaatcacgattgcgagcccttgcaaaggttaccaaggataaggagcgagttgctcggcattataacaagaaagtagtgtccaaagatttttcggaaggtgaacttgtatggaagttgattttgccaattgggactcgggatagcaaatttggcaagtggtcgccaaattgggaaggaccgttccaaattcataaggtggtatctaagggagcttacatgttgcaaggacttgatgaagaagtttatggcagagcgctaaatggcaaatacttgaagaaatattacccaagtgtttgggttaacgcatgatcggctgatgttgccgatgcatgatagccgatgtgtttacatcaccttgagatggctgatatggttatatcgcccttagttgttttcatattgtaatcggttgtgctttgccgatgtgcaatggcctatatggttatatcgcccttagttgctttcatattgtaatcagttgtggtttgccagtgtgcaatggccaatataaatatatcgcccttagtcgtttttataattttatcaatgtttttgacattgtaaaattagggggcacatacatggaaaattgcaaatttttgagcgtatttggaagttatgttaatcggcatgaaggatggtcaagacagtaaagtactagagtatcttagccgattacaaaaaattcttaaggtctattatacagaatgtcactgagacaaatatcgctgaatagccgatatagctctctgcctaatttgttctacttcttctatggcttgggcatcttgagcatcggttccagggatgactttcaaggacttggtcatatcagcgacattcttaatagccgatttcagccttgccttctgttcttcgacagcttgcgggagatcggctagcttcttgtgctccatatccagctcgacgttgcattcttgaaggtgtgccatgagatcaatcttacgagcttcaagccgatcgatattggacttgatcgggccctcagacagctgatcaagcttggacttctcttcatgcacaagctgtcgattgtgctagattgtagcttcaatatctttgcgctcccggcgatcgactaatctctgcctggccttctccagcttgaattggtgttgctcaaggtagacggctggagtaagggcatcggctagttcatctgggagtagagcttggatatctgtgaaccttgctcggatcgagccacagttggtcaccaagttgtctagtgatgcttctagccgatgagagatatccttaagcgttctcttcacatcatcggacagaggagctatggctttactagtggtgtcttcctctgtttcatcgagacaatccttgatgtcgaaggaaaacagatcggcgaagacctgcaagagataatattatggatggttaaggatcaaaacatgactagccgatctcaaatttgtgtcaacaaaaacttactggaatagtaggagcagctggttgttcttcctcttcgacattgtgactgtctgcagccgatggggtacggttgcttgattctagttgcataggaggtgaaggaggaggaggaggctgtaaaagagaaaaatgttaggcgtaatcggctgagatcaattaatgacataattgagaatgtcttactggtggggccggtttgagagttggtgctgccgatttcttcttcacagcagttttcttcttctgcaactataagatcagtgagcaatcggctataagtgaagtgattgcaaaaggagctgaggagagctgcttactcttggaaaatgagccggagcagaaggagttggaggagtttgcttgggcgaagccgatggtgttctttctgtatcgcttacttcgtctgcggcttggtcaacatcatctcgatgtcttcttcgatagatggatctagggcgggtagatcatcacttggcttggttttctttgatttggttttcttcttgggagccggagctgatgtttccacagccgacgatctggttttcttttcttgccagcatcggctggttctctaatgagcctttgaagaagagttgaagtcttgagggcattatagccgatgacaggaggagatggtccacctccatttggaattaagcctggggcatatttgatatctctgccactattgctttgatgtggaggggaagattctgttgtctacaaaatagaagagaaggttagtcaagttatgaatcgactgataattgttcaaacagaattaatgagatcaaggtttacctgaggtataacatcggggaacagatctgtcatgtacatagaagctggttgatggaagatatgttgttttcattcaccccaccatctgtcaaagttcttgctcctgaaccttgccagctctatgttctcaatactgcccaagggaggtcttgggatgttgagtagccgctccatcatcagagttgatgagatttctcctcggcactggatcttgttggcaaagaataagccgattgggagttggcccattccaagttgtctagctaaactcattgggtggtagaattcataggagacttggatgtttctcccttggtggatgccgacgggtaagatgcatgggctgattgcagttgagaaaacttccctggacttttggtatctttcatggttaatgtcttcaaatctgaagtccgatggattttccagaagtgatgaatcttcatagaagaaccaaacatgggcatctttctggaagccttcataaaagctgcagaaccagtccttgagcagctcagccgataactttgctcctgcatcggctggtgtggatgcatattccccataggacatacacctgcggtgggtgcgctcttctccatcatcatctgtaatcggctctaatcttggaaattcagcttccgtcacggatggccgattgacagctttcatgactactagatttagccaagtttgcaacaaccaccatggcccgcctgcactgacaattgagctgacagcaatcttggctgacgcgttgttcagtgtttgatacaagtagccgaggaggatcttgcctaagggaaattgcttttttgtttctagggcttcggctacaaactgccagttggttgtagggccgcaacttgatccacagaagagaaatttctccagccacatcagaagaaaggctacatgctctcgaggagtgacaggccctttacccatatatgctgctacatagccagaccaaccccctatgcttttggtcctgaagtcaaattagttcttggtgttcatactcatagggttagccgatgaagttacatctaatccggtgatcttggtgatgtcgatcaaagttggagtcatcggcccttggttgaacaggaaggcattgatagtgttggaccagaaataggtggcggcagccattagaggttcagtttttggctgagttggctatggtaagatcaagtgcttggccgattccgatttcgtcccagtgaacctttttgctagccgacatgcgcttgaaccatgtaatccagctcttctcgggtgaggttttctcaagagatggccaagatttgaaggtgttcttccaatgacctagatctgggttggctaatctgaaaggaaccctatttgtttcactgataatgaattcggtaggatcgggattatcaactgggccaagaacatagtggttctcatgcgacatacttggaatcgcaaccagattggacagatgctacagatgcaaatggggatagagaagaagaaaacaagatgaggcaagagaaaatcaatctgctgcgaaagaaagagatctagccgatgggtacttacctctgcgtattcggccgatggcgcggcggatggattggcggaggatgacatcgccgcgggcggagatctaaccggagacgaaatcgcctagggatcgccttgtgcgtcggagaaatcgccggagagagagaggacaaagttaacttcggcggtgaaaatggaagaaaacggtgtgagtttctcgggtgcaaaggttagtatttaaagcactggaataacggtcgggaaacggcagagtgcgaatcttgctcggagttgatgtatggcaaattcgaaacattaccaaatattccggacttggggggcatgtgttaatgaccaaatttggtaatatcagcatcggaaaggaagattagatcgaagcggaatcaaagataaggattatcgcgggaacagagtaagaatcggctggagtccggatcggctacgatcggatcggctaaattcgagtcagacttgttttggtgatgcagctgattccgacaatacgacttggtgtacaacatcgggttgagttgatatgcttcaaggtgattgccacgcatggatagagtcctgggaaggcaattgtatctattaattaggatattttatgtaatttacttagagatatgtttgggcaaaagtctgccgtaaagacttatggtatcttagagtttgttagagataagagtcgtgtccgatatgggcatagtttgtaatttgcgggtataaattgaccccgaaccctatgtaatcaatga

SEQ ID NO: 15799 - DNA, 12625 bp, Oryza sativa
  unsure (1)..(12625): unsure at all n locations
ggtgaccgatctatcccaatcacttgatttaagtatatattgacataaagattatataatgttaatatctacagccgattgaacatatttagttctttattatttacctataactgccgatcgatgcatatatgacatcggctcaaagataaacgatatgtcatcggcacttagccgatcggctatcgtttatggatttaaacacagtttctttgcctttacttcttgttgattgatcaaatcaactggcacgcttgtatacccgaaggcgagttttggacctgcactggagttaagcagatcttccaggcctcgtgttttccatcaacaccgaccacccatacgcccccatggcaacaacgaggacgaggacagcggcgacggcgacaacgacgaccggcggcttcgagaaatgacgtcgacgaggagagtggcgacggctttggatgcagatgacgtaaacacctgcaagcgaaaatccactcacaaaaataacgattttcgcagaccatttggtgcatgcaagtcgttccaccgcatgcgataactggatttgatcatatggaaaaatgcatttcgtagcagtgactggcagcaatatggtgttctgtagtaatgaaggcttcgttacaattggcagtttaattcattttgctcgtggtaggtcatgcaactgtggaagttgaagttgcagtcgatatacctgatcgagatgtacagcataacgaaatgcacggcgctataccatacaagtctttctgttcttcttttcttattctacaatggcgaaagatgagatgggttaattagcgaacaactccatctctttctttaagcaagttagaatggccacgttgcatctagacttagtatgagcgcagtacgaaatagcagtggggtctgagcaaactagatagaggtacagtctcccttccatctacatatgataaaaaattttagtgggatcttcgtgggggctctcatagtcttcacgccagtagtaggggctcgagaccctgccgccccaagctggatccgcccctgtatgagcgggtcttttttaattttcttctcctgcaaaggagaaagaaagatgggatgggatggctgttaattaagtcaacagatctggtcctttattaaagtaggctagaatggcacccttgcatctaattaagcaagtttgcaacaaagtaaaggtcaacgatacttaatgttattgtaaactaaaaacttagtatatgccagtaattatttgtatacagctgtgtagagctttgcaggattctaattttgtggtaactgggcaatgtagttgatctaaccgttatcattcaattgggaacatatcatatgcacatttggcttggcatgtatatgtgtgaatgacgaatttcgtgtcaactagcctgcttcacttgccatcgatctgtgggtacatctattatctttcttcccgcttgtgatgcagatcgggctggacttcatcaccacacgtctccttgccattgtgcgcctcccgctcactgtcgcgcagggtttacattaccgtcggtaaccgcgcggttactgcggttaccggtcttaccgtggggcacggtaatagaaaaaaccacggttaacctccgtaaatttaaataaatttaaaaaataatttgaatttttgataaattttgtatggtttcgtacggtttttcacagttaccgcgtggtaaccgtgcttactgccggtgcacggtaaccccggccccggcggcttcgctgtcacgtcaacgaagctaccgccgtcgtcgtctaacgcaactgttgtcaatgccacatcccatgtaccccgctctacactgccgctgcgatcaccatgtgcctcctcgttgtcgtggcctcccgctcgttgtcgccccaacgaggttgctgtcgttgtctaccgccgtcgtcgtcagggccacatcccgcgcctctccctcgactccaccaccgcgcctccgcgcgcctcttcgccaacacggccttcttcgcctccgcccctacgcggcctccaccgcctctgccccacgcggatttggccattggcatggatttggggggccaccgctgcctccgcctccgcctccatcggcgttgaggaagcccgtggcgacaacagggttgggtgtggacatgaggcggcgagctcgagcgccaccatgcccatctgccccacctcgagctcgaggatgggaatgggctcgaggagcagtgggagaagaggaagaggggagaaaggggaggaaagaaaagggttgtagagactaacatacgggtcccagtgtcatacttagagtatagagtttagcaatgagtttagcttgccaaatcaatttcatagctggctatatagatgtttggagtgtttgatttgggtagtctgttgaagatgctctaattactataagaaatgataggtacgtttcacttacgtcacaaaaactgaaatttacgtcatgacttgaaatttgtgatgttcgtatgatgaaaattcatttgtcacctattatgcgtctctaatcaagttttatgacaaaaactttttttggcattaatctagtaacgatccttctatcatcattgagtctatgacacccatttctatcattattgagcctagaaatcgtctgaactcactaaactttgatgagtagatgccacgtcagatagaaaacgtcataaaaattttagcacaccatgatatggagctgacatggcatatttttttgtcaatttattttgtcacaaaatttcttgtggcctgcgaagtcccatacaatgatcaatttatgggtcatgcccagttacaggcccgatttaggtttttaatccaatatttagcttatatgttttatactccaaggccctctttgtttaggcttagatttttttatttaggttttcaatctaatattttggcttatacttcctccgtttcatattataagactttctagcattgcccacattcatatataggttaatgaatctagacatataagtgtgcctagattcattaacatctatatcaatataggcaatgctagaaagtcttataacctaaaacggatgtagtatgttttataagccggtggctttgagccatatctccatctaacataaggaaaaaaagctacatgaagctttttttttttttgcttaataatgtaagaatggcttatatgtctttgaaaaaacaaaaaaaaaaaactagtcgtttgtttaggtggagttttgactcaaactttcttataagcctagaaagccgaaataacaatgcaattgatctagtaactgtttctcggattaattagtgattatcataatgatttattgactaacgtggcttaacgagacttcctgtttcatttgtaaatagtaatatatatctaggtgaaacagatatgtaacgaggggaggtgcctcttactgtcctacctcatcatatcataattagaaagacttagaaagtctaggtctttttactattaattgatctgttttcggtaggtagaattaacaaaagggatgagaattaactatatttcaacagccccggacctttatttaagcaggccagccagaacgaacaccgtgcatctaataaccagattacatcgagtcagtgactccagcgttgtcaatatatatggagcttttgcttcttgtgtttcttcttctggcggctatgtcagccgccgtggagagcatcacgagcacggcggtgaaaacggggtgccaggagcgctgcggcggcgtggacatcccctaccctttcggcatcgggcccggatgctcccgccacggcttcgagctctcgtgtgtcagcaacggcagcggcgccggcccgatcgcggtgctcgccggcacgtcgatccaggtgacgcgcctgtccgtcgagccggccgagtcgcaggtgatgctccccgtggggtggcagtgctacaacacctcgcagccgaccaggacataccccgactggagccgcgcgaagacggagatgaaccgcggcggagtgtaccgcatctccaacacccacaacatgctggtcgtgctcggctgcaacaccgtcggctacactgagagcttgaggagcgagggaggcgcctactccagcacatactacatcggctgcatgtcctactgcaacaactcggcgagcgcgcaggacggccagtgcgccggcgtcggctgctgccacgtcgacatcccaccggggctcaccgacagctccgtcaacttccgggtgtacgaccacaccggtatggtggactacagcccctgtgactacgccttcctcaccgaccggaccaactacagcttccggcgagccgacctcatcaagatggacaagaaccggaacgttccggtgtggcttgactgggcgatccgcgagaacggctccatgtcctgcgctgaggccaagggcaagccagggtacgcctgtgtcagcgtccacagcgagtgcgtcgactctactaatggtccgggttacaactgcaagtgtaccgcaggctacgagggaaacgcctatgctcctgatggatgtactagtaagtaacaatttccttctatcagtacatttgttacataccatttacctccctccatcccattttagatacagttatgggttttttgtgttcaaattttaaccatccgtcttattcgtcttatttaaaaaatttatgtaaaaatttaaaaaaagtcacacataaacacataaaatactattcgtgttttatcatctaataacaataaacatactaatcataaaataaatttcaaataagatggacagtcaaatgttagacatatgtcacgcccggaatttctatccaaaattccaaacgcttacatgtgtgtgaaccctcgtccaggaatcagccgaggcacacaataacaaattgataatagagtgcagttattactctaattaataagcgaataaaatgtcattacagaggtagatagttcctctcaatcaataaagatctaagcagcggaaagataagataaacggcgcagacgactccactccacaggcagcttgaccagggctacacctaatcctccacaccatcagcatcactgtagaactcttcctctgatgaatgattgcaaggtgagtatatgacatactcagcaagtcacgcagcaaatatgcaagtgcacaggatcacaaaggatggcataatagggtttcatttgtataaacagcatttaataaacatttcagaatttaataaaacagttaagtaataattaatcaatattaatccaacgctatacaacataccctgttgtataggcccaaccattctgaacaaccatacccggctatacagatctatctccaaaccaggaatataccattccaaaccaggagctaaacaaattattaccatttatagcatctattatcatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacagtacccctcgcacaacacaatccaccgcagcgcaccattcctggatcataatcacccccttataaacaaggcatggactccccagcgacccccgtgggcttatctccgccacttctcagtctggtgccccgcaatgaaccatgctatacaaaaggtaaagccgttgcccacgctggcttgtggttggcacgattaatgtttcacaaccgaaactcgtgaaccggtccttaattgtcatgagcacgactctcaaaaccatgtgctcacaacccaccattatcaagttttagttggcaaataattaattaaccaatcacgattgaccatcgtgagctatcattaagccatcattaaataatagtgagtcataagttatcccaatagtgtgctattgtttctaagcatggctaagcaatcacatctaatatctagctgaaccaatatatataaagctcaactagtcaagttataataacccaaggtatcaaggaataaagtaatcaagaacaaaaggctataacaaacaataggttgattccacccaatgacattcgaaaataaatgcaatatttgaatagaaacaatagctttaaatgggatcaacatgcttaaagggttgtttgggatctgtgtgacttgccttgctggccttggaactcttcaaattcttctcctgcgaaaacggactctccgaaaacgtcggaatctaaacagaaaagagcaaaaacaccaaaacagcacataaacaagcatgaacagaacatgtggatatttttatcatgtagatctcaattttagaaaaatttagagacttgaaccaactaaatccgagctaagatgaattagttatgaatttttaaagattaaatcggattaaaacacttatatggattttaatagaattatgacgcaataatgaattatttttgaaaaggaaaaggaaattattgcgtcagcggctagggtttgcggtggaccgggcgcacggcagcggttcacgggaacgaacggccgagatcgatccatccaaaacggacggccgagatcgatcgggtctacggcggctcacggcagacggaccctgatgacgtcagcggtgacgtcaccaccggcggcggctcgggcttgcacactcgccggcgaacgacggcgcttcggcacgaacagagggcaccaggacgtagagcgcgacgcggcgaactcaccgatgaccaaaacgtcggcggaagatcaacggacggcgacggcgacgaggaagaagcgacggcggtcttcggcttgacgacgacggcggtgctccggcgatctacagcggcagcgaaggggcggacgaggacggcggtgacttggcgaccacgatggcaacctccccgagcgacgacgacgaccggaactcaaatctccttcttcttcaaaactcaaatctctgcggcgattgtcggcataattcttatgacgagactgagccactcgcaatctttcttgaatgatctttaccttttcttctgcttcccttaggatatccgtcccgaaaacttgacgttctcccgtttgatcccacaaaagcggagtgcggcacttccgaccatacagtgcttcgtaagaagccatctgaagactagcttgataactgttgttgtacgaaaattctgcataaggtagattcttatcccaacttccaccgaagtctaaagcacaagctctcaacatgtcttccaaaatctgatttaccctttcggtttgtccgtctgtctgcagatgataagcagtactaaagttcagcttagaacccatctcttcctgaagcttcttccaaaaatttgaagtaaactgactacctcgatcagacactattttcttagggacgccatgcaaacacacaatccttgccatatacaattccgccaaccgacttccagaataagttgtctttactgggatgaaatgagccactttggtaagtctgtcgactatcacccaaatagagtcatggcctgatgacgttctgggtagaccagtgatgaaatccattccgatttcctcccatttccattcaggaatcttcaaaggctgcagcaaacctacgggtttctgatgttctgccttgactcgctgacaaacatcacatactgctacgtattctgcgatttcacgcttcatacttgcccaccaaaatctttccttgagatcctggtacatcttggtactaccagggtgaatggagtataaagtatcatgagcttctttcagaattgcatcttttaaatctttgttgtcggggacgcagattctctcacccaaccatacagttccttgctcatcttccaagaaaccgatagcttttcctcttcttatattcttcttgatttcttgaatatcaggatcattaatttgggcttctctaacttgatcaattagagtgggcttcgcttctaaggctgcaacaaaacctctactgacaattcccaaatttaatctttcaaattccttgcataattccaatggtaactgtcgtccttccgtagcattgcaatagcctttcctgctaagagcatctgctacaacattagcctttcccgggtgataatgaattcccatgtcataatccttaattaattccaaccatctcctttgtctcatgttcagatccggctgagtaaagatatattttaaactcttgtgatcggtgtacacctctgtacgagtaccgaaaagataatgacgccaaatcttcaacgcatgaaccactgcagctaattcaagatcatgagtagggtagttcttctcatgcggacgtaactgatgagatgcgtaggcaaccaccttcccatcttgcatcagaacacatcctaacccaagcttagatgcatcgcaatacacttggaaacccttctttggatcaggcaaaatcaagatgggtgctgatattaagcgacttttcaactcttgaaaactctgctcacattcttctgaccacttgtactttacatctttctgaagcagtcgtgtcatgggcttagcaatcttggagaaattctctataaatctccgataataacctgtgaggcctaggaaactgcggatctctgaaactgtctttggttgtttccagttggttacggattccacattactaggatcaacggcaactcctcctgctgagatgacgtgaccaaggaacttcacttcagacaaccaaaattcacacttgctaaacttagtatacagttgatgttctcgtagcttctctagtgcaagacgaagatgttcttcatgctcttctttggttcgggagtagataagaatgtcatcaataaagaccaccacaaacttgtctaggtattccataaacaccttattcatcaagttcatgaagaaagcgggggcattggtaagtccaaaagacataacagtacattcaaacaacccatacctagtggtaaaagctgttttaggtatatcttcctctttgattctcaactggtgataccctgatcgaagatctatcttggagaaaacagtggcacttttaagctgatcaaacaaatcatcaattctgggtagcgggtacttattcttgatagtcacatcatttagtgcacgatagtccacacacatcctctggatatgatctttcttttccacaaaaataactggagctccccatggagatgaactcggtctgatgtatcctttctgaagcaaatcgtccacttgcctcttgacttctgccaactcattggctgccattctataaggtctcttatggatcggagttattcctggtaccaaatctattctgaactctatatcccttttaggcggcataccaggtaaatcgtctgggaacacatcacgatactcccggactacaggaatctcttccaaagttatttggttcagtcttgaccttaaagactcggaagacgatgcatgaacagttacaactcgaccatcattactagtgagagttacttttctgttagcacagtttatcacacctttatatctggctaaccagtccatccctaggatgacatcaaggtctttggattctaacaagataagattggccagaaatggtactccttgaatttctattctgacggaggggctacgtcgcaaagagagtacttgattacttggggtactaaccatcaaaggacgtctaagatcttctacttccatcccatgatttcccgcaaaactcatagataagaatgaatgtgtagcaccagaatcgaaaagcactgttgcaggaactgagttaacaagaaacgtacccaaaatcacatctggagcaccttgagcttctgcagcagcaacatgattgacatgggcctttgatgctggtacggtagagttgctctgggtagggacaaccttcacgcgtcggggcttcggacacttgtcagcgtaatgtcctgggtctccacagttgaaacacaccatgggcttgctgccttgctccttcttggcaggttgttgctgtgtcgaagctgcaacatggcgtggagcttgattgcggatgttgttgcccgcattgttgttgaagaactgacgttgcggacgaacaacagacgaagaacctccctgtggcatggactggggtcctaaagtaagacgcggcctttgactattcccctgttgtgccttgaattgagcaatccggcgtttcttctgctccatgcggttgtacttgtcctcttgacgaatagccttatccactaacttctggaaatcatgataatccccagtcatgagtgagtaagaaagctcatcattaagtccttccaagaacttctcctggcgctcttcatcagtgcgtacatcttccggagcataacgagccaaacgattgaactcgtgcagatactccgtaacagagcgagacctctgggtgagcgacctgaattccttcttcttgagagacaccactcccgatggtatatgcgtcttccggaaagcagcggtgaactcaagccaagtgataggttcagcagtagtcctattcaggcggaagtgatcccaccattcagaggcagggccatgcagctggtgtgatgcaaatgagaccttctcctgatcagtgcattgaagcaaatccaacttcttctctatggcatgcagccaatcaccagcttcaacaggattagtggtgctagaaaaagtaggcggcctcacacgaagaaattctgctaacttgttctggggaggtgcatggttatttccctggttctgctggttctggagttgctgcatcatcatgttcatgagctgtgcctgttgagccagaacttgggcaagtgtaggattctctccattgttgttgttattgttgttgttgttggggccattcccgttgctgtgagtgagcaccatctggcatggacaggacacaagaagagaaaccggggaaaactacttaggacagggaattaatttttcttttattgatcttaagtgagtttcattattacaaaactgaagactctcacaccactgaactcaccaactacctaacactcgaaagcaaacaaacacatgcacttacatcccaccactgatgtaaatcacatgcgagacacacacaaacaaacttaaacaaacaaactaacacaacgatctaagacaacgacttgacaaggcattttagttcttccgggcatcggagttgattgaaggctcgttcggctcgtcttcatcatcttgagtagctccccactcaatcttggaatgagtgtgcttggattcttcttcttcatcatcacttacattgacgactgggggatccgctggggctggggtaacttctttttccaccacacggacctttggcgccaattggtagcgagggacaaatagagctctcttccttgcggtaagacgaattctggccttctgcggtggtgcttctcccttcaatgcggctagttccttctccaaacgatccaccttgtcctctaacttgcaaatcttaccacgattccggtcttcacgatcttgagctgctaacacagtctccgcacgggtttcatccatagcccacagcatctcaaccaaatgccttgtggtagcatcgatctcaattccttcagtctcaaggtagctgccacggtcacttccctggggttggcgaggatggtagcgatactcagtgtcggccaactgatcactgtagcgatcgtgaagctctcctatggcgatccttgccacctcctgacatgtatggatgtagcttcttcctccagcttcgaacatcactgaggggatatcttcactattactgttcaaggtgactttgacacggcacttctcttcatgacgatcatgaggaatctgggcataaaaaggggcagtcccaaatcctttgacaaaggacatcgtacgcaactcctggacaaatccctcaactccaaacaagtactcaggcttgtagcgcggcatctaaagacaagtgaaaggagggagttaagacacttatccaattaatagcacaagtttttagattaatttgaataaagttagaaaatcaaagaaaaaggtaggtaaataaagtaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15800 - DNA, 1154 bp, Oryza sativa
caaaaacactcctcccggcctctccttcggctgggaggttgcttattgggcccccaacatcatgtactacgatttttttccaattctaagtggttttgattgacatatggaccctccaatccgtgtaaacgtgtcctgattgtgcggatgtgtattttgttgcatgacgggtgtgttttctccttaaaacacttgcatacgcatatttcaccaacactagtggaaatgattagtaataatccctaccactgagttggataccatattttatttcattatatgcaagcattgatggtccaatattatgatttaagaactgtcaatagtggttttcatacaaaatccttgcatacatatatttcaccgatacttgtgaaaatgattagtaatagccactaccactaggtttgatgttttatttcaattgcttatatgtaggaattgatggtcggatttggtatttaaggaccatcaacagggttcatctctccctccttaccatgcacagggctgtggttccctctgacgggtgtggcaatggcctctcccctccctagcgctgcagtgaccagcactacctaagccagcgccacccctcaagctcggaagtgatgagcactgccgactgccaacgttgatgcctctcaccaaagctaggcggcggcaatagagtaggcgaggaatactacaccatgacataaaattaccggcagatgtgtattagcaaaaatatagaattatctactaactacctgttggtaaaaggtttgaatggaccatatgtcagcaatgctacaatataggagtaggaatctatttctgtcagcaattctatataacttcaggtcaaagtatatgtcggtaatactaactttaaagtcagactatgtgttggtaaaacttgccaatccatcatgtgccaccaaagtttcatccgtgtgtcacgcccgtgataaattcatcccgaaataaaaatcattctctaaatggaataatagaattaattaaaattcgaaaagaaattggcaaatactaaaatacgtaccagaaaaattcgaatgttgtccggagattttttgttaaattctccgtggtctaaaaagagccctccaattttacttgaattttcagagccccgaaaaatattattaagc

SEQ ID NO: 15801 - DNA, 1194 bp, Oryza sativa
ggatgatcatatctgggtcatacgaactcctaatggacccattcaagtctcttaatgtttgtcataacctaaagaaccgtgtgctttctttttatgtattgttattacttctttttaggcttgtagttttgcttgtgtgcttcgcgtagcttctgtcattccggaggtttccgaagcatgcttcgcggtcgtcgccgaaggttcggagtgccgttctctctgagcaacgcaagtcgcatcacccttgagcatattgaatcccagtttataaaattattttgatttaaattattgcattaccgctttacttaaattcccgcgttatcactgttttatttagccatgcctatttacctttgttatgaccttattattattgctattgttattattatcttgttcaccctaggataaacaaaaccccaactagtgggtactctattaacggttccactagtatgaatttaggtagatgcttcgctgattaattaggcaacactaggtggttttataactttagactttgggaattcttatatcatttggacagtatggaatggttggcttatgttggaattggacacacacctccccctctattcaaaacccctaaaatggttttaggctgggctcaaggtgcatggttctgctagtagcacctcggccactataaggaccggtcttcgagcctctgttgcaaagcactactgtactaaccacatgtctaatgggtaaggcttaacccggtgctcagtctagtcctggcaagagtacacggatggagatggacgaagtcggggctcgatggacatctctagggcaaatgaaggctacacgagctgcggctcggtagtcgagatgtcatggcacagggccggtgtcctgctgctaggggctcaatcttacctacctgtctcgggatttcggccataggcgaggttgggtcggtgcttttgtcacggctaggatgggtaaaggggttatgtcacatcctttacgatgggttccacggccgtggaatgcagagtaaagatgtgtctagagggtaaagatgtacacctctgatcagattataatctattcgaatagctgtgccctcggttatgggcatgcctagcaatgtaccaaagttagaagtttgcttcttaaaacttgcttaacaactaaaatgtggaatgattggcctgagttggc

SEQ ID NO: 15802 - DNA, 1267 bp, Oryza sativa
aaggaaagtgtgttagtgtcctataaggactttatgttttccttttatctttaggacagtttctttcttgtcctacaaagactagtatctacccatgggtataaatatgtgcacccggggtcattgtaaattatctctcttgatcaatacaactactctcggcgcatcgccaccctctttaccgaggttttttacttatcttccggtggaatttggcacctgacatgaggctgcattggttcagttcgatctctggcgaaggagtaagtcctacgttccaccggccctggtgaatctattggctatattggtgttgttcaaggctgcattgcttcgatctcttggatcgctctggtttggttgatatatttgcctacctgatatctcaattctatctctaattgcattgtgtttagagacgcatcggtttagttgggactgtctcggttaggtctgatcttctgtcttagccgatatatctctgcaatcacaatgttgttctaaatagatttgttatatccatcacattagacagatctagctcatcaagcattagattatcatatacaatctcgtgctgtatcggttaggttcgacctactagattgttgttgataatataaatcttgttgagccgataggttcacgctagtgttttatcggggtgctagccgataagttatctggacgttgcatcggcttataaggattacatacaagttggatttagccgattacaacaaaggtttcactgtttatctaatcgtttggattctatgacatcggacctccagccgatgtatgctttaaccttcggatcaatgcttattctatcatattgtattgctagccgattggtttatactagattatattgttattttattacatcatcatcagccgattgcctttatatcattatctatattggacatatagccgattgcttaaatccaatcgttattggctattatcggcatcggctggaactactccatcggcttgtcagccgatcggctcattgatctattatttggatatcttgtcagttgcagggtcaaactgattggcacgcccgcatctcactaacctttggttctgcactggagctaagcagatctcccaggccagtgtatgtttttcgcgtcaacaagtctagatccatttatcaagatgatatatctctgctacttaaaagttccgtagtggtgacggtgactccaaccttgacaaatacccaaaatataaaaagtcggatcgcctaatc

SEQ ID NO: 15803 - DNA, 2457 bp, Oryza sativa
gctcttatgttaaacatctcctttggtcctagtttggcactgtgcttgttaaaccattaattgttctaggtcatgtacatgatgaggatgggtgctattctttttatggatcccatctatcaaatataatgtgatggcacatgttagagaggtcagcggtatagtacttgtggatctcggcatcctaaattcatgaaattttggcggtacggtatccattatttttggtataatttcctgaaattttagattagtatttcgtagaacaaaagtttgaaaggttcaattctaattgccttgtcttctaactgaaatttggttgtaaattttaattcagccacataaattcataaacaagcaatcacatcacaacttcacaaggctaatctattttcaaggtaaattaaactagggacgttacagaagtactcaccctttgttcttaaatattatccgaaaccgacaagggtaatgccgagtttgaggattgtgcctgatgtcttaaccctataagttgcctatgataccttagacagatgctattatttcttttttcgtagcttcttcagtttctactaccttcgtcccaaaatgttcttacctagaaggctaggactgttcagattagttattctaggatgaataacatatctcattctaggtagcaacattttggaatggaggaagtagtaaactgtgtaagacttttcaactttatcagacttaacacaaaataaaaaccacagtaattgtgtgtatgcaacatattatatttcagtggtatcaattttttttcgaaagatgcccatcctattctcaactttggaagattagaccggcataacgtctcggtgttgaggggtatatcacctaccactaccactgaaagaataatttgtcataaataagagcactgttggtatttcttatgaccacagataaatctgcaagcacacggaataccgctgtagcacttcaccttcgggtgaccccaaaaggatatcgaactcagggaacgtgtgtaatctacctaaggctaagagaatccaaggacaactataggcaggcaggctagagaggactttctatgtgctttaattatctacgctaagcaaggtaattccctatctgttgcttcgggcaccgacccctactggtctgctagcgtggttccggctatagctctatgatgtatccaaacgtggaggattactaggacgggattcagggctgtcaccacttgccgcctacctctgacaaatccgtgggatacacaacaaacaaaggtaatctctaacctaaacaccacgtctaagttattaattactactctaatacttgtacatgaacttccttctttatccagagtcctagtactagagcacttagtatgaatactaaacaatgtacacgcaaagatggaaatctatcttactcagacaaagtaattaaataatataagaaaggaacatgaatgcttactttatagaagaagtttcttcgaacccggagcagagtgtatcgacagctccggtactcctcaagaattcctcctagaaagctacactcgccaagaaagaagtcggagagagcgccaaacttccgggcactcctccagagattccttcactctctacctattttctaatgtacaaaagatacaatagaatctcatgtaattcagctcaaagttgtgtactggaaatgagagtgagcttcctccttttataggcaggtatgacggttacagcctatgcgaaatgtccaaaatgccctagaatcgccatcaggaagtaatcagggccgtccacatggaaaatggtgatcaacagcgccagaacaggtttggccgaactggtgggttcggccgaacccaaaaacactcctcccggcctcttcttcggccgggagattgcttaatgggcccccaataacctgtgctttgttttggcccaatcctaaatggttttcattgacttattgggcctccaatccgtgtaaacgcgtcctgaatgcgcggaggtgcattttgtcgcatgactgatgtggtttctcctcaaattacctgcatacgcatatttcacctacactagtggaaatgattagtaataatatctaccactaagtgagataccatgttttatttatatgtaagtattgacggtcaaatattatgatttaaggaccatcaacaagcacccatgctaagtttgggatttgaatctaagaggacaggtcccaccacaagataccttaccagctaatacgctacggtcagttctccagtgggatggatttgtggttttatctactgctatgcgaaggcaccaagcaatgtatgtgtgtgctgttaatgcagaaggttaatggtcctaaaacaccagggcctgacatgacatttctatagtgcagagttaattttctcattgattctattgtaacagggctgatggtctg

SEQ ID NO: 15804 - DNA, 797 bp, Oryza sativa
agcagcccattgccatagatgaggaccagatgacgaaccaacaattaccatttaaaactccataaaatacaaaagggaagggatgatacgtactttgctgaagagatggcagctcctttgttgttatcaacaatcatttcggctctagtggtggtagcatcctctactcgtggtaccatggctaatggtgtattccaggtgcgccgcaaattccatatcgtggacggtgtgtacaaggggagcgacataggtgcattacaaatccatgatgggaaccgccatcgtcgccataaccttatggcttcggagctcccacttggtggcttcagcatcccatacggcactgggtatgctttaatcatctctgcctttggtcatgtctgtgtttgcttggttggttggtgtggttattagggataacaaatggatcttggcatagattatactacacagatatagggatcgggacacccgccgtgaagtactatgtacaggtggacaccggtagtgaggcattttgggttaacagcatctcctgcaagcaatgccctctcacgagagcgacatattggtaggtttccttctagtgtttctttagtttcagtccattaatctgcttgcaaaatctgctttgcaaaattgctttgtaatatgtttttgtttttgtcatgggtatgtgtatctgcttgtgtgcagagaaagctgacattttatgaccccaggagctcagtaagttcaaaagaggtgaaatgtgatgatacaatatgcacttcgcgaccaccattgatgaactactg

SEQ ID NO: 15805 - DNA, 484 bp, Oryza sativa
catcaccttggcctccgtgaacaggaagcaatgcgcctaaccaaaatccaccaaggattgtagtgtggcattcgaatctcgagcaacatgcttttcccatgcgaagctacaccaaaatttggttggggggggggtcaccacttgcttctttactctgctttggactgagtttaggcttatgtaggtgcctgggttttgaaggaggagagtgtacatatggtgaaaatagacgaactatagctaaaaatgtggatttagttcggagggaggtgggagggggttacaaatggtgaaaatataccaaaatagacgaacccgcttgtgcagtcgtagatgtcagtcacgacagtggtcgctgccaccatgctgctgattccccggtcacagcttggctgtccaccgctattgcactgacagccgacaacgttagtttggtcaacgatcatgatgctgatgaagtcgctaacgtgcccttagtcatgac

SEQ ID NO: 15806 - DNA, 3764 bp, Oryza sativa
aagtagggatatatgcatataatatcaatttgtattgtagtgcacgtatgccttcttacatgttgtaaccttttgagaatacatgtctttctgagtgtaacccaggctcgtgattccaacacaaagattattaccaaccttgattggttctattgttgtttccaccaaactaatgctatagtatccattttgaatctgtataataatcactagacccaaagcatggatttacaaatttgtgggaatatgtatagtttttatagaagtacttatcatgtttatctgtatcttctgaaaattaaaagcagcaaggcatctggaacttttgagcccactcacacaccacacacactaactcacatcaattcactattctatcacatagtgaggtatattaccttgtgaacctcaagtcgatcgatgttgctggcacaacatttcagcttccagccaatatttttgaaacgaccaaaacaaagggtacattcattgatagcggtacaaccttggtgtaccttccggagattgtatattcagaactaatacttcttgagattataggcatataatgatttaatttattccataaataaatcatgacattacagatgaaaactagcatgaacgcatcattagatctacacatgtaaactacacagtataacatgaacagattaaatatgcgcaacatattgaacacgtaccgaggtgacgaaaagaccggctgcttggtcgaaacttttcgcaggtgtctacgaaggcacgaaacacgcgagcgaagaggaaggcgagccgttgcgaacgaacagggagcagtcgcgcgaagcgcttcccaaaaaccttattgccgccttctcccggtgcaggacgtcaaaggcagaggttccggagacctgctctccgatcgctggtgcacgccggcgagcgggatggagtagtctacgagcgacggcgcagtacagagtaggaggcacaccctagattgatttcgcgtatattgcgtgaagacagcgggtcgggttatatagagaaaggtcgcttgatcagggcgcccgcacgatctctactgcgcgtaaccgaaccggataagtcgcgcgtaacttatccggactccacgctgtttgcatgcaccggatttttcggaacgtttccaaaacaaaaccgaatccgaatttgcagcaaaacaaaactgcaaaaggaggctgcatctgcacaagggtgaggagccaacttttttcggaccattcgacgcgtacgtcgtgcacgcgcgccgcctgccctgccctgccaggccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtagagcatataagtcatactcctaggtctttagtaagcttcctagaagattcacccaaaatcttcatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatatatattggtactctcctctagtttactaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattattcgctcaagcgcacgccagtgatcatctcccggattagaggtaaatcggctcaacttgctcacagcaaaggagatatcaggcctagttgcactagccaggtacatcaacgagccaataatttgggagtattccagttgattcctagcaattctattgttcttgcgaagcaacaagctaggatcataaggtgttgaaaaaggcttcctatcaatgtagccaaaccgattcaagatcttctccacataatgggactgcaagagtgtaatcccattctcgcctctaattagcttaatgtttaagataacatcagctattcccaaatctttcatatcaaaattttgagccaagaatgatttaacctcatttatcacctcaaggtttgtcccaaatatcagtatgtcgtcaacatacaagcacaaaataactcccttacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaataggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaaatcccgttagcgataatggaatccatttcactacggacagcctccttccagtagtctgcatcaggagatgcatatgcttctgaaattgacttaggagtgtcatccacgaggtacacagtgaaatcatcaccaaaagaattagccgtcctttgtctcttactccttcgaggagcttcactgacatcctcctcaaagacaaagtcatgtgtatgttcagtttgttctggtggtgtgattgaactg

SEQ ID NO: 15807 - DNA, 872 bp, Oryza sativa
tggaaaacttaggaattaaacacatgctggaaagccgagacatcaagccaaaattaatatgacataaacgtgaataccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctatcgatagaagggacatgctgcacgttcttcagctgcacgatctttcccgaagtaaacttcagatctaccgtgccaagaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggaatggtgttgttcttcttctgcttcttgaagttggtggtctgctgagctttgtatttccccttgctcttgttctgggccttgtgcacaacattggggctggactggccaccatcgcttttagacgcgggatttttttcccgagctttttcctcaacatcaagagacgctatccacccctcaacggagtaatcctgt

SEQ ID NO: 15808 - DNA, 1568 bp, Oryza sativa
caaaagacctgctttcttttctagtggtagaattgtttgcaattacgtttacatataactctcaaccaattgcaggtatttgccaagcatccggatataaccttgggtgctatgtacaattttgaatgttttcattttcttggaaggtatactctataacacaaaatctatagtgcagagacattatattcaccaatggactatataccagaagattcattggattcatattgagttaattcaatcttttcaatgcctctgaattccactttatccatcaaataactccaatttgttagtagtccgctaacattaccactgttttgatacccaagtatcctatccatttgttgaacgtgaggaaaaccagtaattctctaaaaattcccattgggtcataacctaataaagaacgctgcctactcaaaccgaagctttgttatgtacaattttaagtcttgaataatactctaaatgggtgaagttgcccaaattaccaaaaccttagagtaaaaataaaagtaaaagaaactttcgcttttctatatgagtttcagacaaaatataaggtacgatggagaagcagtagtggaaattgttttcattatacgatttactcggtaaaagacacataaactgctatttcatctgctacagcagcaaaacctatgtcaaaagtgcagtaggggtttatttagagggtttcctatttatgttgggattacttagactgttccatagttctgagggatggggtatattatatgcaacttagtcttcagatggtagaatataattattccattttactttgtgattattctaactatgttgttgttttcttgtgcagtgttgatgataaatttccaaagataactttcaatttcgagaatgatcttagcctggacgtgtatccatatgattaccttcttgaatatgaggtaatgacatttcacccctatgctctaccaaagttggtataacaatttgttcacaaattggtattgccttgtcttattaattctgacaacttaacacttcaaacttgtcatggccagaaaataccttttccgaacgctagtgcattaatccccgtcgtaggaaaatccgtggtcaccacaacagacttgatacaaaagccacatctttattaattatcacgatgatatctatattattatataggcacattaggtctgtcaacaaaagaaaaacaacagcggactagaggatgtatgactccatcttcacaggcgctcaacagtgctataagctaggactccacttatgacttcttcaaagcttgtctgactacaggatgaaagattgagtaagaatgagtgcaaccaccatactcagcaagccacaccaagaaatgcacacataatgcaaatgggtacaaggaataatgatacatgttgacttttgcataaaacccatttttaaatagtttagttttaaaacacatttcaaagcatgatcccaatctagtcaaattttttagtcaagctgcacacttgcacgaacatgcgttaacccaagccatcaaattcagttccaatcattcc

SEQ ID NO: 15809 - DNA, 466 bp, Oryza sativa
ccaacggtctaacacccaataccacaggcgacggctgggaaccaggacgaaaccctaatcttcaattttcttcatcttcaacttccgggcggaggaactatatatatatatatatatttatttatttatttatttatttatttatatagagcaagggtgagtactttcgtactcggcaagtcacgggaacttaggtgtttaatgcaagcttggaagagaggcgaggttgttttgtaaatcttttgttgaaatccattttgaaaccactaagtgatttatttctttttaggtttgggtcgaaaagagacttgcgtctcgattcgacttaagagatgcttttcaacaactcaattggtaatgtaccgacctcccgggtcagatcattgcttctcggctcccagagccatttcacttgattaagcggctcccagagcctttttcattttctcggactcctagagtccag

SEQ ID NO: 15810 - DNA, 3962 bp, Oryza sativa
  unsure (1)..(3962): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctccatagcctgtgtctcgtagaagaacagaacattgaattatgtggaactatggatttactggtgcaagtccattctcaattactaggttgattgaactctgaatgtgttatggttatagggaccagggcagcagcatcccagcccttagttatttaaattagaagtatggttaaattggaaagggttagtttgggccttaagccattaggaactggaataagtaagagttccaattgttagggccacttgcacaaatataagttaactagaaaagtacccgtgcgttgcaacgggaagaaaagacaagaaaattgagagaaatagagtgtggttggcagatggcctagtgagatgggttgggattccaatttctagcaatggatagaaaagatatatacctttctttatgataaaacttaggttgtcgattttattttaaattctctctgatggttgcaaattagtcctaaaatcttgtagtcgcagttgcatggcatttaattttctcccgcttgtcatcttttgtcttcattgattttactgcttttgtgtgagctaagatctttttttctattgagccaatatatttttcatcctcatctgtaagagagaaattctcggtgtcatctaactccggcatatcaaacttgaactataatcaaattaaccatctctatgcccattgcccatataaaatttgatttcattgttcaaatcatctgtctcctaacccatgcattgatgcacacgttaccatatgccatggaaaagtaatcggtcaacccagtaaacaatatctagtcaaatcttgaacagtaacgggcctaaatcaaactagcccaaaatttcccttttcttttcgttctatttttttcttctggccagatggctcctcgccacctcaaatgaatacgtagtatttttattatgctgaaattgctaggccgttaggctgaatcggattgctcgatccagcaatctcacgacataggaaaaccgatgtgcactgtgacaatgtaaaaaagaaaacagaaacgattcgttagcgcgcaagtcacgctaaactgacacagacgggccgaacatgcggacgatgtacacaggactcggaaacaatgaatgaggattaggacactgcctcggaggatcggactaattgacggacgaaccaaaaaattgtttgaagcagattttagaatatctcaagttctccctcgccttgttgtccctgacttcctgcacgcgacgtccttgttgccacggttctcttccactggctgccgggaacaacacctccattgaaacaatcactactagcccataacaaaatgaacggtcaattgctaggtggattgagctctgattgaatggtcaggctgtttagattttcctcaattatcgtcacttgagaggtaagctgtttactgacggatatatgttggaacactgcatatggcatgttgtcgggtaaaatagcgtagttattaagaccatgaccgctttgtttgttacttgatgtgaaatgatttctagaaatgttgctactatgctgaagcagatgtcctttcaaagatattactaaactctagtttccatccaggttacctggaacaggtgagtacaacaagttctatggtgatggggtctacaactgtgctggctgtggaacacccctgtacaaatccacaaccaagtttgattctggttgtggctggccagcattttttgagggacttcctggagccataaaccgaacagtacgcttgcataaccatttactaaatccttaaaaagttctttttttctcgtaaggaatactgaattttgtattgcgtttttgtagccggatcctgatggaaggagggtagaaatcacgtgtgcagcttgcggtgggcatttgggtcacgtgttcaaaggagaaggcttcaagacgcctactgatgagcgtcactgtgtgaacagtgtttcgatcaagttcaccccggcctcctaaatcctttcccaggtcattattattggaggtgaattccccagggctaaagctgtggaaagcactacaaaataatgaataaaatcacagagacatatcctgtttgtccatatatgaattcatctcctgttaatttagctgtaaacttgtaacttaacattgctgggaatggtaaatgaatgaataaatgaatctggttcattagttactgctctgtatttcacgttgctttgttcaattattatattatattcaaaccatatggttaactggttaagtacaaatgtgggtgtggccaacaatttcttcaggtaataataacttaacttagcaaagtactccatgctcattcaaatcatccttcgtactatatcctagtggggttgtttctcagatgtattgcacttgcagcacaatatcagtttgtctttggttcgccaaaatgtactattctgaaacaacttgaagtacaattgattatattttggccaaacaggtagtggcagaaactagcttccaggcataccaagattttctgcttaattattgctcagataaactgtgtactccacccggatttagtatccgtacagtagaggatgcggtgctgatggcgacggccaacgtgtgcatatggtcccagtgttcgtaatcgatcggagaggagcagttagatgagcatgcatcatcaacttttcacttcgtcagtgagggaagggccctcatgtttaggaaattgaccaggattattcagctaaatgaacagtcctgacaatatctcccttcaattacttccagattgcagctttgcaagcgcttggccttcaaaagaaattttgaactttgtttccttttcaccccgattacatgaacagcaggcactgcgccatcatattcaccacaaaagcccacgatcttagcttcattaacccaagagaaacttcaaactttctattgctacacgtataagaaagggatctcctatggaacatttggcaaaaaatccctttgatctcaactattttttgattgtatgattgcatcaatagtatattatccttccggagaagacaaggagcttccggagacagaggaagagtccgagtacgattcttgacacggctctgataatccaaaattcgatagaaaacccatcaaattcctgtcaatgattgcatcgcaaaaccaattataaaagttaccaaatgaagacattacttgctgtatcaattataacaataatcctgctttaagtaactatccgtgctgaagcatatccgtgtttctgggatgcaggaaaatcctgccaaaaatgcgactctgtgacagctttgattgcctgataccgaccgtgtaccgtggctgtgtgagtgttacacaaaccactggaaccagtacgtattttaaccaatcaaacggctaaaaattgcacttatatatgcacatgtacacactacggataccaaacgactctttaattacgtcattacgctactacgacgaggaccatctaaaccgacgcacaaagtactcactcatccctctaccacgtatagagagcgagagctacgtcgtcgaacactctaggcgcgtgtaacgcgtgttcaccgcggcggcgtcgccgtcgtcgacgtccatggcgtccacggtgaggcgcgcgttccggtgcctcctcgacggcctccgctccctgccg

SEQ ID NO: 15811 - DNA, 10241 bp, Oryza sativa
catggtggcgctgcagaacgtgcgcgcggaggaagggcgcgggatgcggccgctgtcggagctcgccgaggggctcgggatgcggtacgtgttcgccgagagctgggcgccggagtacggcaacgccgtgctctcccgctggcccatcaagcgctggaacgcgcgccgcctcgccgaccacttcgacttccggtacgtacgtcacacccgcgacacacgtcagatcgtcatcaccacgcacgccatggccgccaccatgcgtgcctacatttgctgccttactagcttcgaatcacgcatatctttttcacgaacacgtaaaaggattgcacggcggtatattagaagaaagcaataccgaatcatgcatatcatttgcattgcagtaattacatcgtctcatatcttaattacattacattacacgtgcgcacttacatacatgccatccaaagttccaaacaattatgaaattttgacatttgggaaaaaaattaatgactatagattatgctgttattaaggctagtaaaatcaaatcaaatccagctgagcatagttttacactatttacgaccaaattagcgtttctccctcctccatatgtggttcaagtttagttttgcatctgtgttagatgacaaattgccccttgactatcaataacgaagctttatactatttgatgatatgcacgaaacgaggacacgttgctatcaaagtctatcccttcagtaagtagaaaaccaccaatataatactatttgtatttctgcatacataggagagcaagtcaaaacttttgacagaaacaacaaaaagtagctgatttttcttactttctccatattcttaagttaagtggcaattatcatatacgacaatgggacgatgacaatttagatgagaagggcatacgtatgtatgcactttggcaagtacaatcacaaaagattagtcatggagtaagtgtagctgaaatgttgccttttttcccccacttaatataacagtagttgatgaaatgcttagcagttcagctgctgagatgcttacccaatggactcagcctgatctaagctagtaactgagctaaaaggagaattaggttagctgcttcataagcatcgagaggccaacatctagcaatcagcaaaggttgctgcagtgtcgatcgatgggtcacaattattatccgcgacaggattagtagcgtgacattatcaaattattaatgctttggttcttcattaaactagctgccacagtaggccacacgggcacctcgatcgcacttaataggtcccgccggtgtacccaacgtgagtatacatacgcacattctagctcggagacaacaaacaacaaaaaatgcgttcatttgaatcaaacatgcattataggggctcatttaagactctaatcgaattaataatggttattttattcagcaggtgagaagcgtgactcatccatccactgcacaaattaagacaaaatgtccccaaaatcctaaattaattccaagctagtagcattcagaacataaatagttggagagagtagcagcgtatgtgtatgattaggcctgaatttggtatggttaaaatcctagataagttaatgatcaagaacaaggaacacagtaagtaagagagtaacaaacatattaataaggcattaatggtgcaggaacgtgatgagagccaccattgaggtgccgggagccggggaggtgaacctgtactgcacccatctggaccacctcgacgagggcctcaggatgaagcaggtcgactccatcctccgcttcgccgacggccaccaccacatcctcgccggcggcctcaacgccctcgacgcctccgactactccgccgaccgctgggccgccatcgccaaggtacataccacacaccaatcaatctattaagttgcatgcaccagccagttgcaactaaaagcctaagctgatagggaaagatggacaattcactttatacattccaacacaatcaatcaatcgattttgtccaagaaaccatcctgatccatcctgatcatgggcaatttccggccggcggcggcgtgcgtgcagtaccacgaggagatcggcaagccgccgccgaagtcggaggtgatgaggcacctcaaggcgaagcgctacgtcgacgccaaggacttcgccggagggcgtgacgccggcctggtggtggttcccaatggccaaggttagattactgacaaatcttatcgcttgcagaattattccggcgatctgaagctgctgctaattaacatcgctgagatcttcttcttcttcttcttccatggtggtacggtgcagatgtgcaggggacgtgcaagtacggcacgagggtggactacatcctggcgtcgcccaactcgccgtacaacttcgtgccggggtcgtacgccgtcgtcccgtccatgggcacctcggatcaccacatcgtcatggtggacgtcgccgtcgccgcccacgatggcggcggcggcggcggcgcggcgaggcggcggcggaggcggagggtggtgaaggtgacgaacaagagttcggcgagagggatattcgccgattagactagatggattattattgggcttctggtttcttcttccttttgagtgaactgtatatgtgtctcagtttacggcccaaacacttttttttggtggggatacggcccaaataattatctggccgaataagcccattagtaatatgaaccgaatggtagcgagcgatccaatcttggggtttgggttccaggaaggcccgtcaaccttttcgtacgcacacagaacattgtcgtatggaattattcatccgatgccccttaacttgtcaacgaatctgattttcgtccttcaaccagaaaaccagatacaacgggtccctcaagtgttaaaaccggtgtaatatataggtcccatggcggttttagtagacgtggcgctgatgtggctaatttcactcggtcttcatctgacgtggcattgacgtggtatatatgaaataaaatttaaaaataaaacaaaatatatggtcccacacgtcagtcaaaataataaaattaaaaatagtgagacccacatatcagtgtccccattcatccacctcatcctttttctctgtctgctctcctcctcctccctctcttctctatcacctcatcatcttcttgttagatatcatgtgtatatctggatgtgtccggctggttgatcctatcctttagctgttgagatagcgttgtaatccaggttagttggagatatatcagccggactattctcgtcttgtaaaccacgatgcaggttgtttgcatcatatattaatacatgcgacgcacccaagaggaggtgacgatcgcttcctgtcctctgactttcttcttggtatcagagccttctcctctttcaatccaatctactcatggcgagctcgtcccaatctccggccgttggctctcttggagggatcacggtcacggagaaactaggcaaggggaactacctgatctggaaggttcaggtccttgcggtgattcgaggagcacggcttgacggctacctcaccggcgccataagagcgccatcgccgaccaccatcatcaagaagagtgacaaagatgttgaggtccccaatccagcgttcgacgaatggatcgcgaacgaccagcaggtactaggatatctgctaaccactatgagtagagatgttctctccaaggtggcgacgtgcggatctgctgccgcgctttggagcgtggtcgaagggatgttctcctcagcgacaagggcacgctccatcaacaccaagattacactgacgaacacaaagaagggcgacctcagcgttgccgaatacgtcggcaagatacgggcgctagctgatgagctagcgacctccgacaagctcgtcgacgaagaagacctaatctcgtttatcattgtgggattggatgaagattttgaacccatcatttcctctttggtgtcaaaatctgaacatgtgagcctaggggaggcttactcccagttgctcagctttgagcagcgcatgaaactccgtcaggagcactcggcgaaccttgctcacagagggcggggtcgtggacaacaacaacaaggcagaggttgcggcaatcaaggtaatcagcagcagcaacaatgcggtcgcggcggaaaaaattgcgggagagggcgcggcaacacctcctaccagcgacaaggtggaaacaacaccgacaaccgtcccaagtgccaactgtgctacaaaagggggcacactgtgattgattgctggtacaggtatgatgaagactttgtacctgacgaaaaatatgcaggaacagctgcgtcctatggtgtggactccaattggtatgtggacacgggtgctacagaccatattactggagaacttgagaagctaaccattcgggacaagtacaagggccaagatcaggtgcaagctgcgaatggtgcaggtatggtaatcactcacataggtcgttcaattgttaacaccccatctcggcctctgtacttgaataacatcttatatgttccaaatgccaacaaaaatttgatttcagcatatcggcttatggttgataactcagcttttcttgaattgtatcctaaacatttttctctcaaagatcaggccatgaaggagatacttcttagaggacgctgtcgtggccggctgttcccgcttccatcttcatccccttcagctcatcaagacaaggaagccctagctgccactacaccgtccctcgagcggtggcattgccgccttggtcatccttcctatgctatcgcagaaaaagtagttcgtaatcatgatctaccagtgtcagctgagtccaataaaatgttggtgtgtgatgcttgtcaaaaagggaaaagtcatcagttgccatttcccaagtcttctagtgtctttagttttcccttagaattgatttattcagatgtttggggtcccgctcctgttgccgggggtggaaagaaatattatgtcagttttattgatgctttcagtcgctttacatggatttattttcttaagcacaagtctgaagtttttcaaaagttttatgagttctaaagtcttgttgaacgtatgttcgataggaaaattatagctatgcaaaccgactggagaggcgagtatcaaaagttgaatacttttttcagcaaaataggcattacacatcatgtgtcctgtccacacacacatcaacagaatggctcagctgaatgaaaacatcgacacattgttgaagttggtctctctcttttagcacatgcttccttgcctttaaaattttgggatgaggcatatcaatctgctgtatatttaattaatcacacacccactaaagttcttggtttttcctctccacttgaatatctgtttaaacaaacccctgactatcaagcccttagaaccttcgggtgtgcgtgttggcctaatcttaggccttacaacaatcacaaaatgcattttcgctctaagcgctgcaccttccttggatacatccccattcacaaaggctttaggtgtttggattcatctactggccgcatttacatttcccgtgatgttgtatttgatgagtccgtttttcccttaaccgaactaaatcctaatgctggaaccaatctccgtaaggagatcaaccttttgccgactgacatgattagttttggggttgttcagttggatgatcatgtgagttattatcctgcaattcctgctaatctgtctcctgcagaaaatttggagcaaaacgcaacagcaaatacagaaaatgatgcagcagaagatgcagccgattctggtgcagccgaacaccaagcagctgacaatatctctgatgctgcacaagaggacagtagtcctctgtccgccgcgcatcattctgcacacgaggatgctgccgatgaatcatctgcagctccgtcgccggctgaccagtcttgtcaaccacaggcgcaaggttcctctgcgccagggggagagccacagcgtccagctactcgaccagtcacccggcttcaaaaaggtatcagaaaagaaaaaatatataccgatgatactgttaagtatggttttctcaccactaccggagaacctagagatttagctgaggctttacatgatacaaactggaagcatgctatggatgcggaatttacagctttattacacaataaaacttggcacttagttcctccacaaaaaggaaaaaatgtcatggattgtaaatgggtttataagattaaaagaaaacaagacggcagtctagacaggtacaaagttagactagttgctaaaggtattaaacagagatatggtatagattatgaggacacctttagccctgttgttaaagctgctactatcagacttgttctgtctattgctgtgtctagaggctggactctaaggcaattagatgtacataatgcttttcttcatggaatacttgaagaagaagtctacatgaaacaacctcctgggtatgaagacaaagcaaatccaggttgtatttgcaaacttgataaggctttgtatggtttgaaacaggcgcctagagcatggtatgctaggttgagtcagaaattgcagcaacttggatttcagggatccaaggcagatacctcattattcttttacaacaaacaaggtcttacaatctttgtacttatttatgttgatgatataattgttgctagttcgaggcaggatgcagttctaactctgttgcaagatcttcagaaagaatttgccttaaaggatctgggagacttgcattacttcctgggtatagaggtaaataagataagtaatggcattattcttactcaagaaaaatatgctaatgacttactgaagcgagttggcatgattgattgtaaacctgtaagtgcatcgttatcgactagtgagaagctcactttgcatgaaggagatttgttgggtctcaatgatgcctctaattatagaagtgtagctggagcacttcagtatttaactctgactaggccagatattgcttttccagtgaacaaggtatgtcagtttttgcatgctcctactacgattcattgggctactgtgaaaaggatactaagatatttaaaacagtgtactaaacttggtttaaagattagtaagtcaaagtctatgccttgtagtggatattcaaatacagattgggcaggaaatgtagatgatagaagatctacaagaggttttgcagtgtttctaggagataattcggtttcttggaacgcaagaaaacaagccacagtttctaggtctagcactgaatcagaatacaaggtattggccaacgctacagcagaaatcatgtggatacagaccttattggcagaactgggtgtttctagtcctctaatggccaggttatggtgtgataatcttggtgctaaatatttgtcatctaatcctgtttttcatgctaggactaaacatattgaggttgattatcattttgtacgagaaagagtacaacgcaggttgcttgaagtggattttgttcctacaggagatcaagtagctgatggattcacaaaggctttatcggtaaggcaattagagaattttaagtacaatctcaatctaggtagattgtgattgagggggagtgttagatatcatgtgtatatctgaatatgttcagctggttgatcctatcctttagctgttgagatagcgttgtaatccaggttagttggagatatatcagccggactattctcgtcttgtaaaccacgatgcaggttgtttgcatcatatattaatacatgcgacgcacccaagaggaggtgacgatcgcttcctgtcctctgactttcttcttctcccttctcctcgccaacgcctgcacgccgcccacgctgccagagaccgggagggtggtggaggttgagggccagatcaccaggtttcatgcgccttcttttccatcttgccgcgcacaggccacgacgctgtcctgctcggccgctggccacgctaccatcctccgctgccgtgggccacgccggctcctctcccccgcggcgccacctagagttgctgcggttgtcgcaaccgttgcaagaagctgcagccgccaccaccaccgaaagctcctgcaggcgttgtcatcaggcgttgtcatcgccgtcgccatggtagggcgtggttgatgtaaaagtttactataggctacgcctattgattatactaaattatactacaggcttggctgatgtaaaagttttctatataaattaaagttattttaaaaatcaaacaaatcaatcttttaagtttataaaaaattatactcgattaattatatactgataacttgtatcattctatgtgctatcagaatctccctgtactcactactcacacagtatgaaaatggaactgaaaattcccacgcgcgtggaggattcatagtttcatatataccacacgtaccgacgtacgacggttgaaggcatcacatccccaggagaagtcgcgatgaacttcaatttttcagacccaaattttccaattcactagtgaaaaatctaaacattacaccagagttctgaaaatgtgaagcatgagccgggctggttccaatgtattcagctgacttaccaattaattggagaccggtgatcatgtgcatacaggcatatcatgtcttgtcaggtcaaacaatatgtttctggccggtccactaatagctactcccttcaccccactttaagcgcagccaggatttcgtgtccaactttaatggttcgttttatttattcttttttaaaaaataaaaaacataaaccacacataaagtaccgttcatgttttatcatctaataacaataaaaatactaatcataaaaaaattaaaataagatggacgatcaaagttagacacagaaactcatggctgcatttaaaataggatagatggagtagtataggtaacacagtagattgatcacatgagcgagatcattttttctaggcaaaatttgctacggaacacttacaaaatatgtatttagctgtgaaacaccacaaagacgtgaatttgtccgagaacacttcaaaaatgtaatatcctcctagttgatgagagagaaccatataaaataacattttttcccttgttcttcctccaagtcttcttctggctcacttggagcgagctccaccgacttacccatggcggacagccactcgtctcaacatcacaactcaacaccctaaataaaaaaaaagggcatcggcataataaacaagaaggcgacaaaaaaagaaagatttttttaacactgactatgagctagtgatgaatgagtgtgagcgataatgactacacgcactgattaattgcttccatccatggcgatggcgcctgccggcacacgccacatgatgttgcacccagtgatggggtcctcgtagcattgctgctgttggtagtacggctgccggttgccgtagtaccatccctggtggtcgtacgacgccgtcactgaggccactccgtagtacccactggtcaccggcttgttgccgccagcgcacgagccgcagcggcacgcgccgccgcagccgtagccttagccgtcgccgtaatatgaggactagttgtacaccgggttgtcgggttatagttgtagcatgacaggaagccagtgggcaccggctagatggacggcacggcgacgccttgcgcagtcggctcgggcggcaccatcatcatcggcggcgcgatcggctagccgtgtggcggctcgaggctggcgtgctgtctgccatgggcaaaccaatggaacttgctaggagtgagcatcggaagaagacagagagaagggagaaggagataataagggtaaaattatcattttgtgtggtttctttttcatcaataggatagatattatattttaatgcgtccagtatcctacggtaaattattgcacttttagagtgtctaaattcacgtctttacggtgtcctacaactaattacacattttttgagggtcctatagcaaattttgccttttttatatctatcgatctgagtgacgcttgttctggttataacacatattctaaattaaaagtaatgtgtgaataatttttagcgacttaaaaaccaatggcgaaaa

SEQ ID NO: 15812 - DNA, 3506 bp, Oryza sativa
ttctcccccccccaaaaattttcgccctgttctgcctccgggcaacagctggcgcctccccccgaccgcggcaccagggtggctggcgctcccctcctccccccatagaagcccttccgcctccgggcctcggctggcgccgccctcatggatcacggcgccagggtagctggcgccgccctcccccagcccaaaacccttctgcctcgcggcactggctggcaccgccctccccaaccgcggcaccagggtggttggcgccgccctctgcctccctgcaaattgaagatccatattgcacaaatgtaccaattcacagttcgcaattcaaatcacaattcacagattcgtacagactaaaacaggttctaattgcacaaatcacaatgccaaaagtccatcacatagtcctcacatagtccatcacatattccacacatcaaacaatgcaaaaaatccatcacatatcccacacatcaaacaatgccaaaagtccatcctatattccacacatgaaacaatgtcaaaagtccatcacatagtcctcacatagtccatcacattttatatcacatagtgcaccacatatgtcatactaccaaccaatagattaacttcatacaaattacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcctgagtggatcgcaagttgtattgcgtgggttacgtcccctgaggcgcgtcgggaagctgtgacatgtctatctcctcggcatctggtgcgacgtagtcctcatcctcctcgtcctcgtcgtcatcgtcgtcgctaggtggagccggcgccttcccctttcccctcccttgcttaatgcgtgacgacgacgagccaccaactccttcacgctcttctatcctgatggagtgtcgagcgatacttggacgcgcggattgaggtagtggtggtggtagtctccccggttggtacacgtcgtccaatccaaccgacctgcaacctaatcttgctgcaagtttccggcacctttgacgaactttctgcatttaaaaaaaaaagaagtttgttaggcataactcaagtaatgcaaagtgctaaataaattttacctctaaaacattgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaagaaaacttacgactctgtctctaagtggggcgtgctccatttgatatccaactctagtccggacatcatagggattccgcccctcatcggagtcgcggtcatcctctatgtcggcttccgtccaagtagggcggaggaacagtctatatgtcctatgcagccaacgaaagtactctgagaaaagatgattttggtgtatagtctcgatgtacctgtcgttccttccggctgtcctccattcatcaatgtatctattatgctctagcccccagtctttcaccttctttgttctcaccctgtcatacctagacaagtagaaggtgatgaaacaatagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctgcaaaagttgaagagatgtcgttggttagtatctcaattaaagaagtaaatgtctaactagaaagtgatattggaagtacttacatgttgaggctgtaagcagtccatctcattgacataatgcttgtatgccacatcccggtgagcatgtgcagtggcagtactctcaaaaaggagaccactgtcttctccatgtctggctcattgtagggccaaggagtgaagctttgcctccatttaagccttgcaaccggtagtcttaaccacattcacatctgaatcaatagcacacaaccactcatgttggatgatggtgcctaacgacaacaggcctcacaaaactggctatatgtccacgtcaacactgctgagccgcaactgaaacggcccagatcaccaaggtcggcccacagaggaggggcgcgccagccatgctggcgccgtggtatgaggggcggcgccagtgtggctggcgcccccattctgcccagtcagcacctccacgacagccctaaattgccacagagtgggcacgggcacggcgccagtatggctggcgccgccatgttggggtacggcgccagccactctggcgccccaaaaaggaccatttccggtttaagttttcccaggagtctatttgtaaaataagttttcaaaaaggaccaaattgtaaaaatttcaggcatgcatgctatacaacagaggaacccgttcctattttgcatgctaatttcataaagtagaatattgatatatgcagttcttaaattcttaattttaaatttactcatgcacgccatgtactaggtagctaggtacagtttttaaatttattcattatttttttaggaataattaactactatttgccactcttacgtgtggttctaaagaatttatgtcatagacagcgagtggcaaatccttaattgccacatcttaaaagtgacaaataattaaatgcccttttttttacctgtagcgaccaatctaaactgtcttaaaaaatgttatctaaaagagtttcaaggtttttaccatcttcgttctaaaatattgctatctaggtcccatcttaccatatctaactgtacacaatgcactagtgtcctagtcgctagtgccatgcactatttgacatttgcggagccatcgtttcaccttattcgtggaaacttatatatatatatatatatatatatatatatatatatatatatatatatatatatattcttagcgaactaaaagcaaaggctaaaaaataaactttaatgaaaaacctcaaaatcaattctaaatttacggttaaaaattcaaatattggctgataagtataagtataagcgaaaagataaggcccttgatgtagcatattgttgcgctagaggaaccatcgttcatattttaccatcgacaggtatatatatatatatatatatatatatatatatatatatatatatatatatatatatatatatatatatatatatatatatatatatatatatat

SEQ ID NO: 15813 - DNA, 55609 bp, Oryza sativa
  unsure (1)..(55609): unsure at all n locations
atattggctgataagtataagtataagcgaaaagataaggcccttgatgtagcatattgttgcgctagaggaaccatcgttcatattttaccatcgacaggtatatatatatatatatatatatatatatgtatatactccctccgtatttaaatgtatgacaccattgactttttaactaacgtttaaccattcgttctattcaaaatttttgtgcaaatatgaaaatatttatgtcatgcttaaagaacatttgatgatgaatcaaggtacagtaaaataatgataattacataaattttttgaataaatttgatgatgaatcaaggtacagtaaaataaatgataattacataatttttttgaataagacgaatggtcaaacgttggataaaaattcaacggctatggaggtagtagtatttctttttgcaagttgccaagttggtaagccggtcgatgtcaccatgccataaccgtggagcgtgtccatgtcaccgcatgctataagggcacccgcaatggttacctataggctatctacaagagattcatgtcagcatatattttcctacttggaagaaattaaatgaaaagagagagagcaaagctatctactaaactggagatagtctatagagaaaagcgagacaatggatttagagagttatagatacccatgtagatgtactattaaggtggtttactattaatctagtctattactgatatgtacattgtcggtgatatgggaccgggggtatcgtgaccagaggcttgaggcagacacaatcgcccatgcggcctggcaccttcggggacgtcgggcccgagggtgaggtgtccgccctcctcctgatttcccccgagggggggtcgggttactccggtcccggccccgagggccgaggcaccccgaccccttgaggaagtttgcgccacatatatgggataggtgaacacggcagtgctcacctaaccgcatttattgtaagactggtcaagcgtgtcacgctgcatgcagcgcagtgcagcgcgttcctttatccggtctgtgaccggtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacagcctatatgttgtatgaagaagggcgaacatgcagattgttgaactgacgcgtggaggacaagaatgaccagtctgacactggtcatgtcgtcggcagacagccacgttcccacgacgcgcctgccttcggcagaagtggaggtaggtgtgtgccgtcccgtcagaaggatgatcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagatttggaacttagaacaagtaagaggttggctcacattttgtagctccctcatacacagatccaccaaaacacaggagtagggtattacgcttctcagcggcccgaacctgtatacatcgcccgtgtctcgcgtttcttcctagctggcgatctttccacataccgagagagcttgagatttcaccctaagcccccggccgaaccggcaaaggggggcctgcgcggtctcccggtgaggagccacgagctccgtcatctggcgcgccaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcgctcgatgcgtacgtgcggaaccaatggccgagaacgggtacgtgtgtttcgatctgtaattttctttccccaactcgcggcatgtcggcatgtagtgtaattctcctgcactgacagaatcatgggcaaattaaacatatcaaaatcacaacatctgggaacagccgcacacgcttcacactcgcacgagaatattaaaatcacaacaatagctatatatataggcctctacagctaagctacctcgtcaattaattaattgttttatcgtggaagatgggctcacgtttcagctctataaatacaactcttcagatcagagctaggcacaccacttcacttgtgtagctgtgttctctctccataacttcacttcacgtacttcaactcaaacacagtagagttcgtcgcctccttgtcatcactgaacacacacacgctgctgacatggccgcgagcaaggctgcagcagcgaaccagccgctggagatggacgctgtcgtcaatggcggcgccggctttgaccttagtagcgattcatacaagttaaatcttctaatcaatggtgggccaataatgaattttttttgcatatgtattaagacgcttggcctgatttcgaaattgtccagagttttttatgtagttttcattgcaaaatgatggatctccttccgtaactttccaattacgagtacgagaattgaaagacatgaaaattctcaattctctacggcgtctaggagatagatagaatattttcaggaacaagaaaaccagaagaatctttctctctattcactaccatttcgcgtcttcgacttctattagtttcttttcttctttaatgcaatagctatagtttgatatagaatccatttctcaaagtaatggaaacctttctcttataggaaatggttcgaaaatcgctattccaccttttaggtatcgtgaaaagtgatacctgtgaagatcgtgcatttcagtcacattcagatccgttttttgagtccatgatataaccaaattggatggatcttccacccgtttagctaagaaagaatagatgcagaggtggataatagatcgatataaagatcatgagctgccccataatgaaaccaccaggagtcgcgaatatctccttcttccctaatccaagattggagaaagaagatccaagagggacccatggagaatgtggtcagaaacctataatagagtccgaccgcaacgacctcatcgagaaacttagactactaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaagggatggatattaaatgataggaagtgctagaaagtgaaatagaatgaaatagagccactctgggcttacctatgaaatgaggcatggaacggagccactacgaagaaattccgggagttacgaaagaagcttcggactcatattgttcatgggttgagagcgggagttgaactctaggaggtcgaatcccccttgttcctcagnnnnnnnnnnnnnnnnnnnnnnnnnnnnnnnnnnnnnnnnnnnnnnnnnnnnnnnacttggggagatttgattcattctttaatgtaagaataaagaattgaattaaagggctttctttgacccttaggagtaggtaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccggggtaccctcaaaaggaacctccctctcctcagccatttcatttcgggttaagaagatgggaaaacccctttctctctataagaatagtgcgttccgaggtgtgaagtgggagagaggggatgtgatgattgaggttttgaataagaagacctttgcattttggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtggttcctctacgcctaggacaccagaatatcgaaccatgaacgaggaaaggcatgagagaaatattggctagtaattgtgaagccccaattcttgactggaagggacaccaaaggcctctgccctccctctctatctatccaagagatggaagggcagagcttttttttggttttttcatcttttcatcaaagagttgaacaatgaagataaatggcaagtgcctgatcgatttgatcaggtcgtgtaggaacaaggttcaaatcgttcgttcgttaggatgcctcagctgcatacatcactgcacttccacttgacacctatttaaacggctcgtctcgccgctaccttatcctatttccatgcttctgtcgctccatccccgtatgggtggagaacccgtcacctacgcccctcccctctcgcaggcacgggcgtgatatcgatccagtggctcacatgatttctgtcaaatttcagacaaaatttgatcaattttcgcctgttttaaacgatcatatatatattaattgatgcaggttgtgaggagcggatgagggcgcgggcggagcggctcgccggggaggtgcgccgcaggatgttcgccgccggcggcggcaacggcgacggcgagggcggagttacgatgagcgtggccgaagcggcgacgctggtggacacgctcgaacgcctcggactagatgggcacttccggcacgagattggtgtgctgctggggcgtctccgccgcgaggaggcggattttgcaggcagcgacgacgacctgtatactgttgcccttcggtttcgtctgcttaggcagcatggggtctgggtatctgcaggtacgtaactgttagtcttggattaattaatactatgatgattcatagaggaaaatacaagaaaattggttttgcataaacgatttaagaacgaatggcaatacatatagttaacggatttgctagaaaacttctataagttttttgttcccaaaacttttaggattgtaaccatcggatcgccttgagatttgtgcatgaagaaaaaaattgctaaaagaatgtttcacacgtgtcacgcgtaagatttcagtactaactaaccaaaccatagttgaatgcaagttttatataagttatatcgtagttacaatatagtacaatataattacacttcaattatattatagttacatctgaaagttttatactcaaaaaacttgtgacaatttttagatatagatactacctatagttaattaattaatttggcattatgttgtgtttgcgtacgtatgcagatgtgttcgcgacaagttcagagatggtacatgtagtttcagctcaagcctacgtgatgacccgaggggcttgctgagcctgtacaacgcagctcacatggcagcacctgtagagatcgccctagacgacatcatcgccttcgcgaggtgccacctcgaggccctgtccatggaaggcgagctcaaatcgccattggctgagcaggtctcccgcgccccggacatcccactcccacggttcccaaggcggctcgagaccatgagctacctcgtcgagtatgagcaagaggacgaacacgacgacatgctgctggagctcgcgaggctagaattcgagctcacgaggtgtcttcaccttgaggagctcaaggctctctccttgtgagtgatcgtttcttatcgtctcattgctgctgccactgtcttcttcgtcttcgctataagtgtaagaggttgatgatcttgcaggtggtggagagagctttacgagagcgtgaagctgagctatgctcgagatcgcctagtggagtcctacttctggacatgcggcgtgttccatgaggaggaatactctcgtgcccggatcatgtttgccaaggtatttggattgctgtccctgatggatgatacctatgacgtccatgctaccttggaggagtgctataagctcaatgaagctatacagaggtctgaattaattaatctctcatgatgttgcattgttgattgatccttatgctggtgattcagctcacatgtatacatgtcgatgtgcagatgggacgagggcgcgatttctattctgccagaatatttgcgcatgttttacatcaagctgctgagcaactttgacgagttggaggctagcttagaaccacacgagaagttccgcgtgtcctacgccaaaaatgcggtaaatattcatagtaaaaatcacatttcagtctatgaaacatgctaatatgtagagtaaaatcagtagaatctcacgtgaaattctccctttcctgtccatgtacagtttaagctgtcgtctgaatactacctccgtgaggccaaatggtcgaacaccaagtacacgccgagcttcgccgagcacctggaggtgtccgtcatgtcgtcgggcttcccgatgctggcgccggtggtgctgatgggcgtgcacgacgacgccgccgtggcgaccgcggcggcgttcgagtgggccaccgccgccggcgtccccgacgtggtcatcgccgccagcggcgaggtggcgcgcttcctcaacgacatcgcgtcccaccgcgtggggaagaacgagaaggacgtgccgagctcggtggagagctacatggcggagcacggcgtcggcgaggaggccgccctcgcggcggtggcggcgatggcggagcacgggtggaggacgatcaaccgggcgttgatggagatggaccccgggctgctgccggcggcgcggctcatcgtgaacctgacgaggacgctggaggtgatctaccttggtggcagggacggttacaccttcggcggcgacatcaagggcctcgtcgtcagcctcttccttgatccggtcgccgttatacgtatttgagctgaatttgaatgttctcgatcgatcctgtataagttgtgtacccgtgtattccaggcttctagctaggtgtgtgaaagctaggccagtaaggtatagtaccgttggaaaaatatgggtgatttatagtagtagttgtttctaagagataaattacacaaactattgatgcaaaataaattttgagacagaactcgaaaatatatccaaaattttgaagaataaaaagttctattaaaattggttctaatgctgttgaaaagaaggtgtcacatttaggggtgaaaacgaatcaaatatggtcggaaactagctctaccatatccgttttcatatttcttttcacggaattggaatcagaaacccggatacgaaaacagaatcgaatattatcgaatatagatacggagtgaatacgaatcgaaacgaataaggtaacgaataattatcgaaatatcaagacccctcaaagtaagcttcttaaatcgaggaagaggtgtagccattagttttcaaaaacaaaacatcaacatgttcaaattttatctctatttgtaagtgcaagggggagatagaaaatgttgtgtttactttcatacaaatttatgttatcatgaaacaaataaattaatgtgtatcacttaaattttcacaggcacattaaaagttttgaaaattggttgagtattttaaattttgggttgaacatttcaattggagttgagagtttcgaaattgaattaaacgttctagaatttaagttgaattttttaaatctgagttgagagttttgaattcgaactgaatatgtggagaaaggaggaggaagaataagatggctgagaatgacatgtggggcccacgtggaccccaccatttttaattaattcttttagtgtaactgacaatggggtcattgtttttattaattctcacatcaaattgctacgtcaatgccacgtcagaagaagaacgggtcaatttagctatgtaggcgccacgtaagctaaaaccaccatctaaatcaccatgggatctatattgcaccggttgtaatagttaagagacccgttatatctggttttctagttgaaggatgaaaatcggattcgttgacaaataagggaccgcatatgaacttattcctttactatttgacaattttcatattgcatgggctacacacatgaaattttatggatttggcccgttattgaatttgatatgttttcatgtgtttgtagcactgggcacatgggcccaatatatagcccacatgtaggctaattattattttttaatttgtttcaaatttatatgtacgaaagttatacgtacaatgtttatatgcatatgcggagaaagtagggccagggcttcctaatgcacgcgctgctctgtgggggcaagtcgtgcacccccaacaagcgacccctatattacttagcgcacccccgacccgcttagtgttaatctggttcaataacattttgtaatataaattaacgaaaaagtgttaagttgaaagtttctatcagtgttatggataatgcatactcaatagttttgagttaaactcggtggggcccaccatatattaagtcctacacagaatcttgcctcgtatgcggaaggtggttcaagttgaagtttaaaattcgagctgaaagtatcgaattccaagtcaaaagtaaatttgatatgaaagttttgaaacttgagttgaaagttccaaaagttgaattgaaagttttagaatttaagttgattgcttcaatttgagttaaagttttaaatttcagttggaagtttttgaaatttgagatgaatggtttgaaaattgagttgaaagtttcggaatttaagtagagtttcaaatttgattcaaaagtttcaaattttaaatatagttttcagattttagaaaaagaacaataaacactagtttgaggaaaaaaaaccgcatagagggttaccaaatttacgtttaatcagattgtacaaaatgactaattagcgcatgtgaagaacccttgcgccgcgagcctcatgagttaaacaagttgtgcatatgcacggaatagatttttcacacaaagtatcaatgtatttggtttttatgcttatttattttgaaaaaaaaatctgaattaccccttgaactattgaggtagtacaatttacctctaaactagttgttttgcaccccttactctttaagcgccgccgctcaccgaccttgggttcttggccttttcccgagagagggagaggggtgagagatgtcatgtgagcccacttggatatttattttgacgttttgttgctgattggagtgtcaggttcgtgccacgtgtgcaatcctatgccaaaaccacttcaaaccatgctcacgggtaatccatcaggtttaaagagttagggggtgctaaatgtctggctttgtgatttaagagattaaatcatattacctcaatagttcaggggttaattttgacttttttcttttctttttctatgagtaaactttctttctgggctagggttaacacgaagaattcatttccaaattcatacgcatgaattttatatatacaaaatttctacgcaaagtatctatgtataaagttttacgtataattttttaatttatgaagtgtatgtgtataactttttttactggacagcatactgtttgttggctcaaagtccaaccagaataaaaaacaagcatgcgctgtggcgggttgaatgcccagggaagagaggaaacttgtggtcgtatgcacactgttttgtcattttttgccgcgcactcgtgatgtgcgcgattgcttgctcatcagactgatctctatttatgttcttgaggtgataccatataactgaagagaggtgcgagggtaagtttatattttcacgttagatggatggatatgctgtacggatgaaagaggccggtgttctcagtttcttacgcaagcgcgctcacgtaataactcatgcaaacataccaagggtttgacggctcgtgcaaagtcaccttccaaatgaataggtatagtatgcagacgacgagttgtgctgaggctgtgtttagttcagcgtaaaatttagattttggttgaaattggagatgatgtgactgaaaagtcgtgtgtgtatggtaagttgatgtgatagaaaaggactgaagtttggatccaaattttagatctaaacacagcctgagtactccagtagttaggccggccgttatatgtgccaatcagtactggaagtctgaaaatatcggtcgatcagcagtacacgtattcacgatgggagtgtatgtatgtgaggcatgtgccagtcagtgcttgctgcatgcatcatgcatgctgggccacagcctacagccctacagggagaacagtacagggtgcacatgcaaaatgaggccctcgtacgacaattcgatcgtctattcttctttttgctgaaatcgtcgtccctgtgcggcaagcggtccatgatggaccattcatgcattgtcttcgttggtcaatctcgtcactacgcgcaagcggtgacactacttgtactgtggtgtctaataaatgtacaggttctttgaaaacaaaggaaaaaaacaattgttgcactagtcgcgcataaatcatcctacgtataaacctggaccttacttttcatgtatgatatatctccattataccaacctgtagatcgtgatatatcctgcgtagacgaacgacgctgttgatcctgttaatgatattttatcagctattacactggttgaaagatctttctcaaacaacccacacccacgcgacttcacggtccaccgagagataaggcactcatgtgtcccacgcccgcacgtacggtgacagctcctcgtgcttccgctgcttaatttccctataccgcgctccgtctcctcttcttcacggaccacggccacacaaaacctatgtttaaatgtgccactttcactgagaaaactgctgcgccctgctagaaaacttgcaacctcctctgccttggagctccgtcgctgcctttcccaaagcgcccgatgccgcagctctctgcggaagtcatcgcctccactcacctgagccgacccgtcgagctttttccctgtaccgtagtctactacactaaaaagctcgcgtgccccgtagcttgctcgacaccaccaatctgctccgatttccgatcaactaccacaaccaaagccgatgaatcaccatactatatatatttctagccactaaacaacctgagtgtcaaatcttattatcatctctctatggtatgcatcttactgaagacccgtgcctcactgaaattctatggatagcttaaacacatgtgcttagtatttgtaggcatcacgatttaagttctctactgggtagaatgatggcttaaacacatgtgcttagtatttgtagacatcacgatgtgagttctttactgggtagaatgatgtacccgtgaggccgtgactccgcttaaaagcacctagttattgaggcagacgagaagaactgaacaagcaagaaccatcatatgctaggaaaaggacgatttttgtttttgtttttgtttttgtttttggagtcgtgacaaaatgccctgggtcgttttctctttatttttttttatcacaaccgactcaatccatcggcaaatacaaagacaaagcactacacacaagaggtatagagctcctggtggattaatcttatttgtaaccagggcaagtgtgtgagatgtacaactgtattggccccttaaaattatatattttgatataccaatgtgttctaatatatttagaatctttttacttcttttttaaaattttctttgtgcttcaattgaattttcctagaacgagattttttttctctgacaattgtttgataatcatagataccttgtagaactatattcatgacggtagtgaacgtgtgttctaaataataacaatatcatttgtccacttaattaataaaaaaatgaacttggtgcagcgattcttcttctgcctagctaggtcgtcatagacggcagggacagatctacagtagaagggccggtgttaggcgacaccgacgattttcagcaaaaactatagcgaaactgcttatccatatgttatgacacaatgatgtaagtataattagcacacgatgacaccgatagacacgttctgacactaacgaatcgattttctagatccgccactgatagacaggtgagtttctttagcatacattggctatcgccaatacgtataagaccttattttatattttgaatagggccacaataatttaggatggccctgtttgtaacatacgcatgcataccctagtatttattatgtgggcgtatagtgtatatgtttttagataatggataaaatctaacatttacttcaacagaagctatagccacttattacatagttattggctgaaaaacaagtataacaatttgtaacaaagaataaagagacgacacaataataaatgtcaccatcataggaaagagaaacaatttactcaaagaataatcttattattaaaattccatccaaatttagcgaaaatttaaacggcggttgcttataaattccaacatgtagcatgaatagtcaccatgtcctcttcacacatttgtagttggacatagaaccgaagccagtatgctctgaagaaaaccggcatatatgatttagttggtgttttataaaaaaccatgttaattctattcaactatagagtctaacatagaacagacaccctaactaaaataaaatatatatgtaggatcgaagttacgcacacgatttggacgaacacgtcggcacgttgctgtgtgcatgcctaatacacgggaaggggatcaagaaagaggttggagacgagacccttgaggtcgccaccgacggtgtacccgtccctgccgccgaggtagatcacctccaccgtcctcgccaggttcaccatcagccgcgccgccggcagcagggcggcatccatcgtcccgacggcggcgcactccccgttgatcgtcctccacgcgcgctccgccagcgcggccaccgccgccacggcctcccccccgcccacgccgcgctccgccatgtagcactccaccgtgctcgccatgtccccgccgctcttcccgatcctgtaggaggcggtgtcgttgaggaagcgggcgagctccccgccggcgcggaccagggcggggacggggacgctggtcgcccactcgaacgcctccttggttgtcgccgccgcaccgccgctgtcgcgcacgccgagcagcagcaccggtgccatcgccgggaagccggacgacatgagagagatatccaggtgctcgacgaagctgggcatgtacttgtcgcttgaccattgggcctcacggaggtagtattccgacatctgcttgaactgtgtacatgtgtgcatgtgcaggaaaattaatcaaaatgtgtggacgagggcacgaatatcactttagtatgcctttttttttttttttggagaacaagattttaccgtagttttcgcgtaagacatgctgtacttctcatccggctccaagctgtcctccatctcatcaaagtcattgagcaactttatgtaaaagatacgcaaatattctggtagaatagaaaccgcacttttgtcccatctgtatagatatatatatatatatcgaggatatatttatattagctagatcattgattagtaatgctcgttggcaaattgacaacctactaggccatcattaactagcaaatttctacctctgcatagcttcgttaagcttgtaacactcctccagggtggcgtggatgtcgtaagtgtcatccatcagagtcatcagttaaaacaccttggtgaatatgatccgcgagcgagagtacttctccccgtggaatatggcacaggaccagaagtaagactctactagacgatctcgagcgtagctcagctttacgctgtcataaagttgtctccaccacctgtcaatcatattcacgcacgcacatatttactagaccacgtaattgtatttatgctaactgtgcagtgaagtgaagtagagtaattttatgatagtttttactgacagtaatatatattccactatcataatctgctgatgagtaaaagcagggctattgcttataacacagttgcgtgaagcagagaacgacaaggacagtgaagcaagaaatgattgtggaagaaaaaaataatatgcataagagaaacttaaatgattacaaggagagggtcttgagctccttgaggtaaagaggtctgataagctcgaagtccagcctcgcgagctccagcaccacgccgtcgtgcgcctcctcccgctcgtactcggtgatgtagcgcatcgtctccagcagcttgggcgcccgtgcgagagggatgtcgagggcgcgggagacctgctcggccatcggcgatcccagcttaccttgcaaggacttgacgctccgtctcgagaacgcgatggcgtcgtcgagcgccgcttcttcgccggggcatggcgaggtgcgctgcgttgtagaggcttagcaggccccttgcgtccgtgctcaggttttctctgaaacaacccgtgctatctttgaacttgtcgaatacatctgcatgaacaaatttctagctgtaagggtgtacacactagtactatatatgctccagggattatatttatccaaatgaatcagagatgggagagatgtgtgttcaaataacaagctttagatcgaaccttgtttgatctttgtcgtattttagaattcatttagtgtttttttcaccgtattttttttcaacctcagtttttggactgttatatactgaatttatttccattcttttgattttgtgtcccaatttatacgctcctagctatcaatgaaaatgtcttctaactgattcggcaattatattcattctatatcaatatgtacatatatataacaaaatattctcctacaaaactgcagagagattgaattatactccgagttacctgcagataccaagaaaccatgctggcgaagtagacgaaacctaagggattcaaggtggagcaagtcagcagcagcaacgctgtcggcgtgctccttatggtgcaataataatacatgctgtaacgctacggtgatctcgtcgcggaagtggtcgtctatgtggaggcgttcgagcacgtccactagcatcaccgtgtaggccatactcgtggccttcgacagcttgcagcgcacctgcctctttagctgatccacatgttccctcatccacttctctgacatctgaaaacatatgcacgagcaattaaatccaagagagccatagttaaaggggaattacatccatgcgtaaagtctcatattcaaattcatattatacagagacaaaaaaacaaaattatatactctcaaaactatcataatttttatcatgtttgttatggctaaaatataatgaatttgaggttaagactttacacatatgtgccatattattggaagtacttgtataattttattttagattttttcgggtgaaatttgttaattagagtatacggtgtgtatacgagaagagacttgtgtgtacatgatatgttccctagttaaagtatccatgtattgtcaaactactaattaagctatctagaatattgtatatgatcaattaacaacatgccattgaaatttcacgcaatctcttgctcctgaacttttataagatctctcacacatccatttcattagttgatcattagttaattgttagttttatattttttaaagaaatggccatatttcccttggcatattattactaaaagtttgacaatttaccgaatatgtagttttgggtttaaaaaagttagggcaaaattacataatatggaagtaatttcattgaaatttcaaaaacttgtgaaactctgcatcaaatcaaatttgaaatgtattttttaatgaacaatattcagtttgaaaattgtcaattttgtcatagccatgtactctctctgttttaattaattgacatgtcgttctaaaaaaatctaacaataaattagtagttggcaaattacattgctaccctcgttaattatttcctaatcatctttctatatatatatatatatacatatatatatatatatatatatatatatatatatatatatatatatatatatatatatatatatattgatgaaggatagtagggaatatagatctctagaaatgttttcaagtgtgatcagaacgacaaaaacgttttgacacgaattagaacgaagagagtattcgtcactgtcatttcatgcaatttttttcaaaaattatttaatatttgaaattttgtttttcttatcaagtgaaaaattttgaaattttcaaatgtattttaggcactatataaaaaaaatgaaaattgttcttttaattagaacactcaacattatgtaatacataaattagggtaatatggtcattttaggaaaaaaatgatcaactaaaggaaaggaggtgtagaaatcaacatagaagctctgcatataaaagggattcgacaaaactcaaacatataaacgaattagctaaatatttagatacaaaatgataattttctctataatgtactccctccgtcttatataagtcgttttgaatttagtcaaagtcaaactactttaaatttgactatgtttatagaaaaatatagtacaatatcaaattagtttcatcaaatcaatgatcgaatatattttcataataaatttgccttgggttaaaaatgttactttttttttacaaatttggtcaaacttgaagcagtttaactttaaccaaaattaaaacggcttataacctgaaatagagggagtatatttcttgtgtgtgcacatatatattatgttcagtaatactagtattaatttgcatgcctgtggggctgggaggggtgtaggtgacgaagaagtcgccccacacggagggagcacaagttcggccggtggcagctgcggcatcagctagctgcgtggtgccacctttaactgcaagcacctccgtatcgagaacactaatcaccttactcccagacatgagattagctacttttggtcggtgtgctctagtcagttacagaggtcgtgaaactcttgctgcttttggatggtttgaatcgattggtcctactatctctcctctcatctcatggtctctatttatagacaaatatccttcccggtgatgattattaatggaccatctaacctaatttttctgttacaacaaggtgaccttttttaagattttataacattcccttctttctcacatacttatctcattgtttccatgtactattctaactttgatctctaataaccttcaataacaaatgaaacttttttaaggatacaatatactttaatgttacaaaaactttctaaagtatttataaacgcttttgaatagtaaaaagacgagtgatcaatctgagaaccatgcaattaatggagtatccgagggtggtccggtggtcctcggaccagaaaaaaaatcgccaagccaaagcccatttatggtttaaaaaaagagataaaaacaactcctatgtgtgaataaaagtgttggtcaatcggttcagctccagatatatagtagtccctcactcgtctgtgttgtttcctctcccacacgtgtgcgccgtgcggctgctggctaaagatcctagtgagtggcaacggtggagttgcggacagcaagggtgttagggctcccgagtctgcacccgacaggtcaggtccgtcaggagattaactggttgtttaggaatctttttcacccttctcacctcaccatgaatgtaatgtgtattagagattaagtatgaaaaaagatggaaataatatcgcatctctttttccgaaacatgaagcaaataagatgaagattgcttctcaatcacctccttcctaggttgtggcagaagagcacactaaaatcaatcttcttcaaacatctgtagccgagtaagcttctttaagtcaaattttatgaatcatgatgaactttcaataattatatgggtaaattctagatgtaccgtatttaataattttatataagttggactacccatgcctaaaattctagatacgtcactagaaccatataagtattttataccaaccttttttaagaacagctcgtttagagttctttaaattcaaccttactgtagttgccggaaaaaaaggaatcgacctagcaaaggtcggtcaacggtggaaaaaaaggaattaatgtagttgccggaagaagctcgccaaagagaggtctttgttgtcatcatcgctgaagggagtctacttgtctacacatttccttttctccatcggaggaaactcgctggagggaggtgaagcaagcttgccacccgctatcatcatcgcccattgggagagaaaggtggataaactgtgtgtgtgtgagagagagagagagaggtggagagagataaagaaatgggttgggctgctgggctgtcgagagtattcgcaaggcactaacgctcacccaacatacccacccgtgggccattagttcctgttaacaaatggaaaaaaaatatccacttttgttcatagccgggtttagaggctcttgtaactattaaaacggtaataccaggtcaattctcacctcactagaagaaaactgtaaaactgggtcaattcacctcacttggtagcctacacgaaggtttcatcatcctagcacctacatggcacgttgacctagtcttcatccaatgtgaagcctacgtgatgcaaacattgcattaaaaatgtaaataaaaaataaaaaaataattaaaaactagtgaacccatagctctcataaaaaaacagtgggaccccataagacccgtacgtactacctctaacacatccattagtcacgatgatggctttcttaaaattaagggaggatgttgagcccatggcttatcaagttatttcttttaagtatgttgaaaattgttacaaggtaacaaataaagatgatggctttcttaaaataaggggaggatgatgagcccatggcttatcaagttatttcttttaagcttgtaacaattaactattctatgcagtttggttcattttttttgatttaaaggaaaacaagatgaaggtaggaggagccttggctacttctgctactatgccatgcatgttttttttttagaattacacagtacaacgcaaacactcacaacgcacgcacactcacccctataaactcatgcacgtaaaccctacccttatgagcatcttccaagactgggccggcaaatcttgtagattgacgaagtcaccacagacgcctcactgtcgacgggtacgtcgcctaccagtgaaagcataatgccgttaaatcccggaaaattcgtttcccatggggagtcgaacttaggatctaaggtgctactaaggctcttataaccactggctacatgctcttttgctatgccatgcatgttgataattcatggctctaatttatataagaataaagaagaggagaccaagacaaagaagaaaatagtagatcgaggatgtgttttgtatttaagttggttccaatcacataccaacgaatcagctatggtcctagagttattgagtacaaataatgtgattagctatgctgtcgcaattttttattggtaatcattgttcaagtcattaggcaattaaccaatcattgtttggtccaattatattttcgttcatcgttgtcatcatccgctatatttcagagttctaatctatacctaatttaaaaatgcgtaaaacttttgagatgatttttcgtccatcattgtcatcatctgctacacgattttttttttcaagtgaaacagactgaactctagtgttcgctagttttcgagttcgatacgaagcggatttgctcagatttttgggaaaatggaaggagaaggagatgaggatagaaacccctcaattaattttagatttatgtccaaggatgctgttggattttacaaaggaggcggcttcaagcggcatcgggcagctgagggagtttgaacggagacaggggataacactgtagcgatgggcccacgtgagatgagaggaggagcaggaggacgcctattagactttcggttgcttgttgggccggacgtatgcttgtgggctgaggtaggggggggggaagggaggaaaacaggccagctaggctgcgggctgagaaaggaaatgggctgaaaatagcccagagagaaaggaaggttttatttagatatttatttaaataaatactgaaatgatgtttgtactactaaaattagcaactaacctttgaaaattccaagaaaatttcagatagtgtaattaatcatggataatttaagaaaaaataaatccagccatgtaattttatgtatcacacttactttactttacttgtaaattaatttaattctacacctacctacttagaaatacctaagtattccgaaaattttgtttttaattaattacataatgtaaatatttctcatatttctcgtcttttcttcccgttgcaatacacatgtaatttttcttgtttgtgtaagaataaagaagagaaggagaccaagacagaagcaaagtgtacaggatgtgttttctattttagttggtcccatccatataccgacgaatcggccaggtccatttttattggtaatcatcgttgaagtgtatctctctctcttcctctcctccaagcgggagcgggagctggtgccgccgccgccgccgctaatgacgatgaggaggtggccgggagcggctccatcgatccccatcaccgcccggcgctgcaacacttttgcgctcagccccctccacttcacagcacatctcatatacctccttcttgctatagtgacactcgaataaaaaaaatccctaaatccttcttccctctcaatttttctccttacaggtatagaaaatagagctccaattagcaattgccattggtctgcgctccacgatgaccttatccttgcaccacatgcacttgatcattggtaccttgttccggcgactgcaagatgagaacgagcatggagaatccatggggatgccgagcatgcaagccacactacgccgcctcccgccgctacttgggccgcaccgtgccacggctatcctcgtcgcactgcgacaccttctgctataatctcgctgcctaggcgaccatagctgctacctcgcaactcccgtcactaaacttgcaatcgaaaccttagccgatttgaggatatttggggggattcgggtcggaatgcactggtcaggacaagttatgtaagaaggtatatgcagagggggcggagcgtaaaagggttgcctatgtggcgcgccatgttagcggttaaacgcagtcaaaggatgattggactataaggatggtacattaaaccaagttcatggatctaaacgtgtaattttcaagtttactgatctaagtaacatcaccacataagtttaggaatttaccatatatttcacttaataccaaatattggtgtctctatgaaacatgtccatcttttcacttatacatatgcttaccaagcaaattctactacaccgttttaaattagtagtcgctttgactttttttttcttgtaacgtttgaccattcgtcttatttgaaaaattagtgcaaatataaaaacggagaagtcatacttaaaatacttttgataataaagcaaatcacaaaaaaataagtaataattctatattttttgaataagacgaaagatcaaaattacaaacaacaactcaaagcgttctgggacggaggtaatataaaataaatcacgataaaaaaaaacaaaatcaatttaaaaataaataatgataaaaacccataaaattaacttcaaatttaaatttaaacctacaaagataaatataagacaaactgtatgataaggttaaaatgtctcaacgtcgtgcgattaatttcgcagctgtcgtgctaggcgtacgtgtgcaactccgtatgattaatactccctctgtttttaatatcttttaagatatgtttgaatatttatcttatttagaaaatttatataattataattaattttatggcctttctttattgtcaaatgttctttaagcatgtcttaaaagtttttatatttacacgaaaattttaaataacatgaatggttaaaacgtttatcaaaaaattaaatcaacagcgacgtgtattgaaaacggaggtaatagtacgtaagaagaaataagtataaccatatatagtactccctccgtcctaaaatatttgacgccgttgactttttaaaaaatatttgactgtacgtcttatttaaaaaatttaagtaattattaattcttttcctatcatttgatttattgttaaatatatttttatgtatacatatagttttacatattttataaaagtttttgaataagatgagcggttaaacatgtttaaaaaagtcaacggcgtcaaatatttacggaaggagggagtacttgctaatataaatgattagacaagaacttcagtactgaggttagctttagatattttctttacgaacaagaaaacgaatgaagtgactagtaataagtacttgtgtgggccttgcggctgcttagcgagcccggtcatagttcaagcatgcatgacattaacatagacgcatactccctccgtccaaagcaaacctgggttttcgtgtttaattttgactgtccattttatataaattttttttataattcgtatttttattgttgttggatgataaaatatgattaatattttatgcgcgacttatctttttaattttttttaatttttttaaataagacagatggtcaaatattgggcacggaaaccagggtttgtcttttttttttggactgagggagtatataggacgtgattactgctgtacgtgcttgttcagttcacgtctaagtcaaaatttgtacatacagctttcttcttttcatttcgcttttaacttcagactatgcttgcacggctgcttgtttttgttcttcctgctattaaatacttcatccgtcccaaaataattttatttttcatcaacttacttgtctcaaaataaaatcaatcctaaaacaaccattgtattaaagtttatagaagtgaaggacaaatacattatgatgtgttaattaaagtgaagaaaaagtacatcaggatttgtagttaaagtggatgacattttaatccttttgcttttgtgttgtattggtattgtttgtgatgagtgaaaatgaaattattttgagctaaaaagtagtactactatcagccaactttgactggcctttcgggtaaaagataaaaaaaaaagacaaatacggacaaaggtccatcagagtgagtcttggcgcaacatcctggtagcacaacacatgcatgcatcatttcattttcatggctgcgatgatacccaattgcagttaccgtacgacataacggaagaaaagatcgagaaaaactaaagaaccatcaatgtcgggagtacacgatagctatagctagcaaggccaacctgcaactttagcgtgctaactactccttaaagaggtacgtgccttctaatattcaaaacaaattaactttaaaactgtaaactgcatgattatataaactaggaaggttctacgcggctactttatttatttaatgttggttgaatttttattacaaatatttatgtggttgatttttcctcttgaaatattaattcattaactctattctaaacatgttttcacccataatttgtttggggctaatttgtatgttggttatttcatcaataatttgtttggggttaatttgtatgttggttatgaatttcctgtagttacttttgcaaaaaaaaatttctaaattaaattattgtgtcacaacaattgagttggttactacttcctccgtcccagaatataagcatttttagcatagtaacaagttaaacattttttactttggccattaataacaaaaaaaatcaatcatgtaaaatcgatgttattagatttatcattacaaactattataatatgcaactctttttatttaaaacatcttatttttatagatattgttggttaaagtagcatctcggatactatgtaaggaactaaaaaatacttatattttgagacggagggagtataaaactatcatttgtgcttatgtgtatatctttttttgaatatttagcatatcttaattctagagtttctgacttagtaacatttttttttgtctttatggactttaggagatattaattgaagataatttctgttgaaaaattttataaataggaaaatttcatctaattaaaaacaaacttctatttacttatattctctcctttttatatgctttcttattttctttgaaaaaaatgaatttaaacagaaataagaccaaagtttaagtgtagatatatcacttcaaaatgtttcatcttcatagactacagtacacgtttgttagggatcgattattattatagtattattttattgcatgaattctcatatataaatacaatatgatttgtgttccctaattaagcaaacttagtgtggaatactacatatcttgcctatttaatagaaatcatggaggaacaaacatgacgtgtactccctatgttcttttacttattatttagtacattaatatcagtttggtatgctttgtgttccctaattaaccaagcttagtatgaaatactcacgtaccatgcatatttaatagaaaccaaagagggaaaaacatgatgtgtacttgccctttgttcttttatttattatttaacacattaatatagcctccaaaatatagaacttatacatggtgttaaatagtaatggtactttaggttaaccccgtatgggccgagtagactggaccctactgttgatgtgaaaacacgtggcctgagagatctgcttaactccagtataggtccaaaacttgtctttgggtatgctagcgtgccagttgatttgattctacaatcaacaagaaacaaagacaaagaaaccgcggttaaatccataaacgatagccaatcggctagatgccgatgacatatcatttatctttgagccgatatcatatatgcatcgatcgacaatcgttgataagtaagaaagaactaaatctactcgatcggctgtagatattaacgatatatagtccgtatatcgatatatacttaaatcaagtgattgggatagatcggtcgccatgccgagacaatataaatcatttagatcgaaatatatattaataatgagactatatatatttatagcatagccgatcagatagatctagcatgtatcggctaatacttcgataccactctatattgagatattgaaacaagtagaatatatcaaacaagggcctaatatacttaagtgcaacaagatcttaacataaagggcagatttaacatgtcaatcgagcatataagataaatgtagttaaattagataagatcggctgaaaccccgatactaccctaatcagcaaccaagaagcaggctagagattgagattctaatcaggactcataagatcaaactcaactgatgcagctataagtatgaaaagaaaaacaatatctagacaatcaagtcgttgtaagtatcatagagtggtggatatcctatataatctaggtcaacatcgatgtttaacctaatcggttgccctctactggcagatgttagccgattgtgggttagacaacgatattgccggagattatataagatatatgataactcaacgaattacataaacaagattagagtatcataaagatggaagcactaatcccgagaacgcaagccaccgtaacaagttttacctcttgttgaagatcgaaaccgatgcagttcaacccaaaagcaagaactcgtcgaaacaaaacgaaagtaaaagggtggcgatgcgccgagattgtattgaacgtgtgttagtttgactacatggggctcggggtctatttatacccgacaattacagaatatgtccatatcggacacgattcttatctctaacaaactctaagataccataagtctttgaggcagacttttgcctaaacatttttctaagaaaattacataaaatatcctaattaatagatacaattgccttctcaggattctatccatgcgtggcaatcatcatgaaacacatcaaactaaaccgacaacatatgccgcttcatattgtcggattcggctcaatcggctaacctcgtccaactcgaactctgccgatcttagtcgtagccgattcggacttcagccgatccttactctgtttctgggacgattccatctcgaattccatctcggtttcttcttcaccttcgatacttagattaccaaatttggttgttaacacctacatggtaagcatacttatatgatgatataatccatattcctagttttttcatgatttttcataattctcgtataccatgcaaagtgtcaagctaagataggacatgttacttgttcacattataaatctaatttggttttctttaaaaaaaattctaatttagtcgtgcatatttgtgaatttataatgtgtatatagcgatatactatatattatcatctttttcataattttgacgtctgtttggattgcatgaaaaaaaataggacctaaaatagtaatatagtcgtgaatatttgtgagctaataaaaaacttttgaaaaaaaatgtactacttgtatagttttggaacccattaatttagtatagctatgattaagaagtcgtcactagattgaacccacatcatctctcttttctttgacatcgatgatgcttttgctatttagattatcacgtgatctttctagcctacgtgagtcttctaattaaggttcaactaaaataactccaaacaagttgtactaataaaacttatactcatatccctatataagtgatacgctatggccgggcctcctttgtttgagattatgatagcttataaaaaaaggggcgaggtcaaaacaaatagatttgtttttttatgaaaatcgatgcacaatggcgacacgaatttaacgtgaaaaacccttgcgataaaaaagccacgggcaccgatcgggaaattatcaatataggggagttggatacaaacgcatggaatatattgggctatcacaccctccctgtacggcttacaagggatatatataggagaaagtaggagtcccaatagagtaataggaaactaatcctataataaaaagttctattagaaaactaatccgaatatattgtgggcccaaaattcggataacatatttaacaatctccaccttgatacgaatttcccttatatcataaaaatcttcaatctccaaacaacctcgtgatgataaaatcaatgtgcgccaaatagtcacttggactataattcataacacccttgatccagatgaggtagaccatgcttcaaactcgccattggaaatatataactcctgaatctgttggtataagcctgtgtgcaccaaacatatacgcgaaaactgatgcacaaccaaactcgtcatgggcataaaatcctgaatctgctgcatgaatttatgtaatcctagcagaaatgcgaaactcttgcgctcaaaatgaaatacttagatctccttattaaccttctggtacactgggcaaacggaagtagcaattccgccggaaattttaccacacacacgtgatctggacatgaaccttctggttccctctcgacgacttcgcttgtatgtcctgaaactgatagactggtgtacgatggtattagtttctcctcctcgcggtaaataccccactttaaaacatcacttgccataattagaatattgcatctcaattcacgagcgatagatcaaacctcaaactcgccttgggaataaaatcctgaatccgttggtataatttgtggaaccttagcagaaacgcgaaacactctgggtgtataaaacgaattatttaatctccatagaaaacctcctggtaaactggcgtgtgagcgtagcaaaaactgaacttgaatttattcccctgaacagaaccgaagtaatgcagatgaattgatccctgtatgaaggacgtatgcacgcagcgaaaaaccaacgtgaattttaattcacgtgaacagggagtcaggtccctcacttgccccctactttttctcgatatgcgtgcactaagatgatcatcgatggcttcaaccctgatgatgccctgcttttttttcacatcgagacccgtgtgcagcttttcctctccctgacgcatgcgctagctgctgcagagatgagaacgacgtgatgcaacttcgcgcgacgaacgcgatggcagccggacagcaaatgatctcaccgaacaggtcgaaattgaattgtcgaggacgatgaacagatcggccgacggctgcgtgaacagatcgcatctccaatgtttttgatatgacttgttatatagtaaaattgatgtacaatatagacacgtatttaacatgaaaaatccttacggaaaaaaattacggacgctgaccggcaatgatcaatataaagaagttggatagaaatgcaggagacactttgggttgtcgcaccctcctgtatgcggtgtacagggatatatataggagaaaactacagtagaagtcctgatagaaaaaactcgaagtcctaataagaaactaatcctataatacaaagtcgtattagaaaactaatctgaatcaattttgctatatatttatcaacaaattttctcccaaaaatttgacagatgtaattacagtacaatagtagtgtaattacactgtaacttatatataaatttcaaaaatctacctgtaacatgttatttcggtaaaatgaaggtcatgggaacaaatcctctcacatatatatgtgtgtgctgtgattttttatcttcctcaccagaacaaatcttgtaatagatctaacgattcaaaattatgtgaaacttacatacaagttacacagtatttacatgtaggttacaatgtaattaaactacgattgtactataattacatctgtcaaatttttagaagaaaatttgttgacaaatgtataggtgatctcaatccgaatatatcgtgggcctaaaattcggatcacatatttaacaattttttatttgccttttattttttaaatcataaactactcttgtgctatcaagttaaagactaggtttaagtaattttttaaagcttttgtggattagagttgagactttatgtttaaacttgaggacacccgcttatctctactattataaaaataaaatatgtttttactagtattttagtacgtcattcttgtttgcggttttaagtttgttcgcttttggaaatacatatccgtgtttgaatcagattttaaattcatttgcttttggaaatacgaaaggagttgtataagaaatcttttttaaaaaaacttgcataactaatttgagttgaaaatcggactcataattgcagctcatgattattaaaaaaaatatccaagcgaattcccataatgaatttcacaatagctaaaccgtatagcaataataagattgaaatagcattaattcacccgttgcaatgcacgggtatcttttctattaaaccataaaaatcaaaaaatcaacttaaaactctatgccaatataatgatctaaacccaaacaaaaatagccaactaattaatttttttaatgaaaagaaaaggagcgtctttatagtccagcacatagtaccgctcggtaccggtacgcatcgagccgttcattccggcatgggtaggatcgggagagaaaaatgtgctcggtatcgttccacagccgcgcgtgcgtggtgcgcccccaatccttcatcccccgacgcgtgcgccctgtccggcatggactccgcctccgccgtttagatcgaagtctcggcgctagaggaagaacatggcaacggcggcagaggaaaacggtagcggcgtaagtgggacatggcggcggtggcagaggaaaacggcgacggcggcagcagcggaagaggaacacgacggcagcggcagaggaagaggaacacggcagcggcggcggcggcggtagaggaaaacgaacacagcggcggcgaaaagcaaccagcgctggtgcaaccaaaattctagggttcgagctagctaaccatcaactcttcccgatccatccctccagaaccatccatcgcacgcaaagttactcttttacccttctaactctcttctctctgcggtgctgtctcagggacaattttgatacctcgtggtaccacgcaataccagctgttggatctgaccagatccaacggctagcatttggtaccgcacggtacagctggaccgtaaaaaaactcaaagaaaaattaaatccgccacatgcatgcatgtatgaggttcgatcgtatgctaggtgacccgtaggccatagctacacgggtcctagaggggtgctcgtctataaatagagaagatgggagaggtactgaccatatccaattagtagcaagctactctaattgacaacttctgtaaactagcggtcgcgaacgagctcgatcaaccaacgataacatgtctgggagcagtgttctcgcgacggaggtgcttgctgttaatggaggctcctcgccgttggctgccgctgccgtcgtcaccacaggcccattgttgcaaggttttgcgccgtccgtgtggggcgacttcttcatcacctacgccccttccaactcacaggcatgcagattaaacagtactgtgcatatatatatatacttaggtcttatttaaggagcttctagcatctgcagtttgtatcataatcttcaactctcttaaatattctcgtcctactttatagaatccagaaaataaggtacaaaccaaaaccagggtttacctggaaaaccatttttacggttcctcgtaagctaactattacacagatcgaccagctgcttatcagaaatgggcagccttagacacaaatagtgaaatagaaccatacacacacatgcataccgtatttatttacgtgtgtgtgctttgcttaattgtacagggcaggggcttaaattaattatctgtgtactctcgatcatgtgcgtgtggtgcagaggtcagaggagtgcaggagagaacgagcggaagctctaaaggggcaagtgcgccgcaagctgttgaaggccacgagccgcatcagcagcgtggccgagacggtggtgctagtcgacacgctggaacgcctcggcatagacaaccacttccgccacgagatcgcggcgatgctacaccgtgtgcacagcgaggagcacggcggcggcggcggtgctgccggctccgatgtcgccgacgacgaccttcacgttacttccctccgattccggctgcttcgccagcacggcttggggatatctgcaggtacagttaggctgtgttctttcccctgttttcccaacccatcactcccgttttacgcgtgcacgttttttaaactgctaaacggcgtgatttatgcaaaaactttctatatgaaagttgcttaaaaaattatattaatccatttttttaaaaaaataattaatacttaattaatcatgcaataaaataaactttgttttgcgtgtcagggacaacccctcctccgaacacagccttagggtggtaatggacccaacattttgacctacaaaatgtgaggtcaaaatgagtctaaaatgagttgggctaaaatttagtagttttttatgctaaaaatatttaagagttgagatgggttgtgaaaaaacccacgagtcttgaccccacccctaggtaatcatatctgcgtatcttcataattgaaaactgattaattaaacatttcaaggcaactcccacgtaaaaacattgattaggtggataatgtaggtgggaatttaaatttagtttttttcccaaaattgattggtagtttttgttaatatatttcgaaaaaattgaaatacatttttttaaatacgtttactaattatattttggaaaactaaagctggctcttagtttttatatatttgtaaatatataaaaaaataacatgatccccaccaaaatactttgaataataacatgatccccaccaaaatactttgaataacatgatccccacttcaaaatttatttaacactctattaatatttaatgctaaaatttaaaatttagtaattagctagttatgagactaaattttgtaagagttggaattttattaatttaattctaaattttaagattaatactagtagttagacagagagttactttttttttgcaattcaaaaaactacccgtgtattcaacatattattgaacttatactacctaaaattatatcgataataatacagctaccgcaaagcacaggttaacgactagctggtatatatctaatttgaactctgaatatataaatatacacacacatacattttactggtctgctcacaacaaaatatgtacattttactgatagaaaatattaattcatgcattgcaaaagatgtgttcgacaagttcagagacaacgggggcagtttcagagcaagcctaagcagtgacacgaggggtcttctaagtctgtacaacgcggctcacctggccatgcccggcgaggaggtgctcgacgacgccatcgcgttctcgaggcgccacctacggtccatgaaaaccgcaggcaagctgaggtcgccgatggccgagcaggtctcccgcgccctcgacatccctctcccgcggacgcccaggcggctggaggcgatgcgctacatccacgagtacggcgatgagccgggttttgacggcgtggtgctggagctcgcgaggctggactttgagctcgtgaagtctcttcacctaagggagctcaaggccctcaccctgtaagttttcacgttttcgcttcctgtgatctcagctgcttacttaaatatccctgctaaagaagtacaactatttttttcttcatatagctagcaagctgttgtttgtgttttccgttaattgactgacagcctactctcaaatatatatgtacccctctctgttgtgaactccattttgtctaaattaatatttgactgcacctttgccccgtctagctagctaaaaacaattaaattttcagcttttctgtttatcagccatggttttcttttcttatttatctgtcacctggagtagcttgcaaattgcttatcctaaacttgcagaattcacaagttacaacttgaagtatgtcgcattagaccaacttaagctagtttcgtttcgttcgtatatttttttttggattactctagatatgtttttatgctttattttgccttctcttgtattggcatgtgtcaacatcaatgtataacttccaattccatgatagagcatagcttgctttgccactattgaaaaaatagctagcgatactgttgttagatgttgttctaatgaatgagaaaaaaaatcaaccattttggcaaataagtgtcccaaacttttccagtataaacaaatggattcaagcatggtcaattgattggtacatacaggtggtggaaagacttttacgacaatgtaaagctgagctacacccgagaccgtatagcagaggtcttcttctgggttagcggagtgtactacgaggagaaatactctcgcgcacgtattatgcttgctaaggttttcggattgataaccctaatggatgacacttatgatgtccaagacaccttggacgagtgttgtaggttcaatgaaacaatacagaggtagaaattagtaatgacctatttgtttattttgtcaaaatgaactatctgagctgagctaactactcaatccttataaatatgcagatgggacaacggagcagtttctattctaccagaatatatgcatgcatattacataaagttgctaagcaactttgacgagatggagaatagcttagaaccaaatgagaaacaccgtgtgtcttacgccataactatggtaaaatctttttacatatactgacgtatttttagcttgcctgtaaaaggaaaggggtgtccatgaaaatattttttatagtgatccagagtcaagatacttaaatatagaactagtcaattattaagagaagaagatacaccctagataatatagagagtatcgatcgatctattatgagaggagcaccgaatcatatataacttctaattataaatttagaatgaaactggttagatacttaaatagagagtcaagatatatagatataccttagtgtatactgactttataaatttattatttgtcaagaaaagtaaaaataacactgctaattatgttgacaaaatttctgaattttaacattttttggctgtcaagcaataatcacaataatcaacaaaactattagggccagagtggtattcaatcggttggagaaaatatttttaggccatgaatatgacttgataattattaatttcatttcaaaaatttaaaattattagactataaaagcctatagttgcgactccatattcattctaactttgtatttgacaattccgaattttagaattaacttgtcaataacaaggaaaaattatgtacgtctccatgataagtagagctttgtgttcgttgttgtaaacctcaaaagtatcgaaaaatatactcccttgttgtttgttagtttagttaatgttttggatattaatgttggcgtagtcacacatgtttcatcacaatttttatccaactacggagtatatattataaaattaataaaactatagctgcatgaaagaaattttcaaataattttgacatattaatgtcattttatatatgttaagttgtaatgttttgtatgtactaaggatttaacatattgacatttgaatgcatcgtgttatatacagaacgttatattatgagacatgagccaaaaatagttgtcttatatttagaaatagagagagagtatctatttgacgaaaacatatatagttcgtagtctaaaatttgaaatataaaagtatatatacactttaccctgacgtacgttcacgtcaggtgtaattttccccaaggacacacgatcagtcaattttatttttcctcaacaagctagttactatgacgcgacattattttccttgataaataaaatatactgcagtaaaaaaaatattctattcacaataaacagagttcaaataacttatattatcttcatatgcctgcatacatgtacagtacaagcagttgtctgaatactacctccaggaggcccgatggtcgagccacaggtacctgccgagcttcgcggagcacctgtacgtgtccagcatctcgtcgggcatcccggcgctggcaccggcggtgctgatgggcgtgcacgacggtgacggcgtggcgaccaaggaggcgttggagtgggcgtgcgccatcccggacctgctcctcgccagcggcgaggtgggccgcctcctcaacgacatcgccgcctggaaggtggggaagaacaggaaggacgtgcgagcctcgtggagacctacatgacggagcacggcgcgggcggggacgcggccgtggcggcggtggcggctgcgtcggagcgcgcgtggaggcggatcaaccgcgcgtgcgtggaggcggtagaacccgcgctgctgccggccgcgcagctgctggtgaacctgacgagcaccatggaggtggtgtacctcggcggcaaggacggctacacctccggctccgggctcaagggggtcatcaccgatctcttactcggcccagtccatgacgattaggcacaacgtaatatataccctctccatttaaaaaaaaaccaatatagtacactaaaggtgataattcataataaaacaaatctaaacagaaggttatttagatttgttgtgttagaaaatatcacatctaataaattttttttttgggatagagggagtagttatttacgtgatcgacaacttgctacacgtatgtactacctagctacttcttgtgtctttaaaaaatatccaattctctttgagagagagagagagactagctcttacatagtacaaatggatgtgtacttacatactatgcgataaaacctagttaaatcgctagcatatgcttatgatagggatagtatacttgtcttccataagaaattgtcatacatggttgtgcattatgcatgccgtatatgtgtgttggcagaatccagcaagttagctctcagtctacctgtgtgtgtagtatgtgcgtgttttttttttcaaaactcggtgaactttatttgataggaaggttattacatgagtgatggaaacatctcccaaggggagattagacaggtagcctaacgtgggacaactgctagctagtatgccactatatatgaagatggattctaatctctcaggtggacgtccacccgtttcttacatgtcaactaaatgattaagaaaaaattacaagatagattaatatataatatatcacttcataaacatgtaagtttaaattcgacttctacaagttgtaataaaaatatcaaattaaactctaactagtatacgtatatgaagatggattttaatctatcgggacacaaattttggtatatctagataatagtattttgagatacctcaacagaaaacctagacaacagtatctcattggaacgggataccttttatgagatagtacctgatacctgttgtggtaccagctgtatggtacccgatacctgtgatacctgttactcggtacctgtgatacttaggacctgatacatgtcatactcatgcaagagaatagttaatatgccttatcccgttgcaacgggatcccgttctgtagcatccctcatacctcaaatactttctcaaagtacggtaaatttctcgtttctaacataagcatacataaaacaactgattacatgtacgtacatatatagtatataacatatatatgctggacaggaacgcgtacgtctatgattgctgtgcctgattaaacgcgaagggggtcgaggaagagggcggtgacgagacccttgaggtcggcgccgacggtgtagccgtccctgccgccgaagtagatgacctccggtgtcgtcgcaaggttcaccaacagccgcgccgccggcagcaggttgggatccatctcgacgcacgccctgttgatcgtcctccacgcgctctccaccagcgcggccaccgccgccacggcctcctccccgcccacgccgcgctccgccatgtagcactcgatcgtgctcgccgcgtccttgccgctcttcccggtcttgtaggaggcgatgtcgttgaggaagcgggtgacctcgccgccggcgcggaccaagctgggcgcccactcggatgcctccatggacgccgccgcaccgtcgccgtcgcgtgcgcacaatagcaccaccacagccattgttgggtagccaattgacatgaaagacacgtccagatgctcggcgaagctgggcatgtgcttgtcgctcgaccattgggcctcacggaggtagtattctgactgctgcttgaactgtacatacatatattcgtgtgtaggaaaatcaatcaaaatgtgtgggtgaacgcatgaatatatcacttttactcttttagtatgtctatgttttttgccgagaaagattttaccgaagatttcacgtaagacatgcggtgcttctcatctggctccaagctgtcctccatctcatcaaagtcattgagaatccttatgtaaaagttgcgcaggtattctggtagaatagaaaccgcactcttgtcccatctacatgtgtagaaggatatattaattagactaatcagacgaggtagctacgctcgttggcaaattgataacttattactacttcagtttgacgttttaagatgttttggattttaaatatatttatacatagatctatgtacgtgcttaatatatgtgtttaaatttatatagatattaataaacctacataagagatgaatagaacaaaacgtcttataatataaagagatggaatagttaatttctacctctgtacagcttcgttaaacttataacactcctccaaggtggcgtggatatcatagatgtcatccgtcatggtcataagttgaaacaccttagcaaatatgattcgcgcacgagagtagtcctccccgtggaacatggcacaggtccaaaagtaagactctactaggcaatctcgagcgtagcttagctgcacgctgtcataaagttgtctccaccacctgccaatcatattcgcatgcatatgtagattagaaatagatcactcatgtagctagttatattaaccgtgaagttgagttgagtaattttacgatgtcctttttttaaaaatcactagcagtaatatttctactatatatcataatcttaactgtaggtgaagcagagagagcagtaaagggcagtgaggcaagaaataattttaggttctggggaataaaaagtaataggataacttaattgattacaaggagagggccttgagctccttgaggtaaagagatctgacgagctcgaagtccagcctcgcgagctctagcaccatgccgtcgtgcgccgcctcctgctcatactcggtgatgtagtgcatcgtctccagcagcttgggcgcccgcgggagagggatgtcgagggcgcgggagacctgcttggccatgggtgacctcagtgcaccttgcagggactggaggctccgtctcgagaacgcgatggcgtcatcgagtgccgcttcaccgggcatggcgaggtgcgctgcattgtataggcttagcaggccccttgcatccgtgcttaggctctctctaaaacaacccgtgctatctttgaacttgtcgaatacatctgcatgcacaaatttctagctgtaagggtgtacatactactatatatgctccagggatttatccaattaaatgaaaggtaatgttatcaccattgaaaatgtattgggaccttcaagtagtaagtataccacaaattttaatgtgtaatttaattacctcaaggtattttttcaaaaaccataaaatttctctcaaatgaatcagagaggtggagagatgtatgtgctcaaataacatttattggttttttttcagcgtattctatttttcaacagctttttgggctgctagcaacccgactaccatgaaaatgccttctaactaattcggcaattatattcattttagatcaacatctacataacaaaatatccttctagaaaacaaagatcagaatataatttaggctacctgcagatacccagaaaccgtgctggcgaagtagacgaaatctaagggattcgaggtagagctggtcaccatcgtcaaagccagcggcagctttctgctgttcatcgtggtgaaatacatgctgtaacgctgtggcaatctcgtcacggaagtggttgtctatatggaggcgttcgagcacgtccactagcatcaccgtgtagggcacatttatggtcttcaaaattttgcagcccacctgcatctttagccgatccacccgttctctcatccactcctccgacctctaaattaaacccatgagagctatagttaaagtatcaatgtattgtcaaactactaattaagctagcaagtactatgttatatatagtcaattggttacatgtctgtgagatttcacgcatccctcctacatctctaagatttgtttgatcccttatgtgccgttgagttattctaatcccttactcgtccactccattagttacatgttagtgtgtgttttttacgaaacgaccttatttccattggcatattactaaaaaatcagtaatgttctatgtaggaattatttgcattgtgaaaaaaagtaagggataaattaccgaatatgtagtttccaaattcaaaaatttgtaaagtaatttcattcagatttcaaaaaaaaatgagtaaaatacacggccggtccttaaagttgagcgcgggtgtcacttaggtccataatcttgtaaattgcacatttaggtccaccatcttgtttaagtgactcattcaggtccaaaggacctctgaccggattgactgacttacgtggcggtccagcgtggcaacatatttacattttgtcccccatttttcttcctgtcttcctaaatctctctctctctctctctgatgcaggttggcaagtgcgcacggcgaggcgtcggtggcgaccggcgaattgctacgcggaggggcgggcggcgcatggggacggccccgctgccctcccacgcggcgtcgccgactctgcccttccgctccgagcctccgagactccatcgctgccatcgcgcccgagctcgtcattgtcgtcttcaacctgggtgtgcagaggatggcgttggcagcacgagagaggaggcgtcggtgggggacgggagaggaggcatcgttggcgagcggcgagagaggaggcgtcggtggcaggcggcgagagaggaggcgtcggtggcagggagatccggtggccgccgtcggcgccggcgacgtgcgccgggtgctgcgcctctccgccatgcctgcctcgccgacgcttccgcctctccgccatggccaccgccgtgcgcgccgactgccggcccgcccccgcacttgcccaccgccgcccgcggccgtggtgcacgaagaggaagggggtggccggtggtgagcgtgtgtggagaaggagggggtggccagtggcgaacgcgtgcggagagggaggaggcggagaggcgttttgctcggcctagtcgtttcccgtgcaccaccgctgctgccactcgcacgtgtgtcatgctagtatgccgcttgctactggcgctcgcgacgccgtcggtagcggcggcggcgcggcatgactatggcgaaggatttggggatatttgtgctgtccatggcgctactgttgcggaggggtttgtttgcaaaattgatgcttgcgtggcgtgccacgtcgacggtcagagttggtcaagtggggtttggacctcaacgagtcacttaaacaagatggtggatctagatttgcaatttacaagattattgacctaagtgacacccgcgctcaactttaaggaccggccatgtattttactcaaaatgagtttatgaaactttgcatcgaatttgaaatgtaattttgtgaatgaatatgcagtttgaaaattgtcgattttctcataaccatgtactgtctcggtttcaatttacctatcattccagcaaatctcatactaaactaggaggtgtgctaaattacattgctatccattaattagtacatcttgatcatcttttccaaagcaaggagaaaatatttttatggacagtcccagctccaccttccatctcagcaagtttctatggaattaaaaatgctatcatgtaagaaaaaaataacttgacaagagagttaatgaagataaaaaaaaaatgaaaaacacgttgctcaaggaagaaaccagctctacgtagaaattaagaacgaagacaagaggatatggagatgatcgaaaggagatagaaaagacgtgactggatgagaatttattttccacccactcggtatatagtttttatatttagtgtctatatattatgattatgattatgattatgattatgattatagtgtggatgggaactatctaatagttttgattaggatttccggcaatgagaagtactagtattagtacgaacgtattgatgaagggtaagaaggatacgcatctctaagaatgctttggaatatgagaacaagaagtatatattttgacgtaaatttaagctggtattcacctaattctgtcattattatcacttcatgattttttttaaaacttgtttaatatttaatttcttgtttttcttataaagtgcacaatttgaaaatttttaattgtattttagccattcatatcttttttcaaaaactgaaaattgttttttacttagagcggttttcgtcctgtaatacataaattagggcaatatgattattttaggaaaaaaataatgatcaactgaaaaaatgaacgtgtagggattgatatatagaaactctatggtatcttatatgtctataaaattcatttctactaagtgtagtataagtgtatagtataagtgtagtgtatgttatttttataagcaattttacagtcattgaggaggtactatgagataccaaattttatactaattttttgtacctcatagtaactaagtaccgatcaactgaaaaaatgaacgtgtagggattgatatatagaaactctatggtatcttatatgtctataaaattcatttctactaagtgtagtataagtgtagtgtatgttatttttatgaacaattttacggtcattgagtaagtaacaagagttaccaaatttataatagaaaaagtggtacctcatggtaccttctcaaggactataaaatttttatcctctcattaagtcacattatctcaattatttctagcccttggataattgatcaatggtctaaacctccttttcttttcttataaagtcatatcactttagttttgtctttggataattaatccatattatctctcttctttttcttctcttactgagccgcatcacatttgttttgcgtttaaatgatcaatctatatatgatttaaattagtacaaatcacatcatcttaattgtttatatatagcttcgataaaagatgaaaattatataaagtatataaagttatgttatctagctatatatcttcatctcaactgtttatagtctttcattcaaatagtcgatcaaagatgaaaattatataaagttatatcattaaaatatcttgcatgttattatacaaaacttccgtatcaaccgcgcggggtttcatctagtatattataaaagggatgagccaaaactcaaaagacatcgaaggggtaactaaatatttttttggtgcattcagagaatatctgatctctatatcatatacatatatgtgtgtaacaatatactagtatattgtttaataataataattaattaatttgcatgcctgtggtttgggaggaatgtaagtgacgaagaagtcgccccacacggacggcgaacaagctcggccggtggtggcagcggcagccggctgcgtcatggtgccacctttaacagcgagcaccttcgtatcgagaacactaatcaccttgctcccagacatgtcccggtctaagctacctagtaattaagttacagaggaggctgtgaccttgctacttgggtagtggatggtctatctctcatggtctctatttataaacaaccaccctccccggatgacgattattgggtcacctcacctaacctaatttttctattaaaagaaggtgacctttctgtttgattaattttgtagtactatctccccatttaatacttacctcattgttttgatgcgctattctagcttatctttgacccctaataactttaaaatgcaatggctagactataacgaacggaaccttgtttaggatgcaatattctttaatattattataacatctttttaaagcatttatatagcgtttttgaaaagaaaaaaaaagagacgagtggtcaatttgagaaccaagggagttttacagaaactttaattttttgttgtagtggtcgtacaggaagcaactgacaaagtatcgtaaatacacatattataaccattgcaaatttaaacttatcacatatttatatatacacatttatttatttaattttcttataactatttaattaggtgacatgaaatgaaaggacatttcattggagaagaaaaattaaggagccatcttcaaacactacgtctgtatcgatcgggccacgcggcacacacccatgacccatcagaaccgtcagggatgtatgtgtcactctgtccatgctaaaattagatgtttggttgaaattagaacgatgtgatggaaaaattaaaagtttatgtgagtagaaaattttgatataatgaaaaaagttaaaagttttaaaaaaaatttaggatctaaacacaaacacggtgtcacttgatttctcgtaatatctcctcactcagcgctagcgtcgaggcctatgtatcatacatcagcctatttacgagccttcgttattacatgcatccgccgttccaccgtcagctactgactacccggcggcggcggccgccggcggctagtgaaaaatatttttgattgttttttttttgctactgtagcgtttaatcacgtgcattcaaaacttagatccaacggatataaaatgcccaacggcatggtactgtagctcaactggaacggcggaggatgcgaagcccagaagatcttccaaatatgtcttaagactgtccgagagggaaggaaaagagaagattgaaagtaaggtaagctattaatacgtgattaattaagtattaattattttaaacttaaaaataaattaatatgattttttaaaacaactttctaatatattgtttttttagattgtttttttcaaaaaaaaacataccgtttaatgatttgagaagcttgcacatgaaaaaggaaatattttctcactatccgttccttccttagaatgcagcctaagttaggaattattaaataccctgagttttgaattaatgggtttaagtaaatattagaacaaacacgtaaaagtttaatttttaaaccgttgtttgaatatgcgatcaataactgtggatacgtagagctcgccgagtagtgcaaaatagactataatttataatttatagtaattgtagtccgaatgaattcctgcggattgaatcgacgtggactgattgatctcctttctaatctcttatatatacctacagacaaaaaaaaatggaaaaaaaaaagaaagatcgagagcctctcaagccctagccgccatcaccccaatcgttgctgcgccaccatcacgctgctgccctcgttgctgcctctgttgccggtcgccatcgctggtactccttcctgtcagcctgctcctacgtaccctggtggtggctgattggagcagcaggtttgattttgttttctcgattggacttttgctgttgtgtgttggactccaattcctgctgctgctaaggctgctgttgcccctgtgctggtgttccttgctgctgctggtctgccgaacatagaggagggttagaaggcagagaagaaggaagcagggagagaaggagaaattagatagaagaagggaaatttggggaatttggttgatattttcaaattcattgttttttttacaaattagtactgctaggtacttcgttttagcccctagttgtttctaatttatatataagaggatctgttttcggtagctcgaatttaatttatcggccgctaggctgaaaccatattttcaaatatggtattaaaccatcgggattcagattgattgtcctaaataaagtttgtattcatcgtcgatatctttccaacggcgctggtttcactcaattccgataaacggtttgggagaaacagcaaaaacaatactgctgaccaggtctagaaatcaagacagcaattcgttttacttaagctaggatttacagaggcataatctgatttttggcccaacatgaaagttgtagattattttctgtaaatgcttgaagtgctattatttactagattccgttagatggtttgcgagttacgtataaaacagtaatggaactgctataggttatttaatacaaatcggtaaaagtttatatgttattggtttcgattttagtaaatatcctttgtaactattattagttgaatatagtggtttatttatagttttgctccatgggtgtggagagatctggtgtggagggtggttcatcgcattaccgtcaaggttaaaggcaagtgcatgacgaactaagtgtataattcatggattgtttgttctatctatttatttccgatatatttctatgtgataagtgactgtttatgttcagattgttgttcacactatttagatttcgagttcatcttatatttacgatgttattcttgtttcaatatttcggattctggttctggttaaataattcaagttccatgcttgatatggatgtgcaatatgtttttaatttggttctttgttttcgacttcaattattcatgttccatgcgagcatggatgtgctatctggttttctattcatgttcctgtggataagcgttgatcacgcttactcggctttgccgacaaatgctagaatatgttcactattgtctgggatgaaaactattatttcaattcatacctgcccgagatgggaactactatcttttttgacttggtgtttgaaaatgtctttcttatcaaaaaaaaagaaagctttctgtttatgctttattatcaatgatgtgtatatgtgttttctagttccatattatacttgctgaatattttcgtactcactcttgtatttattcggttttaggtacacattaaggtcgggtatgcatgagcgggaagtagcacccttgtatacatacctatgtgcacactatcaaactataatgtttaggtccataataatacttagaccatatcttggtttggttttctaataatccagatacctattagtttctttccatgggttatatggatgaatcacattgtggaaatgatattattattagttcaatttataattgtttgtcgtggatatctatatttataaaggagaatctgccgaaatttctaataattttgggagttagtgattttaagtgtattttggtgtgacactctatgtacttgattttaagtgtattttgatgtgacactctaggtacgtggttatttggggtgttacaaattaagaaggatttaaaagtaagcagtatcgtctaacactgcaggagataattggatcggagggctgaacaatttcgtcttgtataagcagagttcagcatcatggaatgccaaaataattcgtgggagatagaaaaaagacaaaatttactacatgaaacccaaagtttacgttttttttttcggagaacacaagaacgcatttctgctagttgaatcagaaaacaataataattagttggtggacacctattgtattattttattatatctgaaaaaaaaacagataaacattagttaaataaaaatttacccataggctcgagctcacttgcgaatcccacatgtcctccctatctctcttcgtcttcttcctcatggtgctgcctttctcgtgcgtgctagacccgttaaacgatcgtcttcgtcctagcttgtcctccgctggcgtacgtgtgcaactctgtatgattaatactatcttcgttataaaatataataggagtaacttttagctataaatctgaatagacagttgttcagatttataaccaaaaatgcttatattttggaattgagggagtagtatgtaataagaaattattagataagaacttcagtactgaggttagctttagatatatattttttacgaacaagaaaacgacttcagtgactaataagtagaattaggtaagcctaattgttccagcggacgtgacgtccaggcgaaaaaaggacgacctactttgtgtgggccttgtggccttgtctactttccttcaaattttcaatttttccatcacatcacatgtttagacatatgcatggagtattaaatgtgaacgaaaaaaaccaattgcacagtttgcatgtaaattgcgagacgaatcttttaagcctaattacaccatgatttgacaatgtggtgctacagtaaatatttgctaatgacggattaattaggcttaatagatttgtctcgcactttacaggcagaatctgtaatttgttttattattagtctacatttaatacttgaaatgtgtgtatatatacgttaaaatgtttttatcaaaacaactaaacatggccataatccaaacatgcatgacattaacatagacaccggtcctaggacgagattgctgctgtacgtagtcgatcaggtgacgtgcaagtcaaaatttgtattgtactcagtataagaagtttccagagttgaacataatttatctatctatctattatatactaaaagtctattaaactcttttaaaatactcttaaaccgccatgtgacatctcaaaacgttctcaagctaccacatatcattttaataaaataaaaaaaatcctaaaaaatttgattaaaaagaaaaatatctagccctctgttttcatttaaattgttggtccattatctcagaccattagattagatatactgatctctttgtgaaaaaaaaatctggattggaaggggtaatagatgaagttctagctttgtgggcaagactgtcagcatgcttatttgcttgtgttggtaatcatctgatggtgggccgcttcgttgtgccggccggcgtctgtccccttgcgccgtcgagtaggccgaatttcttctctcggcctatgaaccaaagaccatcttccctcctcccattctagccggccgtggaataagtccacgtgtgcccttggccccacttgtcagtgacacgcaaagaatatacttttcaagaaaatcaataaatcatttctcattgtttcaaaaaaaatcaattaatcttagaaaatccatctcttgttttgtagcttcaattgactttgttccacttccagtagttagtctaaatatgatcattttcatgcgttggtttttgtttgtttgtcatgctttgtcgaaaattagttaagctcaagatcccgaggaacgcaagtcgcctttgaaatctattgggggtcgtttggcaaacgtggacacttacgggccgtttggaatctattaggggatctcgagtagcggcgggagaggaggccggcggacaaggggtatctttggggaggtttctaggggctcagggagggtgggggcgagagagatcgacgggagaacggccgatggcggcaccgtgaggcgcgcaatggcggcggaagggagtacgtggaacggagagaggacggcatccttggcactgctttggggagggaaggggaggtctcgagggaggcggtggtgaggggattcgccgagaacgaggccaacggtcacgcacgaccgggcgcggcgttcggcgaaaaccggagcagcggcgagggaacgtgctcaggagctatccttgagcctccagagggcatagacctagggatatgggaatggggtgctcactggcgacaaggagcggcttcggagcgggtggcccggtggaagaaggncggccaggtttcagggatgaagattccgggtccggcatcgcgtcaaaaagcgcggcgcgcgcgatgcgtggacagcagagcccggtggcatctacgcgaatcagcggctatagagcagtcgctacggcagggcaggctggcgcggtgacgccgggctcccttccgatcagccatgacgggagcgcgcccgggaacggcaagcggcacggccaaaatagaatggcgatgacggcgcggccaaaatcgaatgacgacgaaggcgccttcctccccgtacatgcgtggcgcgtgggaggcggggttggacaggatcgagggagtggaggcggcccaggcggtagggggttgggttgggttcagagaaaaggaagggaggtgatgtaaaatgattttaatctttttttaggaattcttttaggaattttgaggagcatttgatgtgggatttgaattaaaattttatatttgaactcagagaattagagaggagtcaaggaaaataaatatggtgtgagtttgatattttcgggataagtttgtatttgaaccttcggaaagtttgagggggatttaaggggacaagaatttggatttgaaactagtttcgaatcaaaggaattactgccgggggaggatagagataaatatggtttgagttgggatcgggattcgagttttacattttaacttagtgaaatacaaggggtcaaggagagggcatcgactcgagaacgtgatattttgggatggatgtatatttggggacttgttggattattcgaaaggaattcaaaagagagaggggaaaagaggaaacttggtagcatgggttcaaggatggagtttaattggactttgcatcttggagttgaaagggatacttggagaaagggttcaaaggatagatagattggtagatagagagcgagagggggagagaggagggagggatgaaacttgagagtttgagttcgaatttgaggaatggtttgaaggaaacaaaaggcggagtttaggatttggcggtgaatcgctggatcgaattttgaagtcagatatttgacggagtttgtggatagggttttaggagagaaatccgaatatgaaaaattcgaacttccgatattatctggaacgagaattttgtggagttggttgttggcatcgatgaaggaatcaaccgatggattgaaattgagatttatggcacaacttagactctacaatcaaagaatgaaattttcgcaattagggttttcattaaattagctttttaatgccacgcgaaaaacagggtggtacacaccgccacatatgaggttcaagatagtattgttgcagtccacattgcagccttgagtattgcgatgcctagtactagacctttccactttatgtctacttaatgtagttttgttcaactttacattttgaaaggaaaaactttttgaaaggaaaaaagtgggatgctaggaaggaacttagtagtggcgtagctaggattcagagtaaaagtgatccatctatatatagtaggtcaattaaaagggtggtccactatataatttttattatattaactagtatatattgtcacctagctagctaggcctctgcattgaggggactcagtgggatgtgtaacgctctgcttctcgtgagacattaaaaactaattcggcaaaatcctaattgcgaaaatttttgttctttgtgtgagagtctaagtcgtgccatggatctcaattcaatcccgttgttccctctcatcgaaatcaaaaatcctccacctcaagatttcctatccaaaattcaagtctccgaaatcaaattccgaaagtcaatcccttcctttgaatccttgccgaatattcgctccgactaaaaaaaatatccaagtttccgttttgaatctcttccttgacttctcctcgagtctcccttgattcctccctaaaccatcgagttcgaatgtcaaatttgaattcgaatccaaaaccccaattcgaatccactccaaatcagtcttctctgcaaaagtctattttacctccctcgggtgttgtgggccgttttcccccttagcccacctccctccctcagcctcgcacgtgcgttgcacgtgccgagccgagccaagagagagctctctcgctctctctgtttctccctctatctctcgttttctctctcgcgcgccgacgccgcttcccgccgtcgccgcccaaaacccaccaccgccttcgctctttcccgcgctcgcgcgtggccgaccggccggtcgttgccgccgtcagccctgtcgcgcctgcgccacgcagccgcccggttgccgccgcgtcaagccctggcgtcgcctgcgtcgtgcactgccgctctgccgctccacgccgctagcttccaaagctaagagaggcagcccctctctcactccctctccctccttcaacttttccccgaaacagcaaggagcagagctccctttctccccctcctttttccttttgcccgaccaccatcggcgtcaccgcctgccaccgcctggactaatggcgcgaccgccggctcctccccttgaccgccctaagtcggtttcctcccccaaaaccgacttcccgcacccataaaacccaacccgagcccctccctttcctcttcgtttccttgcccaacctccaccgcaccattgttgccaccccgccctgcagtcgccctcgctgtccgtcaccgaagcaccagggagaccggtgcgtgcgtggacgcgtgacgcgggactccaggcaccctctccttccccttccccggcccgaggccggagagctcgccccgcaccgccgccgcccatcactgcgcccggctcggtagtgcctccctccgttctccttcctcgttctccctcgccctctctagcttgcatgatagctcggttagcccctcgaacgcgcgtacacgccgccccgacctccgccgctgctcggcatggccttgccgccgtcggcgcccgctcccggaggccgcctctcgtcgccggacctccacagcgcctccccaccccatccaatcccacaaacgaaacccttgagccccggagatgctcccgccgcctttaattgagtcctcgtcgcccctcggtgatttcccctttctctcgccgccggccgccgctgtcgaattccaccgccgtcgaactccctccggtgaatccgagccgttggctcgctccttctcgacgccctcgtcactccggtgtgctccccgaagaccaaatccgtcgtgcttgctccggtgaacaaggccgccgtccgcagtccatctcggcctccccttcttcctcctcctgccggcctgcgtggctgccacgtaggcgccacgtcggcgccacctcggctttgaccaagccgagccggtcagccacctcctccctccccccctccgcgcgcggtccacggtgcgccaaccggccgcgcgtgggcccgccgcatccctagtccatccggtgcacgcgcgtgaaccgcgctcacccgaaaccctagcgccgccctcatgcgccgctcccacggtgagccgcgccaccgacaagcaggccccactcgggacaccgcaaggtggactcggcccaccggccctctctctccctcactctccccgcgccccattgggacgcctctccgggccagccggcccattagttcggccgagccgtgcctctcctcttgggccgcacccaagccgcccgaggaagtctaaatcatatccctccttcaatttctttccaaaaaggttttaataaattattaaatcctttttcctttagatagaaattccttaatccttagaaatccatatcttctcaaccgctcatccgattgactccgttcaactttcaataattccgtaaaattgagatctatctaatggtactattatctagtctaaataggatctttattttgggtcttgtgtaggtttttaattgtttgcgtatagttgcggttaccggattttcgtcgatcgcgggttttcttgaagattcgtgaagcttcgtgaagacctcgagcaaggcaagtcaccctttgaccaattgctcctataattgaaaaatcattattattttgtttgcaacttgcattattagaatcacacactcaacttgcttggcctcggtttgcgtgccaaaccgacggacctacccagtagtcgcactaattcctgtaggtcgtactaccctgattccttgtcgctccgcccttgtggtacctcggtattcgtgctctctgagcgcgtataccaaatatcccacatacaccgttgtttgtcgaaaacttgggaaatgggtttgtgaagccttgaaaacccgacatatggtgtcggtgtgtttgaaaataaaatgaattgtgaaaactcgcgatgcgggggttgtacctatgtggcactgtcccgtattcacatataaggaccgattcctatgggaaactcatcgaacataatcaaagtgtaaccacaaggtggaatgggacaccctggctaagtaactagtcggttcagggaaacgtcgcatgccaatagttgggaatgccggggcggggtcaggacaaaccgggttcctggtaaggcaaggacgagaagcttgctctcttaccgatcaaggtggttggagttgatttgtgaatgcctaaaatggcctatttttatgtgaggatttgatccttctatgtggtatgaggtaaccctgggtcggcttgggaaaggctttgtcgcaaacctctgacaccggccagtgtttggagtaagtctatgtcttgagggtaaagtgtacccctctgcagaggttaactaactgttcgaacagccgtgcccacggtcatgggcggatgtgaggtggttccctttgcgtagatttgattgcctgtgctttgcgaaaagttgttgtggtttggaaatcgtaactagaatcagcctatgtggcagatggatgacctgagtggtcagaaacggatctgtgtgattcaggatgtctgcgggcatcatagactaggcttcccgagtggaagcggattgctttgctgctaggcagctggactctaggagtccgagaaaatgaaaaaggctctgggagccgcttaatcaagtgaaatggctctgggagccgagaagcaatgatctgacccgggaggtcggtacattaccaattgagttgttgaaaagcatctcttaagtcgaatcgagacgcaagtctcttttcgacccaaacctaaaaagaaataaatcacttagtggtttcaaaatggatttcaacaaaagatttacaaaacaacctcgcctctcttccaagcttgcattaaacacctaagttcccgtgacttgccgagtacgaaagtactcacccttgctctatataaataaataaataaataaataaataaatatatatatatatatatatatatatatatatatatatatatatatatatatatatatatatatatatatatatat

SEQ ID NO: 15814 - DNA, 5165 bp, Oryza sativa
cgcgtcgagggctacaaatttgatataaagtttgtcttcattagaattcacatgaaaaagttatgaattatttttaaatataaagtctttataccatcctatttgactcaaatgatattcaaatccaagtttagggacggattaacacagtcgaacaaatttgaagatctgaacggtcgatttgcgagttttagaatcgggatgacacagcggtacaccggtgatggactttactctatacttttttccttgatatataattggttgggtatgtgtgcggtggtggtgggtagtgggtacctataaatagagaccaggaggtagttcaattatccatacatcaggtcgatccgcaactcctgtaactaacacagaacgtgcagcggtgcagcatgtctgggagcaaggtaataagtgttctcgatacggagatgctcgctgttaacggtggcactggcacaccgcaagagactgcctctgccacggccgctgcccaaacttttgccccgtccgtgtggggcgacttcttcgccacctacactcctcccaactccaaggcatgctgattaattaaatatatgcttgattaaagaagtttgacaacatattaattacttcagctacatagcttttatatttatgtatacgcgaaattctcatgcatacagaggtcagaggagtggacgagaggaagagcggaagggctgaaggtgcaagttcgcagcaagctgttgaaggccaagagcagcagcagtgcggcagacatggtgatgctagtcgacacgctcgaacgccttggcatagacaaccacttccgtcacgagatcgcggcgatgttacaccgcgtacaccgcgagcagcaggggtgcactgccggctccgacgacgacgatgacctccacattacttcccttcagttccgtctacttcgcaagcacggcttcagggtatctgcaggtacaataacatactctccactttttttaatatataacaccattcatttgatcatttatcttatctaaaaaaattcatataattatcatttattttattgtaacttgatttatcatcaaatgttttttaagcctgatttaatttttttatttgcacaataattttaaataaaatgaatagttaaacgtttataaaaaggttaaccgtgttatatattaaaaaacggaggtagtatcaactctccggaatatgaaggttcctagctaaacacctgaacaaatatatgcagatctgaaaaggtatatcgtctaagtacatagctgggtcgatttttaaatctgtacatatatagatgcaagatatatcccatacatatatgtatacatatacatacacacatatgtgtgtgtatgtatgtatgtatgtatgtatgtatgtatgtatgtatgtatgtatatatgtatgtatgtatgtatgtagtaattgagaattttgaggaagcatctatgttaacaaaataatctagatcatgtcctaatacatatgtagattaattagattttgcaaaatatattaacctagaaatccagaatcaataaatatggggccgtaacagctccatcgtttgctggctgtgttcgtttcactatgttcccaactcctctccctctccctcgtgtttcatacgtacgcttttcaaactgctaaacggtgcggtttttgcataaaaaatttatatataaaagttgcttaaaaaaatattattgatcctttttttaaaaaaaatagttaatacttaattaatcacgcgctaatagaccactccgtttttcgtgtggagggaatgagttcccatcccaaaggaacaaacgcagcaatattctcttagcaaccgcggccaaaatttaaaataggaaacctaattttatatttgattttgataattttttattatagtttattttccaaaattgtttttaaatcattaaaatacaaatataaatgttttatctataaattcgtttcagctgcatcgttcatttttttcacggcttatcagtatttccgcaaacatgactgtaattttaaaagtcaaaattaagagttagagacttgggaaatatcatgcatggactcttctttcaatctaatccactccaattaagaaataaattcgaaattaataattataaagaagtgcccattccagagtgtcaatttagcattttattaatttaattctgaaattaataattagccagttgaaactgattttgaactcttttttaatctaatataaatgcaaggccgaacaataaattattccattatagaagaaatacttagttacaatttgcatgatgttgcaattcattaaaaataaaattacatgtagaaatattcaaacttggattaaaagaaaatataatataaaattgtggttaagaaaagaaaaattgcatatagcacatgccactgcaattttcggctccggaacgtgcagtcttaactactaggtgaccggaaattttcaggcacctgaaatatagcaatcctatagtaatatacatgagttcttcactaatacaaaatatttactgctgtaatagctgtattcgacaagtttatagatagcaagggcagtttcagagcaagcctaagcagtgacacgaggggcctgttaagcctgtacaacgcggctcacatggccatgcctggcgaggaggggctggacgacgcgatcgcgttcgcgaggcaccaccttcggtccatacaaggtaagctgaggttgccgatggccgagcaggtctcccgtgcccttgacatccctctaccgcgggcgcccaggcggctagagacggtgcgctacatcgccgagtacgagcacgagccagcttttgacggcgtggcgctggagctcgccaaactggactttgagctcgtcaggtctcttcacctcagggagctcaaggccctcaccctgtaagtctcttcacttctttgcctcttgactcttcagcccacatgctccctacttaatgtttcctctcattatacagaaataatttttctatacaagacactcacggatcgtaactggtcgagtctgcaaaaatcaacctctattttcgcatacaactcgttaagaggaccacatgcaaaaatcaattttcacagatgggccttttaagaatccgcacgcaaaaataagcctattttttaggtgaacctttcaaggggccacacacaaatatacattttcacaggcgggcctattaaggatccgcctaaagtctaagttacatcctcgtatccctcttaaacacttcaaaatatttcattcttatccactcatctctctcactccttctctccgcattactttctctccactctcacacctcctatcagacacgcggccagcggcaggtggcgggcagatccacctccgtcgggcccacgatggcccaatctgtcgccgccagacccgtgacgaccggatccataggcggcgggtaaaacggccaatggcgggaggtagcacccggacaaattctgaacgcctccttttctcaaagatttctgttgactcggaaggaattttgacgtgggatagatccattggaaggtggtctcgttagctttccatacatatgtggaacgtcgaagttagagtctgaatacaacctgggcgacaaatttagtgtgtggactgcttctggagcccgaagaagacttgaacttgatatgagttggacctccatcttatcttgaacgtccatgataacattgtccattctcctagtatctctccaagtgttccatggttctctccacagttactaatcataattaaatcattaggtagcaatctatcattaagagtacataaaaaaagtacttagaaacgaactcacctgtaaatttaattatcgggtacaagctccagtgaccttgcaaaaaaacaacttgaggatagcctatgcatccaaaggagtgatgtcctcattaatatagataaactataatggaggctccaaattaagtacaactttgtatttattaataattataaattttgcaattgttttctcaagactaaactgaaactaagaatcgaatccatgaataccattctgtatcaattatcaaaattattatagactaaatttcacattgggtcacatattttgaccacggcttcataatagactaatgttaaacccatgtattcacttaacaccacacgtctttacaaagttttcactttgtactggattgagcatatcaaaaaaagaacttcatataatttacacagggttataaaaatgaaatacattgtacgttttcttcattaatccttttagtgtgaactagttgtatatttaatttattcatgtgcccctcggtatagattaatttctgccggttctaaatatgttcacattactattttagtgtgatttgttaaaaaaccaatttgattgtattttctaaaataatggtttgaactgctgatatcttccttatgcttaaccctagtccaaagtgccagagatatgtggtgttaagtgaaaaaagtaattctaaaaaagtgaaaaaagttattttggctcctgtaaattatgaaactttagtcaaaatagattgtccattgtgaaattaactcattattatattattaggagtacactagcaagtagctcaaattaaagatcatgaaagtggattatatataatgatgttaatgctaattttaaaatgtaaaagcatgcatacaatttaagctctgttcttaaagaaacaaataaacaaaccgtgaaaattcgcacgggttactgactagttcatgtacagtacaagcaattgtccagatactacctgcatgaagctcagtggttaagcgacaagtacgtgccaagcttcgcggagcacctgaatgtggctaccatgtcaacgggccgggccggcgctggccccggcggtgcggatgggcgtgaaccaccgcgacggcgcggcgaccgtggaggcatattcggctgggtgtccgcgcgccgtccccgacctgctccgcgcaagcgcccaggtgggccggccgtctcctaacgacatcgcctgctacaagacggggaagaagaacaagaaggacgtggagagcctggtgtgtacgtcgcggagcacggcggtggcggggcaaggttggaaat

SEQ ID NO: 15815 - DNA, 26596 bp, Oryza sativa
atctcttactcgaccctgtccaagtttagacacgacgacaatatactgtatatggcatgtgcaggactatatttacacattgatcgttttctcgacaaaacaaatataatgtgattatctgcacttggctctgtatgtaagtcctactatctccaactcgttttccgtccgcacgcttcacaaactgctaaacggcgtattttttaaaaaaagtttctatacgaaagttgtttacaaaataatattgatccattttttaaaaaataaatagataatacttaattaatcacgtgctaatgaatcgttccgttttccgtgcccaaaagatcagcctatcaagcccgcagtctgcgtccatcagatttcaactttgcaaggcccaccaacccggccacaggcagaccgcactcctgctgccctgcggccatatcttctttctcggcccatgacctgcacctacgttcggtccacagaaaaattggaggttagcccacgtacgaaccgaccgaagcgcgcaccggcggcatcggcgcgcgaagaccgtgcgcgatcagctccacgccacgatccacgggacgggagcgcgcgcgtcgccgtcgccccttcttcctggacccgttcctcggtcgccgcgcgtcccgttccacctctcgacgtacgcacggccaccgcacggcgccgcgctgaacaggccctttttcttttcgtttttaacaagggaaacaaggcgttcaatgctacttcaatgtgtgtgtgcccggccgggacagcgatgtggccgagtggcctgccgctcggaaaaaaattctctgcggcagtgccgcacaggaccgcctgtgcaacaccacgcgcgcgagtgacccgtgtctgatctcttgctgcagcagcccgagacaatcttcagatccgagcctatctcctacacccatatctaaacaatttaccagaacgttccgtgattatcaaagcacgattaatccttaaatgtttcgtgatttctatgttaacaacatgtaatttctgatcccttttcaaactatgatttttatgtcatcaaattgtaatttccaaaccctttcactactagaaaaaaacattgttgcaaacggccgaaaacgatcttttcagatggaagccggtccgcctataggcaaaggcatgtgaaaatcaccgaacaaaataaatgatagttatgaaaaaattcaaataagatgagtggttaaatagggaaaatatgtcgtgatgacgtggacgaatctcatacgactattttttgatttaatggtagtttctaaatttccactaaatatgtagtgtccaaaagttaagggtgttatttattaaaaataaaagtatcttatatcaaaagaaccctgttaaaatcgatgagtctggctcggctcgaaagaacgtgctgtcgatggatatggctcggcgagattggctcggcgacgaagatggtcttagactgcagttggtgattggaccaccaatcgcttgcttgcttgcacgccaacgccaatgcgctggcacctggcatgggtatgcatcttgcgcgcccacgtacgctccatcatctctggattcatttccttctctctttttcttttcctgcttgcttctgtggttggaggaccatatactagtcgattcctcgcaacagataagaccccgtttcgtcgttactgtatttttggatttcctcttccatgcaattccatcgttcttccacgatcccatcgacatggatacataaatccgcgagatgccgagatattcttctgcgccaagcgcgcaggttattccaaccatgtcgctatcttccattcgtctccacgtccagaaacgcaccaatctcatgagccattttctcctccctgagttgaccgttccagttagtttaacaccttaacttccattagctgatagtaatatactagtagtactcactccgtcgcaaaaaaaaaaaaaagacaaaccctaatttccgtgtccaacgtttgactgtccgtcttattaaaaaaattataaaaaaaattaaaaagataagtcacgcataaaatattaatcatgttttatcatctaacaacaatgaaagtactaattataaaaaaattatataagatagacagtgaaacgttggcatgaaaatttagggcttgtctttttttttttttttggacggagggagtacgtagtagtagcttctatcatcaacgacaaatctcccgttgtcttgtcttctcttcgcaccctaagatttccacgtcgtcgatgccttttcgttgttcgcgtcgggttcaccagctaggtggttcgccatgaagtacaggaagggggtcgccggcgagtccaacgatgacgacggctcgacgaaacgaggtcgtgacgctacaccgagcatccaggtggagatcgctgagtaccatggaggcggcggcggcggaggaggtcttggcaacgggggcggtggctcggcgtcgttcttcgagccgtggcgggaggccacgccgggaagcgggagcggacacgggagctcgggcaggggcggcggcgggcgcgagccgccggagaagcggctcacgctgttctccctccgcctcgccgtgctcgagaaggcggcgagcgggctcgggatgctcgacttcatgtgggcgacggtggtgctcctcggcggcttcgccagcgcgctcaaaatcaccgacttctggtgcgtcaccgtcatcctcgtcggcgagggcgcgcgcgtcttcggccgcagccacgagctggagtggcagcaccactccacgctcacctccaccgccggcagcgcgctgcgctccagctcacggctcttccgccgcctcgtgcacgcgctcgacgacccggccgccgccaccgtcaccggcggcgctcgcggccaggacgcgcgcgacagggcggcgcagttccagcgacagatcgtcgccttcatgaagcagcgcgcctggcacgcacccgacgtgtcgctgctcccttacaccggctgggtcttcgtctccaagaagatcgggaggctcctcaactggctgcaggtgctctccgccttcacctgcgtcgcgctctccgtgatgcggctatggcggcatgatttcggcgacgagcccaacaagcggccggcgctgctgctcttctacacgttggcgttgatcgaggcgctcctcttcctgctcgagaaggcgtactggacatggaagatctccgtgcggaagctgctcgagcaggtgagccgcgagtgcgagctcggtgcgtatggccacgtctcgctcacgcgcttcttctacgacgcctactcgcgctgcatcaacgggagcatcttcgacggcatcaagatggacctcgtcaccttcgccgaggagctcatcctgtccgagttcctagacgagcagctcatcggcgtgcgcatcctgcagcagttcgccgacgccaagggctccgcgcgcgacacgctgcgcaaggtcggcacgagcgcgcgctccatcgagcggctcgtcgagatgctcaactggaagcggcccgaggaggaggaggtgcgctggtgcgcggcccaggtggtgtccaagctcgccggcaagcgccagaacgcgctccgcgtgtcgggcatccccggcgccatcgagtccgtcatgtccctgctctacgccggctggagcgcgcccgtgtcggcgacgccgcacgacgtctcgccggcggcgcggaggagctacgaccacccgcagttcaaccttctcggcctgctcatcctcaagaggctcgccagggaccacgacaactgcggcaagatcggcaacacgcgtggcctcctcgccaagatcatcgagttcacgcacgcgtcgccggctctgctccgcaacacgctggcgccggagtcgcaggtgcgcgccgtgaagctcgcgctgaaggtcgtcaagattctggtgtccacgacgggcagcaccggcaagatgctccggcggggggtcgccgagaacgtgttcacggtgagcagcctgcgcgtcgtcctgcagcacgggcagcagcacagggctctgcagaagctggccacggacatcctgtcgggcctggccatggacgacaagggcaagcaggtgatcgtgggcaccggcggggtggtcaagcagctcctatcgatattcgtggatgccgagacagagctcggcggcgaggccggcgaggcgctggcgatgctggcgctggagagcgaggcgagctgcgcggcgatcctcaaacgggacgacgtgctcgaccacctcgtgtcggcgctcgagggcgacggcggggcgcgtcgtctgaacgcggcgagggtgctgcgcaacctgtgcgcgtacgccggcgagaagcatcgaccgcgcctctccgcggtgatcaaagcgatgcctgtggtatgcgtcttatccttacaagatgaaaatgttagttatcacactctgcttctacttgacgcctcccgcgtgaccgcgtcccagacaattacgttttggatatcgatgcattgtttttaaatctgacttaattacattgcgaaaataattaagatttttcatattactatctccaattctccattctaaaaagggatttttgtagaagctttgttgagtcgtgagaccgtgtcaccgtgatgacttttttgctgacatgcacaattggtttgatggtttaggtactgaaggccaccatgaccggcagcgacaagatcctcgaggtgtccgtcggcctgacgacgcagatctgcaagttcatcgacggcgatcggttcgccgacgagctgcgcggcgccggcatcgacgagagagcctacgtggagcggctggcgagcatcctgcgggagcacaggtacccggtgatcagggtgccacggatgcggcggttcatcgtgcagcaggtcatctggctcatgacctcgtcctcctccgccgatggcggcggcggcggcggcggcggcgcgaactacgtatcgcttctccgggaggccgggatggagcggctgctggagtccatcgccgacaccacgtcggagctggagtgctaccacgtgttctccggcagcgtgggcatcagcaagcaccgggagagcttctcggctgccgtcgacgccgcgctggagctgctcggcggcgatggccggagctcgagctgagtgatgagaaattgcccgggatctgctgtctttattcctgcactaacacagatcctttttcttcttgtttattttttttaaaaaaatatttttcttagtaaaagatagcttatcctaaacgtgatgcctctcgtaggtgattcagttcataattttgtacagaacgaaccaatgaacgacagcagctgagcagcaagtacactggtctgacctttcacttttgtaggagtatgaacttatacaatgtactacctcaatttgttacagttgtaactattatacaagatataaacaccatctgatagtaagattcattgagatacattggttaaatacagagtcattcactcattgccgtctacttttctttgaatgcatgtttcaagtttggaacgccaaaataatcacatgatattgaatcgtttcgctggtactcattcatcatcgaaaaaatccaacgtcccacatcatttctgtggaattcaacgtttctgaccgcctccacatcgcctcctcccatccggccagatcgccgtaattttccatcccctctcgcacagcgcccgaatctcctctccctccctctcaatcgacgccatcgatcgatctccgtggcctcgtggtcgtgttgaggcggccatgctgcccataggtgccaccgacaaatcgccgtcctgccgcctaagcacagtccctattggactctcgttgcgccggtgatccgatgggggcttgtgcttgccagttgccacgcggatcaatgagttcgagcaatgtgctcatgtgcggaatgagaggagagaccccattcttggagttcgctcatgtttatatagaggttgacataaggagaaatctctcttttgccccttggttacacaatcctagcaaggtttttttttaaaaaaaaaatacaagcatattccatgggtatattctccaagtatattctttcgacattttccgtagggcttaaagcctattatcgacaaccttgagaaaaggtatttttccatagggtttatagcatatttcccgacacccttggagataaggatgcctatgcgccaacaactccctcatcagtgatgtccctagagtctacgggtgcgatgttgatgctatatggtgtcagccttgatctctggggagtaggggaggtgggggaggggggggttctttttggtgatcttcaaggcgagtgacgttgactaaactgttgatccgattctatgtagttggcgtagtaaagtcttgctgctcttgtcttggcattgtcttaacatggaaattacagatgttatatcttacccatgtcttgatgttctacccaacttgtcgagctttgctcatcttgtcgggcttcaccaaacattttagcctttcacttcatgttggccttcacccattttcagtcaatgcctaacatgttaggttttgacgaacatatccagcttcaccgatcaagttgactttctcccattttcggccttcgtccaatatgccgggcttcgctgatcatgcgggcttttgcccatgttcgatcttcatcgatcatgtcgtatttgcacatggtctcttcgtcgaacatcttgggcttcaccgatcatgttgcttcacccatgttcggtgattgctcaacttgttggtcttcactaatcaagtcagcatttgccaatgtttggtctttgtctaacctgttgggcttcgccaatattcagtcttcgccccaacttgttgggcttcgccgaacattttagatggtctctactatctaagtcaaagactccttagtcttctcaatgttgaaaaagaaggtttcgaacacatgtctcacttcgttaatcacgttgatcttttcccatgtttggtcttaattgaacatttccggcatcatcgagcatgtcaccttcgctaaacatatcgggattcggtgccaataatgtcactttgcccatgtttggtttttacccaacttattgggctttgctgaacattttaggcttcattggtcatgtcggccttcacccatgttcggttttcaccaaacatttaggatggtatctaactatctaagtgaagattcccttggtcttttccatgttggagaagagagttttgaatatatgtctcacttcgtcgatcatgtcgaccatcgtcaatgtttggtctaagctaaacatttcgggcatcaccgatcatgtctccttcgccaatattctctcttcgccaatcatgcatgtcgcttcacttatgtttggtcttagccgaatatttcgggtttcgccgatcatgtcacttcacccatattcggtcttcacctatgtccgctctttgctgcacatttcgggttttgtcgatcatgtcggccattgcgaatgtttggtcattgctcaacttatcgggcttcgccgaacaaattaggcttcgccaatcatgttggccttcactcatgttcgctcttcgccgaacatctcggccttcaccaatgtttggtctttgcagaacttgccgtgcttcgccgaacattttagactttgccaatcatgtcggccttcgcccatgttcaggttgacgtggcagctcatgctaatggtgctgtcgtcggtggtgcttctcatcatcccggcgttcatgtacggctgcatcattgttggctttgctcgtcggttcaggtagcagtacacccacaccagtgccatcaccgagcatgccgtgttgtttgtgcatacggtgtactcaattgtggtggagtagatcaccatggctcaattctcagcggtgctagaagagtcggcatggctcgggctcaagcaggggcttgccaagggcgttagcatcaacagcaatggcatcacctttaccatctttgctttcaacatttcgggattcactgattatgtcggcctttgccaatgtttggtcttcgcccaagttgtcgggcttcgccgatgtttgctcttctgcctaacatgttgggcttcgccgaacatttcagaattcactgatcatgtcggccttcgcccatgcccgttctttgacaaatatttcgggcttttccaattatatatgtcagcctatgccaatggtcggtcttcgccaaacattttggactttgttgatcatgtcaattcgcctatgttcagtcttcgccaagtattttgggcttcgtcgaacatttcggatggtctctaactatcaagtcaaagactccctttgtcaaatatcacaacaaagcatcgtggacaaaacgattatagctcagctataaacttttatatttgtcaatttaattatttagtggtgattacattcggtactaaaataaatttaaatgacatcaatatttatatatagctaaaatggtaaaaagaataccacttttacattaacgattctcaaatggatttgctaaaaaatgtcgacatttttttttgcttgggaactgtcgatttgtgatttgtatttcgtcagatcaacatcaagatttgtgcaaacaaatagtaaaaaattgaaggcacgcggaagaatggggaaccaaccaagaagaagtgatgttgtgatcaaggggaacatatcgtacacaagcttctcgtgcacactccgatccatacacaccaactagcaaatatcacagaaaattctataaaaaagttacacatacttttaatagtattacatctacgtgtgaaatcttatcttcaaattcattataatttagccgtaactagaagaaaaaattctgacagatttttacacttaaaactatcggatttttcacttctttttattacggctaaaatataatgaatttgaatacgatactttgcatatatgtgtaataccactaattaggagtaaatgttcaaatttttcgtagaattttatgtgacattttttagttggtgtgcacggagtgtacacgggaagcttgtgtgcataaaatatgttcccgtgatcaagtatgtatttaggtacatgctccttttacatagtagttacagtaaaattatagtaaattatagtatagttagatttgaatgttttttaacaaaacactatcgaaagttatatggctaatcgaacggaattgctaaagcaatatcgacggttctttcggctgatctgtgtcggtttcactggccatccgacgacagattgaaatatatctttacaatcttcaataaaataaattaaatctcaaattaatttctaaattcttgaacaaatttaaattttaagtgtataaagagtttataagctatatacagccattctacaatccgatggaggaagctgtctttagctatatggataactaaggcaaaattacaaatggctagagtcgtttttttttaatttcattaagtacgaattaccccattgaactatcacgacaatatgaattacccccctaactataaaaccgcacatttgacaccctaaactattaaaaccggacaaatttcccccttggcacaatccatagttgttttgatcctacatggcatacacgtgacgccaacgtggcaatctaattagaaaaaataataaagtaacaatgggcccacttgtcatatactcctacctcacccctctctctctttttttcttttctctgccgctgggggcgcggcgggcacggcgaggaggacgtgcggtggctggagggcattgcggaggcgtcgcacggtggtcgccacgtctacggcgggtgcggaggcagacttttgcagcgatgagggacaccacggtgacacaccattcctccctttcccctctccttctcttccaactccctcccctttcctgcagtgcggcggcagcggaggcagtccaggcggagaagaagaaggcggcggtggtggtggttcggatggagaaggaggtggcgacaatggtggttcagacagagaaggcggtagcgacagcggtggtttagacggataaaaccgtggcggggagagtggggagggcccgaccattgctgtcaccttcacccgagctctctgccactagggggcacagcagtcgcggcgaggaggaaggggaatgggcaagaaggcaaccgcgtgaaggggaatcgatgcctccgccgccaccagctgctcagtccgccaccacctccgcaatcggcctcctgagctcgtgcgcgtgcgagagagagagagagagcgtgcgccggagttgtgtcgtgcgccaggtcccgcctccgcctgcatcgcggccacctggtatgcctccgcctatggcaccggccgcctgagcgagctcggcctcaacactgtcacatcctgatttttgtttcaggatttataaattatttaataaattaataatagaatttatattaaatgatctttaatttacaagtgaagttaaatgtgggaaataaaatttcctaaatataaagcatggatggatttaatttttattaaattctccatgattaagtcaactctctgaaatattctcggatttttcggagctcaattcttaaatgatacaaagaacagttcagtaattatttgatcaataatgatctaattatatttgttaagagcttttcttgtttaaaaatccttaaattataaattgttgtttaaaaggaattattagaaatgatcttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgcatttaagaaataatttaaattgaaaaaggtttttaaaagtcttcttttggctttgggccgaaagccggcccaaaaccctctctctctctttccctcggcccagtccggcccaatccgccgagccgccgctctcctctctctctcagccgctgacaggtggggcccgtttgtcaggcctgtcttcctcctcgcgccgccgccgccgcccgaaaccctagcgcaagccgccgccgtctccttccaaattcggtcgatcctttccttctccggccgaattgattgaggggaaacgatctccgggatctcctccaccttttcccctttggaaacatcggctaaatcggcttggaaagtgtttgattcgaggtcgaatcggatcggctattctctctccgagcccgatctttccttctcgtcgccggtcgccgtgggccttcgccgccaccttccaacccctatataaggatccccgagctctcctctacccgctgcctccctcgccttcgcctctcgccgtcggaagcgctctagcgccgtgagacctcgcgccgccgtcgtcgccgccgctccagccgtccttcgccgccgttccggtcgtcgccgtcgctcggggaggccgccatcgtggtcgccaagtcgccgccgtcctcgtccgccccttcgccgtcgccgaagatcgccggagcaccgtcgccgccgtcgacccgatctccgccgccgcttcttcctcgtcgccggcgccgtccgttgctcttccgccgtggttttggtcaccggtgagttcgccgcgtcgccctctacccgttggtgccctccgttcgtgccgaagcgccgccgttcgccggtgagcgtgcgccgtccgagccgccgagccgccgccgccggtggtgacgtcatcgctgacgtcatcgggaccgtccgtcgcgagccggtcgtggaccgtccgatctcggccgtccgttttggatagggttgatctcggccgtccgttcccgtgaaccgccgccgtgcgcccggtccaccgcaaaccctagccgctgacgcaataatcctccttttccttttcaaaaataattcattattgcgtcataattcaattaaaatccatataagtgttttaatccgatttaatctttaaaaattcataactaattcattgtaactcagtttaatgtggttcaagttgcaaaagttgtataaaataaagatctacatattaaaattgtccataaattgaattaaatttatttaattctttttaaatgggctttaattatatttaatcttgtaaaattcataataaattcatttgaagtcagaatgaggccgttcaagtctcataattcatctaaaatcatgatctacatgtttgtttactttttatgtattgtttatttggtttttattagtctttttcttcgttttacgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagtaatgtttttcgtgattagtctcacacctctcataattagttattgatgttttactggtaataatttgcttagctcctggtttggagttagatctgtacagccgggtatggttgttcaggatggttgggcctgtgcagcatgggtgtgctgttcagtgttgattaaaatttctgattaactactccactgttttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagtcgaagaaaaaggatccagaaggagaaaacgtttggcttataccccagttgagctgcctgtgggagtggagccggagcttcgctagattttattttccgctgcagttttcttcttagtgaggactaagtgcctcataagtaagtatttatcgttttagttaatttgatgaatctgtatattaaattgtcagtttatgtacctcggctgattcctggaccaggattttatgcacaaataagttcggaaattactagtgaatttccgggcgtgacaaacactcgccacccaggcgaactctgcctctgctgccgaccgcctggtccgccttcgcctctacagtcacttgcccgagcgcgtgcagggggggaggagagagagacccgagagggagagtcatgacaggtgggcctaggatttttttgtttgattagattggcacgttggcatcacgtgtacaagctcaagtcaaaaccgctcaaaacagtgtcgagggaggtaattcatccagtattaaaagtttaggatgtgtaatgtctggttttcgggttcaagagggtaattcgaacaaccgcgccatagttcaggggggtacttcgtacttttcctttcattaaatcccacttattattgtataagctacatggaaccatatgtattttatcatgtgacacataaacctaggtattatgaccctaaagtttcacaaaacaacaccgttaaccattttaacatagtctgctatctcttccctttccatgcctttgattcatcccggattgtgttgatgtgcacatgaacaaaagtgcacattcctatccgctcttcattcaggcccggtccgcccatctgctgctaggtctaagaatggaatttaagacgtgattctagaactcaaaagtgtagtagataatatagttttgtgatgcgttaggaccttaatacccaggattatgtgacacttaccaaaattcatgtggttcatgaaacttagaccataggtgaggttcaataaactttactctctctctctctctctctcttttaatctcagctgactcatacgctgtcggattcatggacagtgcactacatacagggagtcatagaaggtatagtagagatactggtggatttgctccatcttatctgtaattaagatacacacatgcatattaatttattacacatacatgcaaacgttacacgattttacccacgtactagtatatagtactcactctatttcataatataaaattttttagcattgttcatattcatatatgttaatgaatctagaaatacattaacatctatataaatgtaaacaatgctaaaaagtcttatattataaaacggagaaagtatatgtgtacgtatgtgcatatgcttgctgtatatctaatcaaacagctgggaggggtttgcgaggaagaagttggtgacgaggtctttgatgtcggcgccgaaggtgtacccgtccctgccaccgagatagatcacctccagcatcctcgtcaggttcaccaccagccgcgccgccgggagcagatgatcagcccgaccacccatctccacgcactcccggttgatcgtcctccacgcgcgctccgccatcgcggcaaccgccgccacggcctcctccccgcccacgccgcgctccgccatgtagcactccaccgtgctcgccatgtccctgccgctcctcccggtcctgtaggaggcgacgtcgttgaggaagcgggctagctccccgctggcgcgggccagggcggggacggcagccgcccacccgaacgcctccgcggtcgccgcgccgtcgccgtcgcgcacgcccaacagcaccaccggggccagctccgggaagccggaggacatgacagacacgtccagatgctcggcgaagctgggcatgtatttgtcgctcgaccattgggcctcacggaggtagtattccgacaactgcttgtactgtagcatgtatatataagacataaattatggtaggtgcaggagaaacaatcaaattaaattgtgtggatgaatatgatgatcgaacgtgcacgttgaatatgatgtgtcttcattttctgtgtaccaggattttaccccagttttggcgtaagacatgcggtacttctcggttggctccaagcaatcctctaactcttcaaagttgttcagtaactttatgtagaaggcatgaagatattcgggtagaatagagaccgcgctcttatcccatctacatacatacaaggataaactaatttagtgctctttgattaaataacaactagaccatcattaacttttatataagtacatcttttgttcttaaaaaaaattacaaattacctctgtatagctttgttgagcttgtggcactcctctaaggtggcgtgggcgtcgtaagtatcgtccatcaaagacatgagtccaaaaactttggtgaacatgatacgtgcgcgagagtactcctcctcgtggtatatgccgcacgtccagaagtagttctccacgatacggtctctagcataacttagcttcacgctattgtacaggtctttccaccagctgcgcatacatacatttgaactcatccaaaagctggtttgaactaattggtgaatttggcaattgaacatgcacttattagtcataatagattgacatagccaattggtgactactggagtacatccgttcgtagagcaaagctccggtactttttactagtagtatattaccatcaatagtattaagggtatatcagtaatttactaatacagtgattagaggtaactttatcatttatgttttttcttgggctagatcgatatgtggtcatccattgcattgggatcgctcatattccatcgaaaagtaaaaaagaaggaaaaaaattagtcactggtaaatgacaattttatccacatattgatgtccatccacatttccagtaccgcgatggtagtataaatagatctaaaccttcgatcaaatgaaatcaacgatttagattattttctattaccagtagaaagcatcgtagtggggctcctattcatattatatatatgtcgttttaactttttctttaatggagtatcaaactttcttaagtttaaatttatagaaaaatataaaaatattttttaaaaacaaacatataattaaaatacatcaaataccatttttaatggaaccgagggtatagtagatgttgttaattttttatatgatttataaaacttaagtaaatttgacaagtaaaataagacaaaacgacttataataaaaaaagactaaataaatagggagcaggtaagttaaagagtcaaagagggaaaaaaaagtgaggagaaacttacatggtgagggccttgagctccctgaggtggagagacctgacgagctcaaagtccagtttggctagctccagcgccacgccgtcgaaagctggttcgtgctcgtactcggcgatgtagcgtatcgtctctagctgcttgggcgcccgtggcagagggatgtcgaaggcgcgggagacctgctcggccatcgacgacttcagcttgccttccacggactgaattaggtggtgcctcgcgaacgcgatcgcgtcatccagcgcctcctcgccaggcatggccatgtgagccgcgttgtacaggcttagcaggcccctcgtgtcactgcttaggctcgctctgaaactgcctctattgtctctgaacttgtcgaatacatcttttttatttttttttcatgcgcggatagttcgtatcagtacaagaacccatatgtcctagttaacatatatatattgtgttctggagatacgtatgttggttaaaacatatgttaacccatatgtgaagaagtaaactctttaatattgtacctgcagttaccccaaagccgtgctggcgaagtagacggaatcggagggaagtaatgtggaggccgtcgtcggcggcggcggaagggcagtcctgttcctggcggtgtacgcggcgtaacatcgccgcgatctcgcgacggaagtggctgtctatgccgaggcgttcgagcgtgtcgactagcatcaccatgttggcgacactgctgccgctgctgctcgtggcctccaacagcttgcggcgaacttgctcctttagctgttccgctcgttctctcgtgcagtactgatcatcctctgatgatctcagctgcttgcttaataagtagtacgtcgttttaagttttggtttgtaacgttccaccgaccatgttagcttattcaaaagattataaaattattatttattttgtttgtgatttgttttattataaaaatacttataatttatcatttttttatatttacactaattttttaaataaaacaaatggttaaacattgcaagtaaaaagttaaaatgatatttaatttgagatggagggagtaatatgttgtcaaattactaattataagcctatgtattatgtatataaggaaataagtagagtaataatataattgtatatatgtgtactcatgttgtgtttaatcttcatgcctgtgaatcggaaggggtgtaggtgatgaagaagtcgccccacacggatggtgcaaaagcttggccggtggtagcagtggtaacctcgctcacagacatgttgccgatgagcgttttgtcagttacaaaacttgtcgacttttgcttgctaggtacttggatggtctaactacatctctcacggtctctatttatagacaaacaaccctctccttgtacagctattgaatcacctagctagcgaaccctagcgtatctatgcatgttgggtttgcagttctatgttaaaaagattataattactaattttatagcaagggatataagtacaaccttttttttttgttgcactacatttttgaagaatgctgcgatagcttgggctccctcacttcaccttaaatatacggattatctctggtgttggtctactagaaaaacgattttttatggtgttggtctatgattttcgctagtggaaaaatgccaaaaccgccagcaagatcgtaacgagggggtgaggggcaccgaccgccagtgaaaatggatcttcgctggcggccacgttataccgtccgccagcgaagatatgttcattttgtctggtggtcacttagatgcgccgccagcaaaaatggataattttcgctggcggttgggttaaatagttcggtagcgaagatacaattatttttgttggctgctcacttaagcaaccgccagccaaaatcgattttcgctggcgttcttaaaaaaaatccgcacataaaaaaaataaccgcccgcccatacccttatccacctaccaccaaaaataaccgcccgcccatacccttatccacctaccaccatagaataaaaatatttccaccaaattccagcaccctcctctcctcctcccctcctcccaggcggcgacggcggggttctcgggtggcggcggcggctccggcagctgtgcgtggtggcgacggcgacgggaggcggtcgtcggggggtgcggcgacagcaatgagaggagccgtcgggggggtcgactgcgacggggggcgtggcgagctccttctcctccccctccccctcccacgatggcttggtgctgcgacggtcacgacgacggctcgttgctacggggcgcagcgagctcctccccctcccctccccccctcttcctctcccagatctagccggaggggagggggcgacggcgaccgcggcggtgacggcaggcaggcggtggcggatctgacgacagggtcggcagcacgagagcaaccatgacgacgacgaccatgaccacggcgacaacgacgacgatgctgcgcgcgggccgggagcacgtatctggcggcttcttccctcccctccttctccctctcccagaggggaggtggcagcggcggccgtggcggcgacggcaggtgggcggcggtggcggatctgaccgcggcggcgacgatgacgccgctatcggcggctcgatgcgtgggcggcggatgtgatattcatgtttgctttgttgaatgcttgttgaaaatgtggtgaaaattgatgtattgttctctggatgtggatttgagtatggatctgatgccgatttgaattgattttgaatatggattgaaaaaaatgcagctgctcaggaggtcgattgctattttttttattggaaaaaaatcttttcactggcggtcctcttaaggatccgcctgcgaaaatagattttcgcaagtggttctcttaagggtccaccagcgaaaatctattttcgttggcggtcctcttaagagtccacctgcgaaaatagatttcacaagcggttctcttaagggtccgccagcgaaaatctattttcgtaagcggtcctcttaagcgtcccgcctgtgaaaaatcctattttcgcaagcggatcgcaaccgccagcgaaaatcttagatcttcactggcctttgccttgtggcggctccaaataccgccagcgaaaacctaaaatgaccgccacgaaaaatagttttcctagtaggcgcaatgtcagttatagaactatcttcccatataattggtatccactaagagatatcctctcttactataaagttataacccactaactgctaaagcttaacatgcaaagatgacacatcatcatccactaacaagatgacacatcataatctactaacaatcattaaagttaaacaccatacaaacatgctatattatctataaatttataatttatttaattttagagcttttaaaatgtaagcatgttaaatcatcatcgcacataattcacataatattttaatatatatctttattattttttataatatgctatgtatatgtatagttcatcctcactgactacttagttaatgttatttctcttttctcttagtgcttaaatgattaatctatgatccaaattttctttctcattttcttctctcaataattcatattatcatctcaattatttttattctttagatgattaatctacggtccaaactatctcaatactcttcttctttcatacagtcatatcaccttacttttatatttgaatcatcattctacatgctgttcaaatttaaattatcataaaccacgttaacttacgtaatctcatgttgtatatctattttacacattatttttacttattatcatactcaactgcaacgcgggatttcacctagtttacttctataaacacgcaagaaacataaccgtttgaatcgagaagcttctaatcgatctaattcaatcatttattagtcgtgaagaaagagcactgcaaattaaagaacatatatgctcgtgatatgtgttgcagcctgacgagacgcctggcctgaaactgctagaaaggaaccaaactgcaggcacacgagattagaaagtagaaactgatcagtgcggatattgtggcgaacccaaaacgaaaccaattgggatagccgcgcgattaaacatttgggatatataaccggtttttcttaggttgctcttaagttatatcatttactacatcggcttactgtcggttagctcacgggaataatttttctaatgataaaaatgaatttttcaaacggtttctgacacaaaggctagctccaaagtctgctagtgccacatatctgcttttccttttggctaacttgagcgggcacaggacattgtgtgttcttttcctcataatggaatggaataagaatatgcacgcttcacgatctcacaaacagtatgatctttgctaaaactttttatagaagaaattatatatgagtttcttagaaaactattttataagaaattaattgacttttatgaaataattatcataaatcaatcagttttttcacccaatcaattatccttccaaaaccttatcttagtgccattaccaagagctgtaaatatataaattttacaatgtaagatataaaatttaatgtgcaaatacatgttaaaagttgattttttttatgaaaatgtaccgtcataaatatagctttggtatgaccgaaacaaatctcatatgtacatacccaccaaattaatgtaaatagcttgcactaccccacaaaaataaattgttattaatagtgagttaagatttttctttattttagactgcttacacatctacatggttgatgctaaattaactcataaaactcaacatgcaagtgtgacacatcatcacccattagcaattattatatagagtattataaatcatatttaagtgtgtcacatcatcgtccactttattatctagggtattttaaatatgatacaaatatgacatatcatttgcaattttgttgtttttttaacttaatatgtaagcaatgttaaatcattatcactacatcattttcacattatttaaatatacttaatgtcccacattatttgtcagaaggatttgagcgtgatttccttatactatctatacaggtgatgctcactaactcataaaactcaacatgcaagtgtaccacatcatcgtccactagcaattattatctaaagtattttaaatatcatgttaacatgacatatcatttactattttgatgtatatttagagcttaacatgtaggtaatatcaaatcattatcgccacatcattttcatattatttaaatatatttaatgttcccacgtaagtcgtcagaaggacttgagtgtgatttccttatcttcaaagaacctatagtacacttgtaccctgataccatcttgttttcaaacaaccttagtacaatggtataaattatctgcagtatcatgagtcgtgtcatgagtcatgatcgtttgcgtacatggacagatgacgaccgtgatatctcatattccctccttcccataaaaaatcaacctagcatatgatgtgatacatcttgtatgtttagattcgaaatactagaatgagtatcacatgtggtattagattggtttttttataggacggggaagtatatttttgtgttccaatataattattgtttgataccaggaggcacagggtagttgttcttggacatgctgacatgcatattcaaggtcaactctctcggatgatgctcaattgcgccaaattttgcagaatgcgtctgtggaaatttctatattatatatcatggggaaaaaaagtacatttgacatgtctaaacttttttttaaaaaaaatcaatctaaccttttaaaaccggatacgactcttcaccctcttcgctgaactctaaactaaaacggggcaatttcataatgcttagcaaggatcattgaatctatccatacttatattaattaactagcactattgaagaaactatctttggtcgatcagccaaatttcacaataatcccgatcggccaaatttcacaatagtctcggttctaataaaaaccgggaataaaaaacatctttagcctcggtttaaaagctcaggggtacttttgatctttagtcccggttgataataccaaccgggaaaaaagatcggcatatgcggagatcgaggcgtgcgcgcggatcggatcgaggaggcatacgcacgcagtttctatctcctgctccctcgttctatctcctcctcctctcctcgctcaccctatctcttcctctccttctcctcccccctccccctcctccccacttctctggcaggcggcggcggtggcggccaggcggccgggtcggagggcagcacgactggcggcggccagccacacggagggcggcgctcggcgcctggcggaaggcggcagcctgcgcagtggcggccggttgtgcctctaccggattttggttgttttttttttgagaatttatgattcggatctgagatgtatttgatttgtgtgtgatgaattttgtagaacttgtgatgtaatttttttaagattttgtaatatatttggagatgatcgatttgagaatttggaggtgatgatcgatttaggattttacgattcggggataattgatttgggatttcacgatttggggataggggatggagtgaaattaatatattaaaaacaatgaagaaaagaaaaaaaaataaaggagtaaccgaacttagcctggctaaaatacctataattatgagttatgtgtcacgtgttaaaatacctatagttttgtgcgtttggagaatgataggtggggtttaatgaaatttaatctaagacaatactcaatttatttagcatatgattatacagtagacatatgtgtagcaattccctaagaaatatatagtctatactaagtatgcataacctaactttaccctacatgtggcaataatgcctccaccgagctgaccacgtcagggatggaggccttcctactcaaacgcttccaaggtcatcacacttcacacaccattgccgttgcacactcatatcacagtgacggaagacacatctaattaaatactcacgaagttcagctgcacatacctgtcgctcaatcattgtgtcctcaacgatagatgcatggctacacgatatttacggttcagggtttcatagtaaaaattatccgtgcattcagtagttatatatgggtttatggctgggttgggctttgggcatttgatggctgaactgattgtcattctaggccttcggctggtttgcctatccaagtccctcacagtgcttttgctctctctaatatagcaatagagtcaacaattggtgataggaaaaatacgtactatgtttctggaccggctacaaggtagaacccttgcagagttagcccccatattttttgagttaatcctaataagagcgaggaaagcaatgcactgtattgcaagctttggagcttgtttagttctcaactttttctttaaacttctaacttttgcatcacattaaaacttttctacacatataaacttccaacttttttcttcaaacttccaattttagtcaaacttccaattttggtgtggaactaaatacaaccaaagggatggcttctctagtcaagtaattttggactacttgtttcaataagatttggttgacggattgatcttggaacgaggggtttcagcagtatagttagccatatagcccgaggccggacggcccggcccaaggcacatgaatttggcccggcctaggtacgacatggctcgactggggtcgggcccatgctggcccagcccggcccgatagctaggtcgtgcctgggctactggtatggtgaaaaaaatagttgagggatccaacatagacttacttcagtcgaaagagggatataaaatagacttattcagccatataagactcagcccaaagaaataagggaggcaaaataaaagtattttatagggaagcacgatgagcactcatgccttcgggccatgagtaggcccggcccagcccgacgtgtagctcaggtcgtgccgactcgattgatcttggtctaggcccggtcgtgtcttggtcgtgccaggctgggcagcctatttgaccatttatattcagcagtgtataaatgaaagcttacgaagacaggatcctatacgagtaagttggcttatgacgtttatttcctttaatccatcaagtttgcctcgagccatatgaccaactatactgttgaatttgcaatgcagtgcaatgtagaagtgttctacattaaaaattttctatgtgggtagcggttaacagttgctattggactttagatcgtcttgtcaaacggggcctaccgcatccggctgtgatcaagttgatgagaccattaaacaaattcttgtgtgtcttttgttttctttcgagaagtataaagtttaatttttatgaagttgggcttagtttcagctgcaccttagccttttacaacacattttttttccagaatggtggagtaaagttattaagggtgttccaaagagctacggaaggggttcaaatctttgatcggttctgtaatctgggacatttgaaaactgattgcgttttcaatggtctaatcctaatatggtggtggttttgcaggctgtggctaatcagaatagtagtttactagtttatggtatttagcaggatcccatggctccatgagtttatttgtaagttgcttgggtttattggtcaggcctcgcttatgtgtgacacttattggaaatgttctttttggtggagcggttcaattccttgacctctccttgtttgtaaatatttcaatagtcttggaataaagcgtagttatccttcgttttttagaaaagaaaatagcgactgttttagaactgacagttgataatcaatgataatagcactactgattaattaccaagattatgattattattatcggttcggtagtagtcggtctgccaaaccaagtctcgctttctggagtggccaaatgctgctctcttcctcccttcatcgatgtcacacttcaggagtgccaggctcgctcaaatcaaataagagaacttgatgagccgagaatactagtataatgcagcatacgggctacaggaatgtagcaatgctaggaaaaagtaccccgaaggtctctcaatttgtcatcgggataaaaaaacgtcatcgaatcacaaaaccagatatgcggggtcccttaactatacaaaatcggtcacccaagttccttcactggttttgacccctgttttggtccacgtgacgactaagtcagcgttaaacccacgtgtgccccacatgtcagcgtgccacgtcaacttccccttttccctcttctctctctgcttctctgcttcctccctccctctcgctctctgctctcgcagggcatgggaatgccggcgctagggcgcccacggcggcgcgtgcccccggaggatgatgcggcccgggtcgtcgtcgccggcggcattagcagcggcggggaacggg

SEQ ID NO: 15816 - DNA, 17042 bp, Oryza sativa
cgacccctccttcgttctcgacacatccaccggctggcgacccctccttcgttctcgacacatccaccgcccccgacaacccctcctcccaaatcgcctacggcctcacggtacgcaacaccatggcggagtcggagaaggcgatgggttccccggccgcgacggagccggtgaagacgccggcccctcctgcaactgatggccccagcggtgaccttatgcagcggcagtataaggaggacgccgacgccacccatggcacacttgtcggcgacgacacggacgagtcgcgccgcctcttcctcgcggacgtggtggagcgactagacgcggtgtgcgctgaagagctcgagcacgcagatccttcggagcagagattaggaaggctggactctgctcgcggttgccaatggcgtcaccgcctgccgacgtcaccaccccagcgatgagcagctcagtgaacgacggggcctgagcggaggaggacccgagcactagttgaccctgactgacaatattgtcatgggtagattaaagaggcccagttgcacttgcacgcgatgattagtctcagttcttcaagtatgggttaatttgttcttgttatctggctctggtatgctattatcctgcaaatggaatgtttgacacaggtagctgggagctagaaatgcatgcagtcacaaggtcagattgatcgatgcagagaacatgggaagtgtaggcgagattgattgcgagtaacgagccgtgggcggcgcagttcttgggcgccgtgggggagcttgcctgcggcatcgacaccatcaaggtggagccagtgtggcatcgcgtccccaccaatctggcgtcctcgcggatcccgccgtccccgctagttctgggcttctggctgatggtggtgctgctactccttaattaccgtttgcctgcaggtcaagaggctcgaagcgaggattcgcgaggcgtgcgcggcctccgccgcagccggctgccgtcgctcagccccgctcgccgcctggccgtctggtccctacccgtcggcccagcctgcgagagagagagcaaagaggggtggaagggagagagaagaggggaaaagggaagttgacgtggcacgctaacatgtggggtccacatgggtcccacgttgattcagccgctacgtagatcaaaaccactgaaagatctcgtgtgatcggttctgtatagttaagggatcccgcatatctgattttgtggttcgaggatgttttttatcccaatgacaagttgagggaccttcagtgtacttttttccgcaatgctactgcaaggttgacgttctcaaatgggcttgggacaaaggaaggatttgggaagagaagtatgtatggccactagtccgctatttccctttccggccttgcccatttgcccatcagcccagcacaggtacaaatctcccaaacactgaagaagaatattggaggacccaatactttcggcttgtaagacaaatagtaagatatacatatatctatctattctattatattattaaaatagctttgaaaggagacaatacgttcgctgtgggggctagaaattcccatattaatcggagaaaaaggaaaaaaagaaaaggagagtccaagtagaaatacaatataaaaatagctgaaattcggaattaaaaataagcaatattgaaagaaattttcatataagaacccaacactgtataaatcaaaattcaaaataaaaataaaataaaatccaaaattagaaaaaaaaaaaaagaggagagtctaagtagaaatacaatttaaaaatagctaaaatttggaattaaaaataagcaatattgaaagaagttaccatataagaacccaatacgagattaatcaaaattcgaaataaaaataaataaaatccaaaattagaaaagaaaaggatagtccaagtaggaatacattttaaaatagctgaaattcggaattaaaaataaggaatattaaaagaagagtccatataagaacccaatacgagattaattaaaattggaaataaaaataaaaataaaatccgaaattagccaaaaagaaaataagagttcatgtaggaatacaatttaaaattagctgaaattcggaattaaaaatacaaatactgaaagaagaatccatataagaacccaatacgagattaattaaaaatcagaataaaaaataaaataatatccaaaattagaaaaattaaaagagagttcaattaggaatacaattttgaaacaactgaaattgaaaataaaaaataaaaatattaaaagaacacaatacgatattaattaaaattttaaaaaataaattctgttagggttacgggtaaggtataccctttacccttcgatacatgccgcgtatcggtatggtatacctgcgcgtatacggacgctctctgcacacattaagggaatccatcatgcagttcacagatggaaagagtcctactcagacaagactgggtcgtcagtgcatcgtgcagggttcgatgtctccaagttctacttgaaaaccgcttgacctgcgatataaaagggacccccctaggaggacctaagaggaggaatctgatggccaacatcaccaccacagcctacgaagtcggagcctgcggaagccagattgccgagaggtctagttggattaacccgatacgatctcgtcggtttcatcgagttccatctttccctttgtaacctgtgatttccatcatataatcccataccaactggattagggctattacctatcaaggggcctgaaccagtataatcttcgtcttctgtttgcttgatgttgtactacgtagacccttgtaccagcgtaccccaatactctctatatccggtctacgggtatcacccgtcgacagtggcgcgccaggtagggggactttgtgctcaaggttctactactatgtcatccagcctcgtcgacaacatcgtcaacaccaacctcaactacgggcttcctgcctcaacgatgctagcgtggactcaagtcggcgaaatcgtctttccggtttacaccacgatgccgatctcagctgggccatcgatgaccagaaacgagaacgcagtggctgtaacccaagacggctccacgtcgaaaggtcctcccgccgaagtggagaaaggaacatcgacgacatccgaactcgagaagaattctaatgcggccaaaccttgtcgttccgaccagaaacacaagccgacgagaataacttccgaagcgacagggtcctggtgccctattcacaaatccaggaaacatactttgcaagcctgctgggtttttctcaacgcccgcgctgagattcgcgcctgcaaggagcgtggaattcagcgtgtttctccaactcgtggtgtccattgtcctattcacaagacaaagaaccacgacctctcaagctgtaaagtttttctcagcgtcacaaagacgtcatctcccaaggtccagcagccaggcaagacccttagagacgaagacaaagaatgaggaacgacactgaccccaaatcgtttcgttggtgttatcgacatcggttcttccgaatcgtcaattctacatctactcgaggactacaactcctcgtcaacaagtacgccacgtgaggtattggctatcgacgggacaggcacatcggcacgcgctaacaccggggcggaaaatcaaacgtctacactggctcagcacatcaggaccctcaacgcaatactgagggagaccccttatgaccccgttctacacgatgacctcgcacaatggacggagcggttacgagagtcagtgaccaacctcagcaacgcgttcgaagaggctgccgctgcaacccacccggaatagcaaccaactgctggtgccaacggcgaaaaccccgaacagcaggaatcaccccatcgagccagccctccacctcgcggcatcagcaatctccgcgatcacctaaacggtcgccgagaagctcgtcgcacacgggaaaacgagaaccgttcccggcatcacgtttcttcacgacatcacgacaatgaagaacgaggaggccgctcgaacaaagaccgagaccgtgatcaccgccacaaccgtcatattcgcgacgatcgtgagcgacggacgccgggtgataccagtcgaggacgccgccatcatgacgaagacggcagagaacggcgccgagacaacaacggagggcgacgacagtattttcgagaacccggtcggcgttctcgtaatcctacaccggaaccaagcgacccatcgacgtcctcatcttcttcctcctcctcatcgtcagacaacccactgcccccagtgctgggtgtagggctttcggtcgttcgttgcacgatgtccgatggcctgagaggtttcggccgggagcaatagagaagtacgattggagcactgacccagaagaatttcttcaagtctactccacaatactctatgctgccggagcggacgacaacgcgttggcgaattatttgccaactgcgttaaaaggctctgcgcgttcatggttgatgcaccttccgccctactcgatttcttcgtgggcagacctatggcagcagttcgtcgccaacttccagggaacctacaaacgccacgcgatcgaagacgacttacacgcattgatatagagctcgggtgaatccttgagggaatatgtccggcgctttaatgagtgcagaaatacaataccgaaatcaccgacgcttttgtaattcgcgccttcaagtccagtgtcagagatcgctacactacccaggagttagcaacgagacgcatcacaactactcagagactgttcgggattgttgagcgatgcgcccacgttgacgatgcacttagacgcaagaacgacaagccgaagaccgggggcgagaagaaatcagccacggacacacctgagtcaagcaaaaagaaaaatcgcaagaacgcgaaaaggaaagctcaagcagaagtattcgcagcagaatatgctaaccctcccaagcgtccagacccacaaggtagtgacgcaaggaaagcatggtgtcccatacacaagtcgaacagacattctttggaagactgccttgttttcaaaaaaaacgctcgagaagcacatgacatcagaacaaggcaaacgagtacgcgtggtcgagaaggatacggagatgaccgctcaggagtcggacccagcgtatccaaactctgacctccacgtctcacacattttcgggggctctacagcatactcctccaagagagagtataagaaagtggagcgagaagtctgctcgacgtggcagggggctgcacccaagatgaagtggtttgaacagaagatacaattttcggaagatgaccatcccaagaccgccgttatcccaggacgctatccgatcgtggtcgaacccactattcggaatatcaaggtcgcgcgggttctcatcgacggtggcagctcaattaacctcctcttcgccagcacattggacgccatgggaataccacgaagcgagttgacacccaccgatcaacccttccatggaattactccccagtcttcgtccaaaccaatgggcaaaatcacgctgcatgtgactttcggccaagcaaacaacttccggacagagcaaatcacctttgatgtcgctgaattcgatacagcgtataacgccatcatcgggagaactgcacttgcgaagttcatggccgcatctcactacgcgtatcaagtgctcaagatgccagggccgaagggaacaatcaccatccaagggaacgcaaagctggcggtacaatgtgacaagcggagcctcgacatggtcgaacaaacgctaagtccacccgccacaaccgagccacccaagaaaatgagcaagacaaacaagacgccgaaaccggatggcgcaatcaagaccgttcctctctctagtgccaaccctgacaagaccgtcaagatcggggcatcactaaacgagaaataggaactcgcgctcatcaccttcctccgcgacaatgctgacgcgttcgcttggcagccgtctgacatgccgggggtccccagggaggtgatcgagcacgaactcatggtgcgacccgatgccaagccagtaaagcaaagactacagagatttgcaccagaccgaagacaagccatacgagaagagctcgacaaacttctcaaagctggctttatcagagaagtacttcagccagagtggctagccaacccagtcatggtgcggaaggccaacgggaaatggagaatgtgtgtcgacttcaccgacctcaacaaggcgtgccccaaggatcacttccctcttcctcgaatagaccaactagtggactcaacagccggttgtgagctgctgagcttcctcgacgcttactccggctaccaccaaatcagcatggcgagagaggacgaagagaagacagcattcatcacgtcgttcggggtattttgctacgttaagatgccatttggactcataaccgctgggaacactttccagcgcacggtccagggcgcacttagcgaccagctcggcaacaacgtcgaggcatacgtcgacgacattgttgtcaagaccaagaaaagcgactcattgattaacgacctacgggaaacgttcgacaacctccgacgatatcgcctcatgatcaatccagagaagtgcaccttcagagtaccgtcgggcaagctgctcggcttcctcgtctctggcagaggaatagaagcgaatcccgagaagatcaaggcaatcgagaacatgaagtcgcccacaagactcaaggatgtacagaagctaaccggatgcacggcagcactaagcagattcgtcgctaggatgggagaatgaggacaacccttcttcgctctctgaagaagcaagataaatttgtatggacacaggaagccgaagaggcatttattgcactcaagcgctacctatcaaatctccctgtactcgttgctccccaacctaatgaagaattattcctttatattgctgccacgccatactccgtcagcactgtaattgtcgtcgagagagagaaagtccaacgaccagtatactatgtcagcgaagctctccacgacgcaaagaccagatatccacatatccaaaaaactgctctacgcagtaatcatgacatcaagaaagctacgacattacttccaagcccacagagtcacagttgtctcctccttccccctcggtgaagtcgtgagaaacaaagacattgtcggccgcattgcgaaatgggtagtcgagctaagtcagtttgatgtccactttgtaccacgaacagccatcaagtcccaagtactcgccgattttgtagctgactggaccatgcctgataatcaatcaaacaaccagatcgacaacgtggataatggcgttcgacggtgcactcaacagccaaggagcaggggcaggattcatcttgacatctccttccatagatcaattcaagcacgcaatccacctcaacttcagggcgaccaataacacagccgagtacgaaggactactcgccgggataagagcagcagccgcacttggggtcaaacgactgatcgtgaaaggggactccgagctagtcgcgaaccaggtacacaaagattataaatgctctaaccccgagttatctaagtacctcgtagaagtcaggaagctggagaaaaggttcgatgggatcgaggtccgacacgtataccgcaaggacaacatcaagccagatgacctagcgcgacgtgcgtccaaacgagaaccactcgagcctggcacctttctggacatcccgacgaagccatcagtgaaagaggcaatcggcgagatcaacacagccgcccccgacatcagctcggaggccacagaggcggaacgcgccattgccaatatcgagaccacagacgattggcacaccccactgatcaaattcatcaacagcgaagagttgcccgaggacgacgcagaggctgagaaaataacccgtaaagcaaaaatctactgcacgatcggcaacgatctatacaagaaagcgccaaacggagtacttctcaaatatgtctcgtccgacgatggcagacacctcctcctcgatatacatgaacgcatctgtgggtcacatgccgccggtcgcacattggtcgggaaagcctttcgacaagggtttttctgaccaaccgccctcaaagacgcatgtgacatggtccagcaatgtgaagcctgtcaattccacagcaagcacacaaagctacctgcacaagcgctcaagaccatccctcttacttggccgttctcgtgctgggggctatatatactcgggccattcccacaaggacagggcggctacaagttcctattcgtggcgatcgacaaattcactaaatggaccgaagcggtacccacgggggaaatcaaggccgccaacgccatcaagttcatcaaggggatattttgcagatacggactaccgcatcgcatcattacagacaacggctcccagttcatcagtgccgacttccaggattactgcatcgggctgggagtcaaaatatgcttcgcttcggtttcccatcctcaaagcaacggacaagtcaagagggcaaacagcatagtactacaagggatcaagacccgtgtctacgacaggctcatgtcacatgacaacaaatgggtcgaagaactcccatcagtactatgggccatacacaccacaccgacaacgtccaacaaggaaacacccttcttcctcgtgtatggctccgaagccatgctccccagcgagctacgacatcagagtacacgagcacagaagtattccgatgaggaacaggaggagcagcgaaacgacgatgtgaatctactcgaggaacatcgcgaacgagttgccgttcgagcagccgcctaccaacaagcccttcgccgctaccacgagaagcgcattcgagcacgcatactttcgatcggcgactacgtcctccaaagggttcaaagccaagcagggcgaaacaagctctcacccaaataggaaggaccatacacgatcacacaagtcttgcgaccaggcgcattcaaaattgcagacagcgatggccacgagttggcaaactcatggaacattaaccaactacgtaaattctatgtatgatcaataccatccatacctgtaagacaacttacatcatcaataaagcctattttcaggcgcatattacaatcacattgttcatgcctgacgatccctcacccagatgacacctagcgttgaaacctatcctcatgtccctttacgccatgctgacaaggcctccgaggatcctaagggatcttcggctgggaacgcccagagccgataaggccttgtcggattctgtagagacaaaagaccatgttagacctgatcgtgtaagagttctccccgtgcgtattaagcaagccgcgtaatcggaaatgaactttccaacttcacggctgggtttaggatcagtgcttgttcaacagaggtaggtcaaaggtccaagagccttgtcctccgggaaccattctccgacgacaaggctgggggctagggagagtgtacaactcaaacgactgcccaaagtcaagaactgaggaggcactcttacacactacatccagagtaagaaggactcgttacgatagatctcttttctatttcataagatactttttacaattccgcacaagtccaaaattatattacatttttccctaagatgtctgtcacagggtacaaaggctaccaggaaggccaacgccagtccatcgactggaaaacttcctccgcaagcggcgccatcgacttcgccaggtgttctatctccgccagagtcctccgagaacgagcgaatgtgaagaaactcgaggtgcagctgcggacgatgatctcgtatgcaagccaacacatgccctccggcatatcggctcgaccgacggcattcctgcttcaaggcttcgtcaatgcgcttgccgacgccttcgagctgagtacatgccccattcagccacgagatgtagccggccgccgattcctcgggatctccacggggcacccggagctccctacaaacatgggccatggacgtgcagcaactctttagataagagtcgaaccacacctcgcgacccctgagtgcctccacggcctagtcttttttcacctccaccatcgccctcttgagttccgcgacttcacacttcgtcttccaatattggatgcgacggtcttggtcggcaagtctactctcgaggtctgctcttccattccgagaacacaaaaaccaagttactccgggaagaaaaatgaaggagatgaaaacaaagatcaccaacttaaggaggtcatcgccacgcccgtttccacgggtgagtcttgtcccatatcatcctgcgacataggcgtttggagggtaatcgccggggcgaccaccggtaacttgggctgcccacgctgctggacatcctcgacatcgacatccctacaaacgacaaccaaaagtactcaggaccagggtgccaacagagatcaaggcagcgattgcacgaataaaggcagttgaagccgacaactgttatacaaagtgtagtcgattacaaatgatctgaggccctactcttcaaaaagcgggagaacagactctcccagttcaccaacctcctccatcacgcccttacgagcgtcgttggcagccccccggtccaaggtctgctgaagatcgagtttggggtgcgccagtcggacacacgctaggacgtgacaggcccgtgtaaatcccgtttgacgcctcctccacgaccctggccgcatgcttggagggtatcgcctccatcgccgtagccagttccgcaagtgaggacgtcagcgagaactcgtcggggttcgctgggatggttgtcgtgacgccacactgcccggcgagctgatgaagaccggtgtaggtgacccgcagcgacccacggatctccgacaggttgttctcgagttccgacatccggtcctcgagtccccgccgttgccactcattaccggccaccagctccctcatcttctggaggtcctcgcgaacctccgccaggtcgcgttccagtttgtcggcatgcttgtttgccgacgacgccgccgccgtcttcgcctcctcgatctcacgactcacgccgcgagcgccagcctcgaggatgcgtttcatctcagcttggagctcccccaggtgaggacattggcagatggcccacgagtaggtctgagggcactggacggaccgcttggcatcgcttcatggctctttggcgcgacaacaacatcggttgaggttgccgcaggagacgctccggaggccccttcggacttgtcctgcgccgctctcgcctgcgccgcccttgcctgcgccgacctgcagaagatcctcaaatcaagccgccagaagaaaaacgaggagaggatctcgacttccgcttacttacttctcgcctagcgtcaccagcttcctccgctgcggaggtggcgaagacgcgtccacggcctgggtaaatcaagcgcgagttgaggtgacatctcttgaatacgagattaacaagccaagggacttaccggtggggaggatgctctccggcgcctaccgagaacggaggtgaatgtccttcccgttttcgggacacggctgccactagtcgtggcagcagcggcgatggccacgttaggcgtctcccgagcgacgctctccttcagtgaggccgtcgcctggtggtccgcgagcagtccaataacgtcagtcagagggagagcctacaccgcatgaaatcattttccgacccgggaagcaaaaatagtgaggttaccgagtacactcacgttgattgcggcttcacgctcgatcgcctccttatcataaagaggcatggggacgtcgcttgccgttgtcaggccgctgatcattaattggccgacgcggcgctccacggtggcgtcactcaagcctgcagatcaagaacagaattcgataaattagggagaacatgcacagaaggggatcaaattaaacacaagaaaaataccccgaggagaaacccgggtcgcgtcctccggccaagagtagtcaaaggctgggtgggcgagagcctggagcagctggatccgcctactaatgaagtcggtagcgacttcataccccgacaaacctcgcgctcagaggtcatcaatggcatcgatgaacgactgaagagcaggggtcaaggcgggttttgcggtccaagatgggattttgtctggttgttcctcaggaacgacaaagatcggatctgaatcctctatctgaagatagaaccaccttgcccgccatctgctacgagaagaagggcactggaaggggatatatcgcgacttcaggccatctcgaagtcggaaacccacacatccagataccctagtagattccatccaacgcaactcgtagtagaagcgaaagaggtcgagaaacggctctaccccaatgtaggcctcacaaagatgtgaaaagatgctgaggaaggcaatggaattggggttcaaatggagcagagaaaggccgtagaaattcaagaccaagagaagaaactcagaaggcggaggaagaaagccacagagaatatagtcctcgatcgcaactatacggcccaggacaggttcaggttcagtacctcctggttccctctccatggctccgcggccggggagggcgccatcctcctgtagcttcttaagcgacgcgctggtggaggtagacatgccgagatccatcgccgccggagatcgccggagaaggggctgagatgaacaatctagggctttgcaggagcggaggagacaaggaacgcctggaggctggagagcttttttcacaacgggcggacttcaaaatggatcctcaaaatcctcttaaacagacgcatttccgacggtgcgaatttcaaggaaaggagagagagattaccgccgaaaatttctaggtccgttacgcgcggcagtttttcagacttcagtttaaattcactcatgaccgttgggcttcacatagtgttgtcgattgcgtcctatctctacggttcgcacaccgagaacgacaacagcctcaacaccagaagtcgcgattggttacacgagtccatttaagcagaagtcgggggctactgtcagggttatgggtaaggtataccctttacccttcaatacatgtcgcgtatcggtatggtatacctgcgcgtatacggacgctctctgcatacattaagggaatccatcatggagttcaacagatggaaagagtcctactcgggcaagactgggtcgtcagtgcatcatgcagggtccgatgtctccaagttttacttggaaaccgcttgacctgcgatataaaagggaccccctgggaggacctaagaggaggaatctgatagccaacatcatcaccatagcctacgaagtcggagcctgcggaagccagattgccgagaggtctagtcggattaacccgatacgatctcgtcggtttcatcgagttccatctttccctttgtaacctgtgatttccatcatataatctcataccaactggattagggctattacctatcaaggggcctgaaccagtataatcttcgtcttctgtttgcttgatgtcgtactacgtagacccttgtaccagcgtaccccaatactctctatatccggtctacgggtatcacccatcgacaaattctaaattagaaaaagaaaaataagaattcaattaggaatacaatttataaataactaaaatttgtgataaaaataaagactattgaaagaaaagaccatctaaaatacatgacgagataaattaagtatccggcctataaaggagtagagtggtggcgattgatacgacatataaaaacgttaataaaacaccaaataaaggagggacgacaggcatgccatgaagcaaacgagcaaggcagttgtcgagacttctagaaagtaaaaaaaaaccctattgataatcatattcgatttttaaaatctcaatgataataaaaaggagaagtagcgggcgggatgtatagaagtatagttgcagagccgccgacggttgacgggacttctagaaaataaaaaataaattccaacgatagttatgttcaatttttagaatcacaatgacaataaagagtagacggcagacggaccgtagaggagaatagtggcatcgtttggtgagacttctaaaattataaaaaaatgaaacccaacaagacaataaactctaaaaactacaaggtccaaatttttaaaggtttggaacttctaaaaaataatgttcgattttaaaatctcaatgacaataaagaagggagacagcgggcgagccgtagagaagtacaatggcaaagccgctgatggtttggcgggacttctagaaagtaaaaatgaatccaaatgataattatgttcgatttttaaaatctcaatgacaataaagagaagagacagtggacaggccatagaggagtataatggcaacgtttgacgggacatctagaaattataaaaacgaaacacaacgtgacaataaactctaaaaactataagatccaatttttaaaggaaggagatgacatgaggggtagcaactggtctgacttttaaaacactatataattagaaacacagggatgataaggtttggtctttcaaaaacttaagacaacgagatagctatttaataaattttaaataaaatcatactaaaatatatatgattttatttggatgttagccgtgtaattgcgcgggtcacccagctagtttaaactattctaaaactaactggagcagcattttttccctctcgtcttgttaagatttgggttttccggctaattcgcgcgcgacttttcaggataagtacttctctcctctttagtatccctcttacccaccttttccccctccatcccattccatatctccatgtggttgggctcttttctcctctaagagcaggtacaatagcaggctataagccagttgcaagcctgcaaacatattttaagtagataaataaggagagagaatggcagcgagctacagattcgtagccagctgtagcacggactccaagacacattgtgtgtatggcaggtgggaccaggtattaatagcgtagtatgtaactattgtatgaatgagctattagattggctatagatgaattggagcttgtagtaggctatactattaaacttgctctaaggctgtattcgttattcctttcccaaccagaacagtacgcatggaaaatgaagcgatccattagcacatgattaattaagtattagctaatttttttcaaaaatggattaatttgattttttttaagcaactttcgtataaaaactttttgcaaaaaaaagcaccgtttagcagtttgaaaagcgtgcgcgcgaaaaaaaagagggagatgggttgggaaaagaggtgtagatgttcttaccctatgtttcctaactcatctccctcgttttccacgctcatgcttttcaaactgctaaatggtatgtattttcaaaaagtttcgatacaaaagttgcttaaaaaatcatattaattcatttttttaaaaatagctaatatttaattaatcacgtgctaatggaccattccgttttctgtgcgtagtgttctggttgggaatgagctccaacgaacacagcctaaaggctgtctctaggctctattcactttatcctcacaagtaagagattgaaggggactgaggggattaatttcacacctcaattggtataaaattattcctctccctaaatcccgctcaattcctttatgagtgggaacaagacctaacggtggtgtttctctgctgcccttctggctcggacaacaacagtgctaccactgcctccttggccacgacctcggcagcccaatggtggtcggtgctcgccgtcgcgtctctcttggcccaatttttcctttttcatgaagataccctgaagccatcaagagagatgggctaggccggttacacgtgggctcacttacatgtgctttctatggtatggtttggtttgtggcctaaataggccttactaaattttgtcagtgcaaaattttggcaagtttttgcatgactacttttggtaaggtaaagttgtgtttggattggagccaaaacagcctaagttcactattgaaatggcctattttcttaggcatgccaaaatttggcttcaaaccaaatagacactaaacactattgaaattaccaaatattggtaagcctaatttaggcctcaaaccaaaccagccctatgtatttttattttatttttctaactagatgtcatctacatatgtgaaagcagcaagctttctcaaaactaataagccacgtcatgtgaataataattgccttaggatgagagtaggaataaatttagaccgttggatccatttatgtgtataccaatcacacatcaggagagttccagatgaataggtcatgtgcatcgatcagtgcatatacagatagtttcagatggtagtcagagcaaaactagtatcaactaaaaccacctccaatactgtcatgggatctgatttaaacggtttttttcttttcaaagatgcgggaggggacggtggtgaaaaattctggtatagtggtttaggatgtctattaaactcgatataaaatgagaaatagcaactggatttattctttttagcattccgcaatagagaatagccgaaagtattgggtcatcgaatccaataatattttgcagtgtttgagagattgtacgcacatgggcaaggccgaaaagtattgggcctacgtgctatattttcagatggaataagttcacttcgtgaccctcaactaaccttaaaccacaaaaccagatatctcgactccaaactcctaaaact

SEQ ID NO: 15817 - DNA, 2135 bp, Oryza sativa
gatgctgtccaagaaacagagacaaagatgatagagatgtcagcacttaatcatctcatatcaacacatgttctacaacaagctcagcagatccagtatttatatgaccaggtagaaaatctatttaagccagtacaccatatctgttatttgtttcttgtagattgtcttcttatgtgaacatagatgtagatattagtggaaaaaatataaatggcactcttttgctgatgtactgttaaacatgatgtgtctgtcgtttgttatcatccactgatctttttattgggatctttggaacacgcatctccctcattaaattaaactttccttttctgaataactggcatggtctctaccttgcatttccctcataataccatctaacgaaataggttataagatctttaactgatgactcaggaggtccatggtgctatatatgaaaattggcaagtgatcatgtgcctttatctgtgtgttttcattcctgatttcttattatagcacaacgtatgccttcttctcaggcagttgaagctacaaacaatgtggaccgtgggaaagctgcgacggcggggagaggtgtcagggtggcggcagctgcgacgcctcggaaggaggagtacggcggcggcggcggctgcacggctcgctgctcctgccctcgcccgtcctgtcgtcgccgctcgttctcaccgcccgccgccagccgaaggggaagaagggggagagaaagagagagaagggagagagggaggaggaagaaggaagaggactgccatgtgggcccatatttctttttttaatgactaatgggtcccacacatattttttaattctaatgccacctaagtaccgcgtcaacaccacgtggaacgaagactcggtcaatatcgccacgtagacgccacgtggcgccacatcagcaaaaccgccctccaaaaccaccgagagtcaaattgcaccggttttaggagtttaggggtcgagatatccggttttgtggtttagggttatagattagatttcgatcacagttaaaggtcacgaagtgaacttattccttttcagattcttcctaaatttcttcggcccattgacgaacgtcaccttgcattgcaagcgatttttttattttttttatttactttttaaaagatttaaaaaaaatcatatttcaaagtagtttaacagaaatatactcctctcgctctatggtagggcgagacatataaataaccttatcatagagcgagacatataaataaccctacggtacgacaatcaatgtgacgtgacaacctataagagaaaaacgatccatcgctgggaaggggcagcctacaaaatcaccatcacgcgtcccatacatcaccaaactattgctaatgtcactaaaataaatcgtccaaaaagggtgagaaggggttgtctacaaaattaccatgacatgctcctcccaccttatgtcacctcacatagcccgctctaccatagggtaatttatgccccgccctacaacaaagcggccctacaacaaagcggttgtagtatatttttacaaaactttcaaatggtatatttttataaatattttttttaaaaaaagtaaatattaaaaaatatccattgcaaggtagctagccgccgtgtagtcggtagctggcagtgaaataatggcggatataacgagcgcacgtaattacgttggaggtgatttacctcaacgctgaagatgtattccagttatataatctagcatggagatgttacacatgttaactactactccctccgtcccataactactagagaagtggatttagttcatgtttgtaacctctttatttttaagttgcaaccggtcgggattaccaactatgaataaaaataataacgtcatgtggctgtcgtcttttcttttctttttttatttttttttgctacttgcatattgatttcgcaccaaactcaacgacaaaatcatctacacaaaacatcacaaaatcatccatgaattgacatcacaaattcatctacaacttcacataaacatctaaaaatcatccacaaatttacatcacaaaatcattaacaaattcacaaaaacatcaaaaaatcatccataaatt

SEQ ID NO: 15818 - DNA, 16800 bp, Oryza sativa
gatttggtctttttttgaggatatggtattttagtgtttattatggtgttttttaattgctttttgctttttattatatctatcggattttaatccaaagattaaaaatctgtgtgatacgataataaaaatctttcgaaagatgtataggtactccctaatttttttcccgttcggttagccctcagtgggtaaaaatccatgcaatccctacccgattttgctatccatctctcgcgatttttttatggcatttgacacttttttggcctccatgcaaccacttgcaatgcagcggcaattttgcaggtcgaacgttgcatgcagtgcagctcgccggccggctggcacatcgaccagtgttaccaagctaccccgcgcgcgcgcgatgatggagaagcacggtgtcaaggtggcctctgattggcgagctggccgccattagtacggccaacgctgttcggtgagcgacaccgcccctctcgtcatcgtcgtcgtgaaatatagagttacagtcctatataactaaaattacatttgtaaatttagttgatatgacatgtaaatgcactgtaattttgataaaaataatatttaagtaaatatatatttgtattttctttaaaatataaaattacagtcctatataactaaaattacatttgtaaattcagttgatatgacatgtaagtggacagtaattttgataaaaataatgtgtaagtaaatatatatttttattttctttaaaatataaaattacagtcctatataactaaaattacatttgtaaatttagttgatatgacatgtaagtgcgctgtaattttgataaaaataatgtgtaattaaatatgtatttgttatattctttgggaccacctatacatttgtcgacaaattttctcctaaaaatttgacatatataattatagtacaatcgtagtgtaattacactataacttgcatgtaactacagtgtaacttgtatgtaagttttacgtaattttgaatcgatagatctattacaagatttgttcttgtgaggaagaaaaaaatcacagcatacacatatatgaaaggatttgttcccaaggcctcaattttaccgaaataacatgttacggagagatttttgaaagttacatataagttatattatagttacagtgtaattgcatgtaagttacttacgattgtactgtaattacatctgtcaaatttttggaagaaaatttatcaacaaatatatagcaaaattgtattcttttgtagtccgttggatgtaaatctaagggtagaaaaaatctaggtgattttttttattggaaatcaccggacaaatggatagacacagtccctttcaggttctcttccatcaccaagacaccaacggaaatcaagaactcttccattgtctgtcttctcgcataaaaggttccacgtggtcgatgcctcagcgttgttctcctagggttcattagctcgctgctgcgccatgaagtacaggaaggggggcaacgcccccgccaccgagcccgacgacgacgccacgacgaaaggaggtcacgacgtgccgccgagcatcaaggtggacatcggtgagtaccatggaggaggtatcgggaacggggacggtggctcggcctcgctcttcgagccgcggccggaggagacaccggtgagccggaggaacgatcgcggcggcggcggcggcgggcgcgagccgccggagaagcggctcacgctgttcgctctccgcctcgccgtgctcgagaaggcggcgagcgggctcgggaagctagacttcgtgtgggcgacggtggtgctcctcggcggcttcgcgagcgcgctcagcaccaccgacttctggtgcgtcaccgtcatcctcgttggctccggggcgcgcgtcttcggccgcagccacgagctggagtggcagcaccgctctacgctcacctcctccaccgccggtggcgcgctgcgctccacctcccgccgcttgctccgcagcctcgggcactctcccgccgccaacccgaccgacgacggcggcgcccgtggcagtgcgaccgagacgcagttccagcaccagatcgtcgctcgcacgaagcagcgcgtttggcacgtgcccgacgtgtcgctactcccctacaccggcaggttgttcgtctccaagaacatcgggaggctcttcagctggctgcaggtgctctccgccttggcctgcgtcgcgctctcggtgatgcgcctatggcggcacgacttcggcggcgaccagcccaacaagcggccggcgctactgctgttctacacgttggcgttgatcgaggcgctgatcttcctgctcgagcaggcgtactgggtatggatgttctcccggcagaatctgatcaagacggtgagcgacgactgcaagctcggagagtactacggccccgactcgctcaagcgcttcttcttcgacgcctactcccgctgcatcacggggagcatcttcgacggcaccaagatggacctcgtcaccttcgccgaggagctcatcctgtcagagttcctcggcaatcagctcatcggcgtgcgcatcctgcagcagttcaccaccgagggctcatcggccaacgccggggaatccaatctcaacacgctgcgcaacgttggcacgaacgctcgctccatcgagcggctcgtggagatgatcaactggaagagccccggggaggaggaggtgcgccggtgcgcggccgaggtgttgtccaagctcgccgacaagagccggaacgcgctccgcgtgtccggcatccctggcgccatcgagtccgtcatgtccctgctctacaccgacgagagcgcgccggactccgcggcgccacacgacgtctcgccggcggcgcggagctacgatcaccagcagttcaaactgctcggcctgctcatcctcaagaggatcgccagggaccacgacaactgcggcaagattgggaacacccgcggcctcctctccaagatcatcgagctcacggacgcgtcgccggagctgctccacaacacgcgggcgccggagtcgccggttcgcatcgtgaggcgcgcgctcaaggtcgtcaagattctggtgtccgcgacgagcagcaccggcaagatgctccggcaggaagtcgccgataacgtgttcacggtgagcaacctgcgcggcgtcctgcagcacgggcagcagcacacggctctgcagaagctggccacggaaatactgtcgcacctggccatggacgccaagggcaagcaggtgatcgtgggcaccggtggggtggtcaagctgctgctgtcgatattcgtcaacggcgagaaggagctcggcgcggaggccggcgaggcgctggcgatgctggcgctggagagccaggcgagctgcgcggcgatcctcaaacaggatgacgtgctcgaccacctcatgtcggcgctggagggcgacggcgggccgcgtcgcctgaacgcggcgagggtgctgcgcaacctgtgcgcgtacgccggcgagaagcatcggcggcgcctctccacggtgaccaaagcgatgcctacggtatacatgtgtctaatatatttacacaagaacctttcttgagtcgtgagtcgtgacgtaattttgatttgattgttaattactatacactacatgttttgtatgatgacttgttgctgaaggtactgaaggccaccatgacggggagcgagaggaccctcgaggtgttcgtcggcctgacggtgcagatctgcaagttcatcgacggcgttcggttcgccggcgagctgtgcggcgccggcatcgacgagagaagctacgtggagcggctggcgagcatcctgcgggagcaccggtacccggacatcacggtgccccggatgcggcggttcgtggtgcagcaggccatctggctcatgacctcgtcctccgccgccgccgcctccgccgccgctggcgcagactacgtatcgcttctccgggaggccgggatggagcggctgctggagtccatcgccgacaccacgtcggagctggagtgctaccacgcgttctccggcagcgtgggcatcagcaagcaccgggagagcttctccgccgccgtggacgccgcactcgagctgctcggcggcgatggagctcgagctgaggcctgagctgcatgcaacggtcggaactctaaaatggcaaaggatttgtggtgccacgctggcacgctcctcccgcacgttctgtgcgtcttgatgattgcacaacacaaaagtcctattctttttttttcttaaaaacaaaaagaaatacactacacttatacgagtagaaatttttactatagctaaaaaatttgccactattacacaaggatgtatatatgcactatctgttcatgagattcactgaaataacatagtacatatttatagttttgtcgttgctttgctttgggggcatatttaggtcctatttgtttcagtttaagattattataatctagattattaaatcagattactctaaactggattataataagctggcataaaataagctacgagttgtttgtttctctggattattagaggcatctaagagtagtgggtcattagccactcaataatctgaaaaaaagctcctctagagaagattattggattatagtaatctggcttatagattataataatctagcataataatctacttgtttattttaacttgctcctaataatctagattataataattataagctgaatcaaacagggtcttagttttggaatttctaacacaaaaatctacaggacataagtcatagcatgataccccatggtaggtacgtaacccaggggttcatcagttgttgtgcgcaactccgtttgtaccggagcagcatgatttttgagttgtgtagagtatcattttgatcgagcaatcgatgcgttactagtgctacttaggaatgaaaagtgcattttctttcacatttacatcccctctgctatggatgtattcgagtattcaaatccagtcgcccaaatctcacacgaatttgacgaaaccctataaacatttcagtatttttttatgatcgccgtatgggccatgaggcccaacaacgggtgatgctgtaccagacggcccagcaactgcaatcatcacaagtcttcgacggctgcatccggcggcgacgacgcggcggcggcggctaaatcggagacccgcctcatcgcggcgcgagctgcagagtcgcaccaatggaagccgccggtggcgcaggcggagcaagcggcggcggcggagagtcgcagccgccgaagacgctggtggactgggcgctggagatcctcggcacggccgaccccgacgagaaggcccgcctgggggacctcgccgccacggagtggctgcgcggcgccatcccgctcccctacgacccgtcccgccccgcgcggccccctcccgaccgccccgcccggagcgccgccgtgcggctgctcccgccgtcgcgggcgcccaagctggggaagggcggcagcgcgcagagccggctggcgctgctgcactccctggcgcacaccgagagctgggccgtcgacctctcctgggacatcgtcgcccgcttcggcgcgccgctgcgcatgccgcgggagttcttcgacgacttcgcccgcgtcgcccaggacgagggccgccacttcgcggtgctctccgcgcggctgcgcgagctgggctcgcactacggcgcgctccccgcgcacgacgggctctgggactcggcgacgcgcacctcgcactccctcctcgcgcgcctcgccgtcgagcactgcgtccacgaggtgagcatactattaatgcacactattaattggattagcatatcattgccaaatcgactcactgatgattcgactgaggtgagggatgattgtagaattagagtagcatctcattgcaaatacggctttattactatcatgaatgcagtgctgggttacctatactactttagtgttgtaagagccaaaaacttgaaagctgagtgccttccatgaaattcaattgataaacagatcagtattttcatcatatttggttggtctcataattgtgtctcacaagaagttgtagatttgtgtttgggttaaataagcaaattgatatttttgttaaaaaaaagactgtatttgatacactgaaatgaataggcagactatagaaatttccatcatatgtttctcttaccttttgtatcagtaaactactaccattttactagctgtaagactgtaggtagtctatattttcttgcctctgatctagtataagtgtaaccgtataaagtacaaccgaatggcatcttcttatgatcgtaagttagataatgagctgtcactgccataaccgtagcccctggtatcatttgattggtcatgacttttgattcttgtgacagtcaatactttgaggcaactaaaatgaatttggacagatctagcatactgctttgcaccatttactgttgttttggctgtttgtgtaagatgttgatactcatagaaaatgaacgatacatttatccataagctagatgtaaacaaaatgctgactcacttgtgatatgcatgatgattttaatagacgcacaaagtgtatataagacgtcggtaattcaaaatggtatttgaaaccttgggctatgtatggggtcaaatgaccttccaaatcagtattttggaatgttaattttgtgtggaaggccttacacactaaatatatttgttcaatttgctgctctgctagtgttttttttccttgatgcgattggcgactactctctataattcgacccttaggagttatccagttttacagacctttaattttgaaatgcgatgtagtaataataatataatttatgtaacctatgtcaatatccctgacatgataacttcactgaacatttgtacaagtacatgactgatgaaggtccatttggaatacaggctaggggattagatgttctacctaccaccatatcaagattccgcgcaggtggggatgaacaaacagccaaattactagaagatgttatttatcctgaggagataacacactgcgcggctggtgttagatggttcagatacttgtgcctccggtcccgcaatggtgatccaactgcaagttcaattccgcaggctataacccaatgctctgaactcccacgagatggtaccggtgacatccacaaggtcgaagaggtggaaggtgatggaccgaaagccgagttagcacaagcctccaatggcgatgacaagacagtccaacaggtggaggatgaactggcaaaatgcaaactagtcgacattggagatgatgttgaagcagcggtcattcggactttccacagtgttgttagagagtatttccggggacccctgaagcctcccttcaatacggaggcgaggaaagccgctggcttcgagcctgcctggtatgaacccttggcagtgaaggaggtagagggacaagcagttgagtgagatgtttgatttctgccatgtactgtagcaggctagaacctacatggtgggcattacacttctgttgaacctcttcttccctgttcccttcttttagcagggaaaactgtactgaacttgtgatcatgttttgtttgccatacggaaaccgactggtctgtccgtggaccagccaaaccaaattaaagacagaaactttacatttcatcgcattagcttcgttgtaaatttcttcccccaacgcaatggaggattccttttcgtttagttgcagtaaagcacaatagaagtggtttccgcaattctgttgataggattatctagggctgtattgggaccaattgggcccgcaagaaacgagaagggaacataactgagacaccacatgtcagcgtcctctcttctcttctcttatttttctcttttctctcctctttcctttcgtctcctcccttcacttcttcagtaggctgggaggcctgcgggtggggcggcggcgggcaaagcaggcaggggacaacgcggtggtgggtggcaggcgaaaggcgaagcagacagggggcggggcgcatcacctgcggccgcgcgacaaccgaggcccgctccagcacggccgctccctctccacggaggccatccttgccgtgcaatccctcaagcgcatcacctcttttgaccgctccccagccgccgccgtgccctcgacttccctcggcgcctcctcaagagcgacctcctcgccgccatggctgagctccagcgtcaaggctgttggtccctcgccctctccccactccacgtcgcccgcatcgagccttggtactaccccaacccagctctctacgccacgttcgtgtcctcctcgccagtcactgaggatggcaccgccgccgccatggacgtgctcgtggaggcgttcctagaggaggagcgaggcggcgggttcgtggagggggaggaggacgtgtacaagctgatgcggcttgtgcgcacgctggtggcgaaggagagggcgcgcgcggcgtggagggtgtactagctggcgcgtgtggggactacagacagacttagatgtaaagctgagggacttcagatgaacttattccgaccgggaatgcctgggcccaatcggaccatatactccggcactgggcccaattgggcctgcaagaaacagcccgtcgtcacctgtggtggcttgcttttcttgccattggaagggtggaggaggaggggataagcgaggttgaaggagacgcacatccatcccggcggagaggatgctgctgctgcgcgccgccagggcgtcgccggcgatggccgccgtcgtcaggtgcaaacccaccaggctgaccccaatcgcgggcctctcctcctcgtcgggtgggggcaggaggaagaaggccgggcggcggggcgaggccaagcccccacccccacccccgccgcagctgcggggcggcgagacgaagaagaagaagaagccagacgcgaggacggcggcggaggcggcgcaagggttgcagaggcatgaggtcgagaggaggaagaagccgccgccgccgccgccgccgccgaagcaggagaaggcgaagcgcgtggtgcggtggaagtgcgcggccgggtgcggcgcgtgctgcaagctggacaagggccccgacttcccctcccccgaggagatcttcgccgagcaccccgaggacctcaaggtactcccaacgatgcaaaattctgcctaatctactactaccattctgcaacgtactacctccgtcccgtcccaaattataagcatttttcggcttcgataacgtctttactaacaatatctataaaaataaaacgttttaaataaaaagagttgtatattatgatagtttgtttagtgataaatctaggaacatcaattttacaggattgatcttttttatttttttctattaatagtcaaaattgaaaatgtttgacttgacactatccttatatttaaggacggagggagtatatactaaaacgatgtaaagaaaaatcgacgattacttgctgtttctataaattgcaatattgttatgacttatgaggtgatgcaagcttaatcaaccaacgctgatgaatgaatgaaatgatgcttcacgcctgcagctgtacaagagcatgatcggcgccgatggatggtgtatcaactacgacaagtccactcgcacctgcaacatctacgaaggtagtcacaaactcaacaggacgaatcctgtatgaccctggtgtgtaatgggccatttcacctgacactgttctggttgatgcgtcgcgaaacttgcgatcgtagagaggcctgtcttctgcagggtggaaccgaaggttttcgaggagtacttcggcgtgccaagccgacccagcacgtttgacagggaagcttgcaggtttgcttctcctgtcctgcctcgtgtatcgctgggttagttcgtcaaaggtggtgatttcgggtttgtttacttgttcgcagtgcttgtgtggataccatcaagatggtgtatggtgaggagtccgcggagctaactaactttaaacgtgtcataagggaagaaagtaaaaagcatgaagctagcctgaaccaagataaattgttggatacatagctcctggtaagaactctgtaagtctatagttctggcatggcccaaatcctgaattttgccgccctttacatctgtaaagttgactagtaacttgtaaatcatgtggttcctttagtgagtattgctaaccattcatcgtagagatatagaatctcatcgcatattgttttttcttagatatgcattccatatcttcaattgatttgaacattgtgatacgatgatagctcctttctatgatgtggtttaggcaagaaaaacaactgccaaacaccaaaatgtgtgaaaacagttcgtccaaaagattattatcgtagtgcctcactatgccaaacggggccttatatatggcagtgagccagtgaagataatcttgcaacttcataccatgttaagccttgtcatgacatgtttgctgatgtataggtttttgtttcaggtaaattcagaagacatcaatggcctataatgtaaaggtccatatatttatgtttcctgctgtttgatgtgcatcagtgcctcaaatggttaaacgtggaacacgcaccgagatgttgagggagttttacctgagatgttgctatcacggttcggaggaaatgaattgacacttgcaagttaagaaggcagtcggatatgctcaagtttataagcttgttgagtgagggttggtggtattattttttccccgttattgttaacaattgtttgctaaagcatagagcaatagttagcttggtttgaatgccttcatccaattctgatgatactgacctagctaatctcactcagatttgattctgaatgattaaatcccaacctaatcccattcacgatttggttttggtcttttgaggtgataaaatatgttccctgtatttttttccctttcctattacacttgcaatatgttccctgtatttgttttccttttttattccacttaagaaacatttctgctggagatataatcatataaatatcgctctcattctacccttacctttctaagtcatgcctagaggcgatggtcatattattatgctctctcgccattattgttctagtatgatcaaagattaaaggcttatttatcagcaagctctagtccatggctctgccccctcacattctagcagagctccaataaatcaataatctcaagcataacacagtaacacaccaagaaaagcagaaaaaggaattgaaatgccaacagaaaacagaagttagtatatatatagtaatatgaacacactgatacaaataatttgagaggataacgagcgttctacatacaaatcctcctcgagctgtcatgtgaacgattcttggatctcttcgagtgccttccctttagtttctggcactaaccttgccacgaacaacaccgtgaccaagctcgccgcagagaacagaaagaaggtacctgcgcacagaaagtaaaatatcctcagaacaatgagacaatcggccatagagatattacagcttggaacccaaccggaagcatatgttcatctttttcgaagctaaattcgactgttttatttacatatagtgcatctatcccatgagataccggtgaggtatgttttgctttctcttcctattgtcctaggtttgtaaggggtgaagatgccttacctgcagagttccaatccatgaggaaattgaatgagtaggaaattgcgaaggaaccaatccagctaaccagcgtcaccaagcttccagctattgcttttatttcaatggagaatatctgcggaaataaacaagggctcaggaacacaagttcctgacagacctccaagaatacgggagcataataggagtacaatattaacttgacggtgttcctttttcctacctcagacatgataacccaaggaacaggtcccattccaactgagtatgcagcgtaatatacctattgtaggaagcagtgtcagagcatgacatttcaaaaattcaaagatgcaatcatcagaaatattcgtctccaaatgtttgaaagaaacttatttgggaattggctgaaagttgtgaaatatttgaaagattttacattgaaagtacacaacactgtaaaagttaggtgtttatgaattctttaccgatatgccataaagagccaatgttggaaccagttgtgcatacactccttgtgcctgtaagaccatgaaacgcggatcaatcaaattggacggaaaagtaaatactctgctaagaatggtacaggtatacagggatagactccttgttccttaacctacatattatttaaattagtaaattaattaaggtttatcaaaactcttcagaattgttgatttgttcagtttcattttactgcaagttcatacttccacctggttatttaatgttgtctggagtgatgctgtcctgtcattgtttctccaaccaccaaatataagtcgtgcaacgaattgagtaatttgaaggtaagcaactctgaaaacagaagtgtatagttaattacttaccttgaagtagaacgataatccagtcagaaagcagcccagaaatgttccagacgcagagaccttaataacagaagaatctcacaatacataattgataattccagacccagagaatgataattgatctgtttcgttttattcaattggctcaggttttgtattgttcataccagtagaagggctcttcttccacttctatccatgagaagggcaccaaacaatgtgagtggaatctgaaacaattgcagttacagaaaatgttaggaatggaagcgggggtgggcaagcaggttttgttttgcccatttatcacaattctagttaatttttcttccaaattttgtactaccaagtaggaaatgaactactatgcagaggtttttatgtgggtagtgggattgcccacttgcatccctagaagatgttatgcccatttactttcattgacagaaaggacataaagccgacctgaaaaattccaatcaaggtggtcccaagctttccagaaaaccctggagttcaggaaaaaacaaattacagatagtccctctaatcagagaataacaaatatatccctccgttttttaatagatgatattattgacttttgaacatatgtttgatcattcgtcttattaaaaaattttatgcaaatgtacaagatataaatcatgcttaaagtactttgagtgataaaacaactcacaacaaaataaattataattacgtaaattttttaaataagacgaatggtcaaatgtgtgaaaaaaagttaacggcgtcatctattaaaaaacggaggtaactacttaggcatttgaatacctgcagaggaaaagatatagcttgtataaaatcccaaggcatttattcctcccagctgctgaaagaccatcaggccaacacccacctaagcatcatagtttgatgattattttatttctgaaaaacagcatttcgcatcatcaagttcagatcttttagggtaaaatgcaatgcctttcaacagcttgaaacttcttacaatgactgcaaacaaattctttctctgaaacaaatcttgaaccctggcctcaggtaagctacgaagtgattcgatatattcctgcataaaacaattgttataaacatcttcactacaaactactccctccgtcccctaatataagagattttgacattttgcttgcactgtttgaccatttgtcttattctaaagattttggaattattattaattttatttgtgacttactttattatccaaagaactttaagcacaacttttcgtgttttatatttgcacattttttttgaataagacgagtggtcaaacgttacaagaaaatagtgaatatcccttatattaaaggacggaggtagtactagaatgaatttagaatggaattaactctaatcccagcagcctcttcagatatgtcagcattctcccctctaagcttttgcagtgaagcattgaattctttgactctccctgtattggcctgccatgttattaaacaaaggacttcagttagagacatccactatgatagcttatgtcagggtttaactctttaacaaagatgctacatttcacattggactgttatatcatttgtcaatctgattaattcatgatctatttcaccgaagatgttatgttcccgtaggtgtcttccttttttttttcagtcatgcagtatataccttcggctatgggttgatttaacttattttcttacttaatgcaatgctacaaaattattttatgtattttctaaaatgaaataataagactaacaatatacgttgcattagtttgttccaaaaaaaacactaataatcatcaaaagttggattgataaaatcaatgtattttggcatccatattaaagaaaagggttatagttactatcttaccagccacctaggagattctggaataaacagaagcccaacaaggaggaaagcacaaggcactaatcctgggtaaacatgcagtattagtttcctttagcggatatcataagacagataatgcgtatatcttacctactagaaccaacgagcgccatgaaagaagtgccccaataatgtaagcagctgaacatcctgagcagatgaacaactgcatgcacagaagggccaatgctaatgtttaagaattattaaattaaataaacatcaataggctatccagttccagttctcctacctgatttgaagatgcaagaccccctcgaagatcctttggggctatttcagatatgaacacaggcacctgtgccattccatggtaatttaagtgcctgtaagattctaatgctatgttgacaagacacgaatgatacgttactacagaagatgtatgtgggaacataactgagaccgtaaattgtattactcagccaaaaggctatatatggattatgagattaaaccatacaaaatgagataacataaccacccttgatacttagatggtagtacactagtacccttgacacattacactagtacattaaactctatcttttcttttacagtatgaatagtcagatatgcattgagaaattagagatgctcaccacataggaaagaactccagtacaatagccgagcaagactcttccaagatagagcatcgtagcacccttcatctcattgaagacaacatttcaagctcatgaaaccacaaatgacagctaaagaagagaaatagttcgcagaggaacatacattggcaaaatatatggtaaaccaaccaacaatgccaataattgctgccaaccccatggtctgcagcagatgcaatggaagacatgtcacgagaacgaatgggaataacttaaactagtcatgaattcaatcacttcaccgttttgcgcccaagactgtctgcaaggcgaccgctagtcagagcgccaatcattgctccaattgtcaacacagacccaaatacgccgtactacaagattaacatgaatcgagacgattaaatttagaaaacaatggagaccattgagttgtaagatagtagcctcttgtacaacactaactgcagtaaacaaaaacttgaacttcaatgcgtattcaaatgctctcaattggtaatgcagaatgaaaaggtaaagaataagcataggcagatagcatgtatttttccctctgaccaaaataaatagcaattttgcaatgcggggactcatttgataaagatcgtgctacgaatcataacatattgggatgcttctttgaccaaatgaaatcaagcatgcacctggtaagctggagtactaagattacaacacaacaattaccccaattcctcaatgcacccacgtgaaaagattatatccatggctcaaggaaaaaagataatgcgtatgtgctaaccgacctctgaattggagagcccaaagtcgttcacgattccagcttgcgctggcgccgaataccccacctgaatttgtacattccatcaaagcacacacatgaacacaagcaatagccgcacgccttatgttttttcttgagatttagcgagctctcagtgcagcaacacaagaggcatcaagccatggggaggagtctgggagcgggatgcgtacgcaggtgccgaactcgaaggacccgcacacggccaccgcggtggcgaggaacaccatccacagggacccctcccccgcgccaccgtggggcgccgcccccgcctgcccctgggccgcggctgcgccaccccgagcagcggccggcggccgcagcgcgcagcaagcatcgcgccgccgtgccgcggcggaggcggaggcggcacagtgcacccggcgcgcggggcggcggtggttgcggtagagctcgaagggagaggaaggtgagtaggcggcggcggcggaacggcggaggacgagcggcggcgacggcggtgcggcggtggacagaggaaatgcggcagccatcatcgccggagcgatcgagccggttcacatatttttctgtgcctcatctgcttgcattttattgtgtttttttttcctttcatttgcgaaggggacacggtgtgcacacagggttcaccttaccgtttggggggggggggg

SEQ ID NO: 15819 - DNA, 12998 bp, Oryza sativa
cgcacaccccccgcggtatggtggttaccgcggtaaccgtgcggttaccgtgaaaaaccgcacaaatttcgtttccaaatttttgaattcaaaatccacggtatggacacggtaaccgcacggtttggtacggtaaccgcggtaagaggacggtaaccgcgatatgttggaactgaaataagaaaaataaaaaaaataatagaaaaaaactaaaatgtgagtattttagtttatgttggaactgaaataagaaaaatgaaaaaaataatagaaaaaaactaaaatgtgagtattttagttaattaagatgtggttatacaacagaaaaattcggcatgacctactctatattgtagagtccacagtataatgtccacgattacaattctagttcgaatgaaaggaaataaacaaggacatgcatagctacgcattccactgattatatgccatattttactcctctgtggacatgagcatcaagccatgtgaatgtagcaaccccgccttgtattccttccaactttgacctgtccatgatgatgttgtttgccactgagcgtacaattgagcataccactgaggctcttgccattcatacacccatgtagtagcaggataatcagaagcttggggacggttgtacacatacgttggatagccactttcaaagctagaggcactgaatgagctagagctatcctgttgtatgtcactgaattgttgctgttgtcggactcccggtgcaatggtagttcgttgagagcttggagcaccatgatcctggtcctgagtagcatgagtgaagtcgccctcacctgcaaatcaaaaaattgcaagaaaattatccagtactgaattggaagatgaaggttgaaattgcaactgaattatatcacaccagtgaattgaacggggctgtggtgatctgattgttgggtgtgacccctaggaggcacattagtagtgccttggcctccttgaccatcgtcgtcgtcgtcatctgtttcagttcttgagctactatcattggactcttggtactctgggcttccttgggtctcttcatcgctatcaacactagtcgatcgtggacccttgccctttacctttttagatggacgtgcttttggcggctttcgagtcttccttttcccaatatgagtgtcacctacattcgtatcagcccactcaacaatactagaagctcccgtggtccttcgcaggtcatccaagttgactaggtcagacacaagttaactaggcaggggagcgtcactctcagctgaatcttcatctagttcggggcaagcattagagcgagcattgtccatccaggcactgatatgattgttagtttcatagaatgagaggtccgctaatctttgaaggggatcatcgtcctccaccctaatttgggcatttgcttgctgaattcgaaggcgaaggttgtagttcacgtacactagcttgttgagcttcttgtgggtaagtctattacggaccttcgtatgtacgaatgcgaatgtgctccaattcctttcacatccactggaggagcaacattgaccaaccaaacgcaacgcaagcttcttcaaattcggcgtgtctaaggcaaacatagaccaccattgtgctgcaaaagccaagtaacatgtcatttcataattctgaatacatcaagatcaattagatatatcatagttccatgattagaaacataccaggtgaagttttcccatctatggccatccttcttgctagtgccctcccaaattcacccgtcttacgtcggtacatctcaacctccagcaaagcggcggcagccgtatcgatatccgtcatccactcgaatgcctgtcggaggtcttggaagacagtagcacttggagaatacgcgtagtgcgtcctagggttcaatgcggcagctacaaaacatggcacaggttaagtaagagttacataatatgccatgtggattatgttatgaccaatatttaccggcattgatgagagtctcattggttaggtcgtgcatccttctgttcacgatttccatgtatgcttcaaacttgtccctttgattcgcaaaaagactgtcgtactccattttgagcaactgatatctcaaaagtacctcactcaaattggggttcttgtcctcgtcagcaaaccgaaggaatgagtacataggttggacaaaattcactactgcctctaagttctcccaccaagacagactagatagacatgcatgtgcatatctaccttccaaagtcccactaaatttgctttgcatgaagacagaggaagccatccattgcatgaaaagatctcgcttcctaaggaaactctggagaaacatgtagtttgttccgaaccttgtagcattccacttaaccagttcaccacctatagctaagaccatcatagcatgcaacttgttatgattgtatagccatctgcaaattttcctagcactctcaatcaccatttcgtggtctggcattttcccaacctccttaagcatcaagttaactgtgtgtgccacacaaggttgccacacaattgtcttgtattcttgccgtagtagtctgcacgccttcttgtagttagagccattgtcagtgataatttgaacaacatgctccgagcctatttcgcgtaccaccttccttatctcctgcattggtagataacataataaaaattagtccatgcccctagcactgacgataacaggtgatgaagtaatttgttgcatgaaccatacataccttcagcacaaagttagcatcctggctttgccccggtcgcatcaatggacttgtggaaaaacattattccattgcagtatatcagaaaattgatgaccgacatactcgtcggacctgtccaagaatcacacattatagtaacaccgtactcatcccaatccttcttgaacctatcaaattgcttcttcacatccttctctgtagaatcaagatattttccatctatctcgttaccagttggagaaggtacactttcacctacaattgacgtatgaaataagtagtgcgcaatgagttagaaaaaaagaagttccttaatagatgcatacgtaccccacttttgtgtctcccgaacggcgctcacaaagtatggattatcggcgtttctaccaggaatgccggcggtaaagaagaaccttgcccatgactcaccaatggcttgcctagcttgcttccccttctttgtgaagaatcctgtgtcaatgcgtggctgcacaggggccttggcagatgctaggttgtaatctctcacagcaggtgactccctatgagacgtagcccttcgtagcatattggtaattgggttacttctacctttccgtgcctccggctgagcggatccactcccaccgccatgctcataagtgccaccacgctcctcaacatccctcctaaagttttcgtcttgtcgtgaggctacaatggctgcttccatttgttcctcctcgtcggcatcacctgttaggtcataatagttgacccttgctgcttcaacccttcttccgctatcactcttacgctggtcacctgcatcttttatcctgtccaactcacggcagaagaactcacggacatccggaggcactgaattgcaatatgtaacccccttccttcttgcagccaagtgttgctttaatcttgttgccccaccaccgcccctctttgtatggcaatacttacagcgccatccaggtgggatattctccccgtgctcccacacagggtccctactatctgacatctccaccctgtatcaaatgcatgagaaattatcactgctaattataaacatacctcccattatgcaataatacgacgtaattatatgtacactggtaagcatgcatccaaattcttccatactatgacgtatttaatttaacctatatgtacatagaccaaagcaatcaaatatacttcacatgcatggttttagccaagcacgggcaaccaaatgccgaaataaactcatattcccaatgtatttcacatgcatattggtaaaaatatgttctattgacctaaatcccaaaatatgtccatgcatatcacagtaaaaaataccataccacggttcaagccacggtaaccacggtagggtggacggttaccacggttttcacacgattaccgcacatacgtatatcgtctcatagattacgaagccgacggtaaccgtacaaaaccgcacggttaccgctcctaaccgcgcgaaaaccttcaaaacggagggattacctcttgcccgtcgacccaggcggttaccgtctcgtaccgcgcggttaccgccgcttaccgcgcgggaaccggcctcgccggcgcggaggcggcggatctggcgcgggcgcacgccgtcgccccttcggtcctgagcgcaactacgcgagagaggggaaaaacggtaggattcgccagagaaacgaagcagaggcttccaaagatattttcctcccattgtgggccttattgggcctcgtgaacagtgcatacttggcccattccatttaatcttttttcttttttataattcacaataggttttgcgctcaaatttgaatttacctgcatctttttgatgaaattgtttcaccataacaacatacaaaacaagcttttacatccatgattttttttgatttttttcgattatttttcaaatttttgaatttgagcaaaatttgcccaaaccctaccgccggttttcgttaccgaccccccacggtaagcccggtaaccgcggttgccgcgcggttaccggcgagaaagtgaaccctgtgtgcacacaagccatcaagttttcaacgggacgaagaaaacggtcggaagatgtaaaagtaaattaaatatattcaaatcatttccgttatttttttttctcgaatgcaaaatcattccaaatcatgacgatagagtcagaaatgataatggttttaccggaggccggagcatcagaaaatactatagacaaaatcattgaagtagagcctcaaaaacagcaagcaagtcttagttatatttatattgtaaaatactagtaacttgtcttagttatatttatattgtaaaatactagtaacttggtcatttgatgttatagatgttggtgtatttatcttatctgttatccataaacttggttagattgtcaaaacgctttcttcctctcgcgtcgccctcccaaggggtggctcgggaggcaacgagcttcggccgtcccctctcccccacctctctcctccacctcgccaccgcctgagcggccgcccggctggcggccacaaggaccgcgctcaggtgacctggggagccgccttgggcggcggcgacggtgaccgccagatccgcgccgctccgatcggatctggcggggtggcggctggcgaaggggaaagcgacggcggcagggatggcaacgacgacggggatagcaagccgcatcgggtgatggggaccgtcggcggcggggatggagatggcgcggggctggaggcggcggcgaggacggcaacagcgggccggatccggtcgtgctagaggcggatccccccccagggcgtatctggtgcggggcgagctcaagccggtggcggcattgcggagctcgcggcgacggcgtcggcgacaacggcgcggagctcacggccacggtggtgatagtggctggacggcggtgacagcaggtggctagccgacgagcagcagctgctggctgccgtggcaacggggggcactcgcagcgggagaggtcggtgcggcggcgacagcaggcgtggagctcgtggcgacggtggcgacagcaggtggctggccggcggcagcagcggcagttgtggcgaccgtggctgcggtgggaggaggcatggccatcttggacggctagccgggggcgtggtagacggccgtatttggccggcgcgacagcgattggaggaggggtcaaagaggcgcaaccgatggcagcggaggccggcacggcgcgagtggtgtggccggcagtgatggaggctggcttggcacgagaggcacggctgagcggctgttggtgtgagggtagtggtatattttttcttttttcctggttacgaccttctagggttgtaattttgtaatttttttctactctatcaatacaacttcacactgtcttgtgcgagtcgttcaaaaaaaataaacttggttagaaatttgactaaaatgactatatggaacatagggagtacctttcttacggatagaccagtatactcacgacaaaacagcgtaaagcctcagaacacacatatgtgtgtgtgtcccatatatatattgctcaatacaattcagagtgacatggtatacatagcttgcatgcgtagtagcccgggacttagcctagctaggtattgagtacactacggcaaaactgccaagaaccggagagagaaagatcaggaggctaaagagacagagagagtgagagagagaggtgcgtcgaatttgacggcggctcaggtagaaagagtggagcaagtggatcatatctctatggtctatggatccctcaatcttgatctggagtcgatgagcgagtcctgaatctcctcgagcgtcctccctttggtttcaggcacgaccatcaccacgaacaggatggtgatcaagctcgccgcggagaacatgaagaaggtccctgcatttgcacgcaccaatggcaaagggaaaagaaaacaaaatgttaagtgtatcaagaaagcagcgaggcaaaacattttacatttctataattcatagaataaatctcctcctggtaaacttgttggcataaatccaacggctcaattcgctgatttatccaggttgaatgaatctttcaaaaggtaaaatggatggttattttacatctttcaaaaggtaaaatggatggttatttgtccatttcgcttagttcttcagagatgaaggttattgtttttgactactggcattacagcattggaagaactacagtgctgtgttggtggaatttttacttacctgcagaactccagtccatgaggaagctgaacgagtaagaaatcgcgaaggaacctaaccaactaactagtgtcaccaagcttccaccgattgctttcatgtcaatcgagaatatctgcacgcaattcgtcatccagaaaatataaatcactctcctcctgaatcactacagattgatgaagaaccttgtaccatatataaccatccaaaaccaacactatataattttgcatacctcagacatgacaacccaagggacagggcccattccaatcgagtatgctccaatataaacctattacagaaacagcatcagaaagagtatcagcagtctgcagtgatgtttatctttcacaacatgctacatggtgtagactactaaatgttgcgattgaagtgacattagaatgtgtagtgcatacagtcctaaaaatttatgtactgcaactgaagggaaaggatgtacatggattatgtacttaccagtataccggtaagagccaattcaggaacccattctgagaatagcccttgtgcctagcagacatgaatcaattaccattatatacagaaacaaacagagatggtcctccttacaatttgagctgttaataacattgaatgatagctttttttggtagattttcaagggattgtcaactgtatcaagctgacttatgccagtcccgaaattttcaaattatacaattatcttttcatgtactttcctaggaaaaatgtactagttacctttaggtagaaggatattcctgtcagaaagcagcccaaaaatgttccggatgccgagacctaaataacgaaaagatctcacaaaaaattctatctagcatgcttttctttgtatgtatcagctcagctttgtagcatttataccattagaagaacccgtcttccactcttatccattagaatggctccgaacaatgtaataggaatctgaaaagatcagtgttataaacaaaatgggcttattagttaatttattaactagaagcagtgtatcaaacctgaataatgccaatcaagatggttccaagttttccagagaaacctgaagtgcgataaaatcacaaagttcatacagaactgtcagaggacaacaacagtgatcacaatatttacgtacctgcagaagtgaagatagagcttgcataaaagcctacaccatttatccctcctaattgctgaaatatcatcaagccaacacccacctgtgtatataagatccagcaattatgtctggttcagttcttttctaaaaaaagtttcacactatcagcctccaaattcagtggttgaagttttaatgcgattgtgattttgacatgaagtagttgaagacttgaagtgatttcttacagtgacagcgtatatattttttctgagaaacaaatcttgaaccctggcctttgggaacctatggagtgattcaatatactcctggagaaaatgatcagtctgagcaaagtccttcacattaaattctaacatatacaagcaattaggacagaattaaactttaatctcgacggcctcttcagaaacgtcagcatcctctccccgtagcatttgcaatgaggcatgaaattctttctcccttccaacgttagcctgtaatttaaatgcagtggaactcaatacaagaagtgcactatgaaatttattactgatgcttcataagttcatgtgtatgatcatgtaaccccttcaattaataaagcaagaaaatcatggggtaaatggtcccccactgacaaaattcagaacttaattttggtgttccatagagcgtttgacaaaggtagaactaagaagttcattaccagccatcttggtgactctggaatgaagagaagtcctgttaatagcaaaacacatggtactatacctgcacaaaagaaaatgtatttattaccatccagcatgaatgtgaagaataaacatgttatttctatggatatgaagacaaattacctactaacacaagattacgccatgcaaccagggcgccaattatgtatgtagctgaactcccagaacagatcagcaactgcgtgtgcagaaggtgcggagtggaaactattaggattcaataaaaatgcctgtcgatatccaattttcattttctgaaacctggtttgaagttgcaaggcctcccctgagattctttggtgctatttcagcgatgaacacaggcacctgccatatccagcaatatgacgaagaacataaatgtgataattagtcaaggtaaaaaaagttgaaaccgatacaagaggggaagacggacagtcagtgccgtattttgaatcaagagatgcataccacataagaaagaatcccagtactaaagcccaacaatatccttccaaagtagagcatgataacaccctgtacatcaaaactcaaatataagatacccacaagaaacagataaggaccaagtgcaagaatcatttcaccaaggaacaaaccttagccaaatgcaaagaaagccatccaaaaatgcaaatagtagctgatatccgcattgtctgcgacaaacgaaaaatatgacacacctggaacatcaatttacagcaaacagataaatcaacccaattgaaaaatgggactgctttaccattttacgtccaagaaaatctgctaagcgaccactagtgacagcaccaatcattgccccaatcgtcagtacagatccgaatagtgcaaactgcaaggttagaatgagtctatacatatcacagtactacatacgagaatattacagccggtgaaagttgagtacaagtagcacagcagagcgaaaaccatggaagagaaaatcactgacctgcgaaatggacagtccaacttcatccacaatccctgactgagtgggtgcagaataacccacctgcatatgaacatggctgagtaactaaatgatcacattcgacatagagaagggggaaaataatcaatcaatacattccagtggaccagggatatataagtactagtagcatatagttggaatgggaatattgtactctagctggaaaaggccatgagaacatgtgcacatttgctgagatacaaccaaatgtggtgacctgtccacttcacaaccctttgcacttcccattccttgaagctttgcaatttcttagttgaagctagcaaaatggtatgtaattagtcagctctaatcaactttccgttttttactgcagatactttggcattgtggccttccttgatttttacctctgcaaacttaccaactcgaatataccgtcaggcgtcagctgtcagatggcccaactgtattgccatttttgttctgctttacgcgtttcttgaactcatgggtctcactaattaagattctttacacttaaaaaggaaagtaattagaggagatatgtaaaaacagagtgagagcttttgcccagccagaatggaaagaattctctgcaatgaacacttgaattataagtacggtagaaatttctgggaggaaaccccgtcgtgttcgtattgatttaatttctgtttgaattactaattgctttcttgagttgaaaacccttccatagtgagagaaaggaggggaaggcgcttacgcaggtgccgaactcgaaggagccgcacacggcgacggcggtggagagcatcagcatcgacatggacccttcttctcttcctccgcgccgacccccgcaatcgccgcccggcatcattctggatcttctcctcatcgccccgcccctgcttgtgctgccggaggagcagcggcgccgtcacctcgccgcctccgcctccgccgccgccgcccgcggctccggccaccaccgcgccctccacatcctccgcggctctcactatccccattccccccggcgcaacacgcacgcacgcacgcgcgcactcgagagcagcagcgagcggcaatggcagcaaaactcgggaggcccaagattggcaaggagcgcgagcgtgtcgctcgggtcgggagctcgggatctctctctctccctctcggctcctctttgaggcagcgccgctatttatacgggcgagcgcgccagggcgggcctcactgacgcgtggggcccagcagctgacaccgcagaggcggcgcgttgagcgtagtggagttaggggggaagagaaatatctcccattgtttcgaagaaaacgagaaaaaagaatcaaaatatctccgatgatcgaggccgatcgcaagcacgcggtaattaattactaccctcgcatttctaattcattaaccttaatataaatatcaaaaatattaaaataaatatgaaaaatattataatgacttatattatgaaatggatatgaaatggatgaagtaattagttaatcaattagttaatgtgatctcattgtcgcgataacgctaaagaaaactctgggagatcgatagacgacgagacgagacgatagcgtgatcgatcgatcgatttttgcatctgactgatctctgcaatgcgagagcgacaggaaggagacgtagcttagcttgattgatttggattaattatgcaatggtgatgagctattgagctggaaccatggcagcattcaagcagcggtgtatagtgcatggacatgaatcctctgcggtactgtatttgcagtagcagtggctagtaggtggacccgattccacatgtcagcggttgttactacagctgatagtgtatacctacccatacacatgtgtgctatctgcagctagctatgcacactccaaagcacatatgctacttgatttttttttctagtataagaaaattgtaatggaagaataagaagaaattgtagcatagcatttgtaggcatatgatgatatgatgccaaggccagcacgatcggtcggcatggtggttcttgactcgtccgcaactactgtagcttagcaataccgcatacgcgcaattgcgaaaaacaaaacaaaacttagcctccggttttaaatctgtgttcttggccttttttccaactcaccatcagggatgtgctcttcgccttctttttcacctcatcttcctctttttccatgccttttaaaccataaaagttttctatagaaaagttgttttataaaatcatactccctccatttagtttaaggttataagacgttttgactttggtcaaagttaaacttattttagtttaaccaagtttgtaggaaaacgtagtgacattttcaacccaaaacaaatttattatgaaaatatattcaattattgatttgatgaaactaatttagtattataaatattactatatttgtctataattttagtcaaaattgaccaaagtcaacacatcttataatctgaaacgaagggagtattaatctatttttaagtttttaagactaatatttaattaatcaagtgttaatgaataacaccttttttgtgccggaaggtagaatttctgaactcggcctaaatacaatacataacaccgttagcttttttaactcgtttggttatttgtctttttagaaataatagctacccctacgtaaataggcaaacacaaggccgggcacgatctagtgatacactgatacttttctcattttacgcaactaaataattgaatgaatattattgatctgagggaaaagtaatgtatgtactcatggaattgaaatgtgtgtttgtgatgtgtttgaaatattaaacaaaaaatataacagtctttaagtacttttgaacggactttatatgtgattctcatatttttttccaatctaaatatttgaaaaaaaaacattgacagttaaatcttcaaaggtttattaaggtacgaataaaacatgttttcacggaataaccttataggttccacttggatgctactcaattctgacccgtc

SEQ ID NO: 15820 - DNA, 1212 bp, Oryza sativa
tatatatatatatatatatatatatatatatatatatatatatatatatatatatatatatatatatatagttcctccgcccggaagttgaagatgaagaaaattgaagattagggtttcgtcctggttcccagccgtcgcctgtggtattgggtgttagaccgttggttccgctgctgctgctgttgctggtgtttcctcgtctgtgtcttcggttgtattctcaggctgtcctgagctgcaacctaagttaaggtaaataagtcctctatttattttaaggatttgcaatgattcatatttgtcaccgtgggtaccagcactatgtcctgggactggtactgtgatcgcggtttcgtaggaagcggttcgcgccgtttttcctacgacacgctcttgtcaggtgccgttgtacggcggtgccggattagggtgtgacaggatgctaagaaggaacttagcagtggcgtagctaggatttagactcagtgggaacttagcagtggcgtagctaggatttagagtaaaagtggcccatctatatgtaataggtcaattaaaaacttagcagtggcgtagctgggatttagagtaaaagtggtctatctatatgtaataggtcaattattaaaaacttagcaatggcgtagctaggatttagactcagtgggaacttagcagtggcatagctaggatttagagtaaaaatggtccatctatatgtaataggtcaattaggtcaattaaaaacttagcagtggcgtagctagtatttagagtaaaagtgatccatctatatgtaataggtcaattaaagtttagtattcacagttctgattttacataaaataaataaatattatacttgcgttgatttgattttgtacaataaaaaaaatgccttcgcgtatacaacggaatgagaggtaccgataaccgagatttttcatcacaggaatcgccgcgtgatctgttcgatcggttttttaaaaaaatattgatctattccatcaatctacaaccgatcgatacgatgattttcatcccggtccctaaacttgcagatcactcgtttaggtcttcgaacttgttcagttgtgtcaccccgatccctaaacaggatggtctaaagactttatatttaaaaataattcataactttttcatgtgaactctaatgaagacaaactttatatcaaaattgtagccctc

SEQ ID NO: 15821 - DNA, 2714 bp, Oryza sativa
gttcagccgggtatggttgttcagaatggttgggcctgtgcagcatgggtgtgctgttcagtgttggttaaaatttctgattaattactccactgttttacttcccttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatctcgaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttaagtggttctgaaactagttgttgaaacttgaagacgccaatgtggtcaacttatggaggttaagtcaagtggatcgataaataagaaggtgatggtcgatctgaagggccaagtggtcaagatggaatgaagtttggatcctaccttagaacctatgccgccaaagtgtctttgaagaatagttagtaggatagaacgtttgttgtttgcttgtgtgtaggtatggttgcattcccgtcattggtgtggttcaatgatgagtgtgtaactatactaggttgcttgcttaatcaacttgaacaatataatggtctacacacatcagatcagtgttaacctggttaaggtcttaactttagcgtaacccctctcctcctatcttctctaatctgcaacagatggtgaacactcgtgctaatggaagtggaaacaataacaatgaagggaacccaactcttgctcaagttctggctcaacagactcagttaatgaacatgatgatacagcagatgcagaaccagctcaaccaagggaacaacaatgctccaccgccgcagaacaagttaactgattttcttcgtgtgaggccacctaccttttctagcactaccaacccagtggaagcaggtgattggttgcacactattgagaagaagttggaactgctccagtgcacggatcaggagaaagttgttttcgcttcacatcagttgcaaggacctgcatcagaatggtgggatcatttccggatgaacaaagcagaaggacaaccaatcacttgggcggagttcacggaagcattcaagaagacacacatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaggagaagtttttggaaggcttaaaggatgagctatcagttatgttgatctctcatgactatgaggattttcaggagttggttgacaaagcaattcgacttgaagacaagaagaacaggatggataaccgtaaaaggagaatgactgtattccaggaggcacaaggtagtagccagaggcagtgtatcaagccactccaaattggtgaatcttcttccgctggtcaaggacagtcgcaacagttgaacatcggtggtgagatcaaatcagagactaatgaaagcaatgaagttaacatcgagcaagctaatcagccggtgccagttcagcaggatcagtctcaggagaataacagtagtggaaggaagcagcaggtatgtttcaactgttacaagccaggccactttgctagagagtgtccgaagccaaagcatcagcagccgcaaggtcaggtcaacaacattgttgtcacaggagccaatgcagtgccagttgcgtcttcaagagttgtgtcttcaagtgttacaactcagccaccagtttcaaggcagcagtagttttcttcaaagccttagaataattatcggagttatggaataagatagactgcagtttacctattccctttttctttctagccgttccgaatctcgggacgagattctttgtaaggggggtagtttgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaaattataaattgttgtttaaaaggaattattagaaatgattttaaaagtctaaaagagaagatctaattttaatttgcaaaatctcaatataaaa

SEQ ID NO: 15822 - DNA, 8863 bp, Oryza sativa
gggtcctatataaagccttggattgaagagatcggactcctcccgcaagaaatcgatccgagaaaaacaaaactcggttttggagataaactcgaaaacgagttcgattcgggcaagatactcaacgatttgctccgatttttgggggtaaagatagaggaggatgagaggataaaaacccccctaacaatcggactcggggcggctggattggggcggatttgagggcgcaaggcggcggctcgggcttggcatggccggccggccggaggtaggagaagggcccgacatgtgggccccacatgtcggtgtcccacgtgagggagggcgggcggtgtcggctgggccgaatgggccggctcggccgcttgggcggggagggggcatgttgggccaaactcggcccaacggcttaaaggaggagttttggaactttttaattaaaaaaaatttgtgaaatgttgtttaatttattaaaaatacttcccttgctcaaataattcccagaaaaatctagaaaatagaggagcaagtgtagtatttaataaaattttatctagctcatttttatgttgaaaattttcctagattattagggtttagcttgtcggcttttaatttaaatttctaaaaattccaattaaacaacaatttatataattaggatttttagggcgtgacaaacctaccccccttaaacggaatctcgtcctcgagattcagaagaactggcaaagagatgcggatgagctgacttcaattcatcttctcgttcccaagttgattcttcttctgaatgattgctccactgaaccttgcagaaccgtataacgcgattcctggtattcctctcgcttacttccaagattctgactggcttctcaacataagttaaatcttcttgaagctctatacgatcaggatctgcttcctccgtaggtacacgtaaacacttcttcaactgagacacgtggaacacgtcatgtattcccgccattgacggagacaactctaactgataagctacctcacctcttcgactcacaatcttaaaaggtcccacgaaacgcggtgccaatttccctttggtttgaaaacgatgaacacctcgtaacggcgtaacccgaaggtatacataatctccttcttcgaaagccaaatctctgcgacgattgtcggcatagctcttctgacgtgactgagcaacgcgcaacctttcttggataatcttcactttttcttctgcctctcgcagtatgtctgtcccaaaaacttgacgttcaccggtttgatcccaaaggagcggcgtacggcactttcggccatataatgcttcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaaattataaattgttgtttaaaaggaattattagaaatgattttaaaagtctaaaagagaagatctaattttaatttgcaaaatctcaatataaaaaggggcctgataaaatttcattaaatactttgctcaattctataattcctagatttttctgggatttatttgagctaaggaagtatttttaataaatggaattgcatttaagaaataatttaattgaaaaaggttttaaaaagtcttcttttggctttgggccgaaagccggcccaaaacccctctctctctctttccctcggcccagccggcccagttcgccgagccgccgctctcctctctctctcagccgctgacaggtgggccccacttgtcggtttcgtcttcctccttcggccgccgccgcccgcaaaccctagtgcgccgccgccgccttctccttccaaatccgctcgattctttccttctccggtgaaatctttagaggggaaatgatcttctcgatctcctcttccttttctcttttggaatctccggtcaattcggtttggaaactcgatggaatcgagatcgaatcggattcctctctctcccaaaccctaaagtttccttctcgccgccggtcgccgtgggcctccgtcgccgctcgctagcccctttataaggacccccaagctctcctctacccgtcgcctccctcgccttcgcccgccgtcgtgtgtagcgccctagcctcgggagcttttgcgccgccgtcgctgccgttcgtccagccatgcgccgccgtcgctacggtcgtcgtcgtcactcgggaaggccaccgtcgggatcgccaagtcgccgccgtccccgtccgccgcttcgccgccgccgaagaccgccggagcgccgtcgccgtcgtcgacccgaagagcttcgccgcttcctcctcgtcgctgccgccgtccgttggtcttccgccgttcctttggtcaccggtgagttcgccgcgtcgccctctacccattggtgccctccgttcgcgtcgtcgcgccgccgttcgccggcgagcatgtgagcccgagtcgccgagccgccgccgccggggtgacgtcatcgctgacgtcatcggggtcgtccgccgtgagccggtcgtggaccgatcaatctcggccgtccgttttggatagggttgatctcggtcgtccgttcgcgtgaaccgccgcccgtgcgcccggtccaccgaaaccctagccgctgacgcaataatccttcttttccttttcaaaaataattcattattgcgtcataattcgattaaaatccatataaaggttttaatctgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatatgaaatcagaatgaggccgttcaagtctctaaattcatctaaaatcatgatctacatgtttgtttactttttatgtattgtttatttggtttttattagtctttttcctcgttttgcgtgatagtttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggttattataattggactagttgagctttatatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattttagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttcccttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatctcgaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctagacgaggattttatgcacaaataagttcggaaattactagtgaatttccgggcgtgacaatctgtttgagggtgataagcggtactgaaattcaaacgggtacccatctctacttgtaatttctgccaaaacttcgaagtaaactggctacctctatctgacactatcttcttaggaacgccatgcaaacataccactctggccatgtataactctgcaagcttattccccgtgtaggttgttttgaccggtatgaagtgagcgacttttgtcaacctatcaactactacccaaatagaatcatgtcctgccgacgttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgctttaggtcttggtacatcttagtgcttccagggtgaatggaatacaaagtttcatgagcttctttcatgatagtatccttcaactccttattatctgggacgcaaattctttctcctaaccacacagttccttgctcatctactacataaccgatggcttttcctcttctcatgttcttttttatttcttggatatcaggatcattcacttgagcttctctaacttgatcaaacagagtaggttgagcttctaaagtagccacaaaacctttgctgactatatccaagtttaacttctcaaattcttggcataactcccaaggtaaatgtcgaccttctgacatattacagtagcttttcctgctaagagcatcggctacaacatttgctttccctgggtgatagtggatttccatatcataatctttaatcaactctaaccatcttcgctgacgcatgttcaaatcaggttgagtgaaaatgtacttcaaacttttatgatccgtatacatctctgtacggttaccgaaaagataatgacgccaaatcttcaatgcatgcaccacagctgccaactctaggtcatgcgttgggtagttattctcatgaggacgtaattgcctagatgcataggcaaccacctttccttcttgcatcaacacacaacccaaaccgagtcgggatgcatcacaatacacttggaaacctttcctcgaatcaggcaaaattaacaccggcgcagtcactagccttttcttcagttcttggaaactttgttcacaatcctctgtccacttgtacttcacttccttctgaagcagacgagtcattggtctggcgatctttgaaaagttctcaataaacctgcggtaataccccgcaagtccaaggaaactacgaatttctgaaaccgtcttgggttgcttccaacttaacactgactccacattgcttggatctactgccactcctccagatgagatgacatgaccaagaaacttcacttcggacaaccaaaattcacatttactgaacttggcataaagctgatgctcacgtagtttctctaaagctagacgaagatgctcttcatgttcttctttcgtcttggagtaaataagaatgtcatcaataaacaccacgacaaacttatctagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcaccttccagttgatcaaacaggtcatcaattctgggtagagggtacttattcttgatagtaacctcattcaacgctcgataatccacgcacattctctgagtatgatctttcttctccacaaagatgactggtgctccccatggcgaggtactgggtctgatgtatcctttctgaagcaaatcatccacctgtctcttcacctcagctaactcattagctgccattctgtatggtctcttatggatagggttggttccaggtaccaagtctatccgaaactctatgtctctcttaggtggcatacctagcaaatcctcgggaaacacgtctgggtagtcttgtactatggggatctcttgtagagcaacttggtttaaaaacacaccatgatatttaggagaggacacaaagaaagaaacggtttccccattgctactggttaaagtcaccttacggttagcacaatctataactcctctgtgacgagataaccagtccatccctaagataacatctagatctttggattctagcaagataagcgaggatgggaaaggaacttcttctatttctatagtagcggaaggacaatactgtgtcgaagatacttgattgcctggggtattaactagtaaaggtctcccaagactaataacttccatcccatgattgctcgcaaaacttttagacaaaaaggaatgtgtagcaccggaatcaaaaagcacagatgcgggtatagagttaacaggaaacgtacccaaaaccacatctggtgcattctgagcttctgctgctgcaacatgattaacacgtgccttcggtgctggagcattggagttgttcggggctggagcgttcttcacgcgccgaggcttaggacacttatcagcataatgtcctggatcaccataattgaagcacacccctggcttgcttccctgttccttcctgacgggctggttctgagctggagttgctgcaggacgagcaaccatgttgcggttgtcattgccacgattaccagtattgttgtcgtagaactggcgttgggggcggacaactgatgaagatcctccttgagggtacgatggagcttgaggtcccgtaacgagacgcggcctctggttactgccctgttgtgccttgaattgggcagccctgcgcttcttctgctccatccggttatacttgtcttcctgacgaatcgccttgtccaccagctgctggaaatcccggaaatccgtagacatcaaggcataagacaactcatcatttagtccctctaagaacttctcctgacgctcttcatcggtgcgaatatcttccggagcataacgagctaaacggttgaaatcgtggaggtactcggtgaccgaacgagatccctggttgagtgctctaaattctctcttctttagagctacaacacccgttggtatgtgtgtcttcttgaaagcggccgtgaattcctgccaagtaataggctctccttcagccctgccttggcgaaaatgatcccaccattcagcagcaggaccatgcaattgatgcgaagcaaaagaaactttctcctgctcagtacactggatcaaatccaacttcttctccaccgcatgcagccaatctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagcagctccacttccacttccggtgcgcgtgttcaccatctgacgataagcagagacaacaggaaagaacgacagagagacaccctcagaacggagttatttaattaatttaaattttatattgctcttaactgtgtatgcttacatttaagttgcattaacactatctcaccaactatcttacactctgacaagcaaaagaactagactcatgctgttacatcccaccaatgatgtaagcaacaactaaaacccacacactcacaagcaaacttaaacaagcaatctaacacagcgaactacggcaacgacctaactaagcgactaatcccgccttgcgtcggaacgaag

SEQ ID NO: 15823 - DNA, 1721 bp, Oryza sativa
cggcgtttctcctttaagttcagctaattccttctggagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgaccatgaggcttgtgaggatgatactagaaagctgatgaatccaactcttcttcaaaacgttgacgcaactctccaatggccaccaaagctgcttcttgacaagcatggctgtacgatcttcctccagcttcgaacttaatggacggaaggtcttcacgatcactagccaacgtcacacgaacacgacacttctcctcgttggggtcatgggaaatccggcgatactcaggagcaacttcatagcctacctcaaaagccatcaacctcagctccctgacgaatcctaacaccttgatcaaatttctcggtgaatggggcggcatctaaagaaacatagaagagaggaattaatgcatatttttttttaagttagctgcaccatctagacttaactgatttgaccaaagaggaagaaaaataaaagaaaagacacgtactaagccattatataaatatatttttagcatttaactttttggacagagacaaataattttttttttgacaaataactaaagtaaaactaaaatacttatgatctattataagcacggtacagtgtcaccataaaaaggatgagtagtactagtgctatcatgattgtatcaataccataatagatgtacagtgccgactaatcaacgaaatttaataaagtgaaataagaaacattttgaaaagaacaactttttgcttttaaaagaaaagaaaatgaattaaattaattttgtgcataaccttgcatgtgctgccaacttaattaatttataagagaatagagaagaacagttctatttttttcaaaatattttgaaggctacttaaggtttaccatttggcttatcctaaggtcaaggtggctctgataccaacttgtcacgcccggaatttctatccaaaattccaagcgcttacatgtgtgttaaaccctcgtccaggaatcaaccgaggcacacaataacaaattgataatagagtacaaataaataactatttaatatttgcaaacaaattattacagaggtagatagttcctctcaaagaataaccttctacgcagcggaaaaaaaaataaaactataacaaactacggaacagctatggcgactccactccacaggcatcttaaccagaacaagctcaatccttcagattgtcacgtcctgataaattcatcccgaaataaaattcattcgctaaaaggaataatagaattaattaaaattcgaaaagaaattggcaaacactaaaatacgtgcaagaaaaattccaatgtggcccggagaatttttgttaaattctccttggtctaaaaagagccctcaaattttacttgaattttcagagcaccggaaataattattaagcaacaacaaccttgatcaaagtttattaaaaagaaaaactaaaaatcccttctcttcctcctttgggccaagcccagcccgaagtccttccctcctccctctctttctctccctctccttctcttcctcctcttgggcct

SEQ ID NO: 15824 - DNA, 7580 bp, Oryza sativa
cggagcatcgtccggccgtgccgtcgcctccctcggctttgcaacaccgtccccttcaccggccttaccgtctcctcgccggaaactcgccggaacggtgcccccgccggcaaccagtggcattggtgccactgtactccctccagccggctgctgttcatcgccggtgcgccgatcgacgccgccgtctcctccttcgacaccgcggcatcgccttcttccccggcatcacctcctcctcgcccgaatttcgccggaacgccgtcgcccgcgccggcctcaccttcctcctcgtcgacatctcctccggctgccccggtcgccgcgccagagcgtcggccgacgtcgccgtctcctccctcggcgacgccgcatcgccctccaccccggcctgccctcggtttcgccggaacgtcgccgcgaacctctccgtccgcctcgccggagttgttcggccgcccgtccctcctcgccgtgtaccggtcggccacctccaccaccatcttcggcatcgcagtcgcgacgtcgtcctcggcctcgcctccccttcgaccgaaccccgccggtgttcgtcgtcatcatcccgttccctctcgcccggctcgtcgtctcgcggcgccgcctccgtcgtcggcatcgtagcggcgtggtcctcgtcgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtgttcgtcctcggctccgcgtcgtcaagcctcgtgccggccgcagctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccccgtcctcgtcctttcggtgtcgcccgtgcccgttgtgcggttgtcggccccggtacccgtgtaccggtgtcggtagtcgttcacgtgtgcgggtggtgaccgtgtagtgtccgtgttagtgtgcccgctcggtagccgcgtggtttccacgtgtgcaggccgtgtggtgtctagtggagtccgtttgttggccactcgcctcggttgacacacgggatccgcttccgtcgacccgtggaccgtctctgtgcactcggtctaccgcggtcctttaggttgacatgtggggtccgcatgtcaacggcgcagccttcctgtcttttccaggctagcgcttacacatgttttatagttgcaaaacctaattacaataatccgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttgtagctttgcttgtgtgcttcgcgtagctttcgtcgttccggaggttcccgaagcgtggttcgtggtcgtcgccgaaggttcggaaagccgttctctctgagcaaggcaagtcacatcatccttgaacatattgaatcccagtttgtaaaattatgttgatttaaattattgcattaccgctttatttaaattcccgcgttatcactgttttatctagccatgcccaattacctttgttatgaccttattattgttattgttattattattaccttgttcaccctagaataaataaaaccctaactagtgggtactctattcatggttccactagtataaatttaggtagatgcttcgctgtttaattaggcaacattaggtggttttataattttagactttgggaattctcatatcatttggacactatggaattgttggattatggtggaattggacatacacctctctttctctttcaaaacccctaaaacctgttttcggtggggtttgggtgcatgccagttaggggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccagggtcgggttgccagttcggtccaaatcatcgtaggccttgggttaaggcaggttcgtgagggttcacggccttgtttaataacactgtgtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactcccttcttccttcttcggatttcaactagtactagatggtcaggtcagtgaagaagaggacatcgccagttgtttgccgaagctccggaagactgcaggatccgctagcgaagtggaggaagcagtgaagccagatgtgaagcaggagtgaagatcttcgagaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagtgaaacaaacaacacatcattgaaaagagttagttcctttaaggtcttgtccctagttctggtctattctttccttgtatgcttcccctctcaacctctaccttgtgacagatggataatcctggtaaccaaggctatgggaatgatggatccgatgactcaagaacccaagccaatgggaatgagagaagcaccaacgcaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagcctccaacctttgccattgccgtcgatcctatggaagccagtgagtggttgcgcaccatcgagaagaagctagggttgattcagtgcaccgaccaggagcgggttggcttcgcaactcatcagctggttggaccggcttcagagtggtgggataactacgaagcatcacagccagaaggacataccaccacctggaacgagttttcatctgtattcaggagatcacatgttccctcgggaatgatcacactaagaaaacgagagtttcgctacctgaagcaaggagatttgaccgtcgcagagtacctgcacgggttctatcgtttggctcactatgcaccagaagatgtggaaacgggcgaagacaaacaagagaagtttctccaggggttaaaagatgagctcgcagtgcaactacttctagaggattatgaagattttgagaaacttgtggacaaagccatgcaactcgaaagtgagcataatcggatgacgaattgcaagagaaggatggttaacaacccagtatttccaggtggtaaccaaagacagcgcactgagccacttcagatcaccggatcttctgttgtgtatccagagttcctgccccaagaagatgaacgcaatgcagacaacaacaatagcaatactaatgctgatgataccaccaacaaccatggttcttgccccattcatgaccacttagatcaagcgtacaatgtcaacatcattcaccaagatatcgacgatagtatcaatgaaggcacccagaatgacaaccttagcaatttcgacactgagaaagactccaatggtgatagcaataatggcaccactgatgccgatgttagcaaggatttccaaccaccaattccaactcctaatcagaacgatcgttcccagacggacaactcagcaaagaagacgttgatttgttacaactgcaaagaaccaggtcatttctctagagattgtccacagccgaagcgtaacctgcgccatcactccggccattatgcaagaagaagacaggtcactcgtcttgtggtcactggagcaaacgccgtacctgtgaggcctcatattaattctaacccatagaggaaacaatgtaccgatgttaagcaccttccctttttgtttaagacagtgccttgtattcatgtaatatgggagaaattggtaataaaaacaagttctaagaggattcttttggaagatgcggatatgtgatcatgtgtataattgtttactgacaaaggagacctagggtatcgcgccagaggaactatattctaacctcgagctaataaccaacctgaggatggaaaagaaaaatcaagtgattaaccaaagagacatttgtttggactaagggttacagatgagtccttttcggatcaaaggcaacgacagttagtatagctttcggcaaaacacttcaaggtttcactgaaaggcagcaagccaaaggacctcatcgtcaccagaagcatccacaactctcggagtgaagagtacctggtggacaaagtttaagaggtgattgatagaagataccagcaaaggtgtttattatcgaaccaagaagtaggtcgaaaggtgattgataagagaaatctaaaaagaatacgtcagggctgaatgtgtaaaggaatactttgaatgctaaatgatgacaagcatggtatcttagtaatgacgagctgatctcgacgcatgacatgaagtgggtaacttgtatgaggttgacgccaaagatatgaattatgagaagttctggaacgaaagtcccatcttcaagtgccataatccagtcgaagtcaactagaggtacaaccagggaaaagtcaggtgaagagaagattccatctgcaacaggagattgagccaagcagtccagagtggagaagttttgctaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaaataaaattcattcgctaaaaggaataatagaattaattaaaattcgaaaagaaattggcaaacactaaaatacgtgcaagaaaaattccaatgtggcccggagaatttttgttaaattctccttggtctaaaaagagccctcaaattttacttgaattttcagagcaccggaaataattattaagcaacaacaaccttgatcaaagtttattaaaaagaaaaactaaaaatccctcctcttcctcctttgggccaagcccagcccgaagtccttccctcctccctctctttctctccctctccttctctccctcctcttgggcctcctcccctctcggcccagctcccttccccccctccttcctcccggcctgcctcggcccagccgcccagcccaagccgcctacccctcccccccccctcctgggccggccgcccggcccaactcgagcggcgccctcccgcccgagcgcgcacgtgcgcgcgctgaccgcgcgccccgcgtggggcccacgcgtcaggccgccgtcgccttcttcctccagccgccgcccggcttccctctccccgtgcgaaccctagcgccaatcctccctcaaatccgcttgattcactcggttaattccaaaattaattagggggaattaatcccctttccctcctcttcaattcccccttaatttccccttgaatggtgcccccaatcgccgggaacggccgcgccaagtccggccgccttcctttgccgccggccgccattcccgtcgccgttcccgctcctcccgtggccggctctctcccccatcctataaaatgggatcctcatccttcgttctatcgttttagccccttcccgagcctccccgtggtcgtatcacctctccccgccttctccttctccctctccgacgccggccggcctccagccacctctccctcctcaccggagcatcgtccggccgtgccgtcgcctccctcggctctgcaacaccgtccccttcaccggccttaccgtctcctcgccggaaactcgccggaacggtgcccccgccggcaaccagtggcattggtgccactgtactccctccagccggctgctgttcatcgccggtgcgccgatcgacgccgccgtctcctccttcgacaccgcggcatcgccttcttccccggcatcacctcctcctcgcccgaatttcgccggaacgccgtcggccgcgccggccttaccttccttctcgtcgacatcttctccggctggcccggtcgccgcgccagagcgtcggccgacgtcgccgtcttctccctcggcgacgccgcattggcctccaccccggactgccctcggtttcgccggaacgtcggccgcgaacctcttcgtccgcctcgccggagttgttcggccggccgtccctcctcgccgtgtaccggtcgggcaccttcaccaccatcttcggcatcgcagtcgcgacgtcgtcctcggcctccccttccctttgaacgaaccccgccggtgttcg

SEQ ID NO: 15825 - DNA, 25040 bp, Oryza sativa
  unsure (1)..(25040): unsure at all n locations
atatggaatggttggcctgggttggcttgggacgagctgggacccaaggtcgggttgccagttcggtccaaatcatcgtaggccttgggttaaggcaggttcgtgagggttcacggccttgtttaataacactgtgtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacagatcatcaccttcgctgaaatactcctcttctgatgattgaatattgcaagaatgagcatatgacatactcaacaagctacacagcaagtatgcaagtgcacaaggataccaaaggatggcataatataggctcatttgcaaaaacagcatttagcaaagatttaagagtagtaaaacaatagagtaattaatcatcaatattaatcaacactgaacagcacacccatgccactcaggcccaaccaaacctgaacaaccaaccccggtcgtacagatcaaacctccaaaccaggaattatccattccaaaccaggagtcaaattaattatcacattattaacattgatgagtagtgtgaaactaatcacgaaaaacattgctcaactcacccataaccgcgggtacggctattcgaatagttttactctgatcagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggactccccagcgacccccgtggacttctcgccgcttctcagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaatcaattaacatcacacgattaaccatcgtgagctaccatttaatgtaaccataattaaaacaataaagtaacataatttataattaatccctttagttagctaatgtttctaaacatggctaagcaaacttacatatagcatttagctgaaccaatccaacatataaggttcatgctaatcaaattataacccataggaaaataagatcatcttcggccattaattaattgggaaaggttcaccacccgatgacattcgaaaataatgcatagttgaaattaaataatagctttaaacgggttcaacatgctcaaagggttgtttgggatctgtgtgacttgtcttgggcttccgcaaactcttcggaaccttcctcaacggaaacgcactcctccggaacgtcggaaactaaagcaattaaacaaaaaatcaacaaaacagtacaaaaacaagcataaacagtacatgtgaatatttttaacatgtagatcttgattttagaaaaatttagcaacttgaaccacctgaaacggatctacggttatttagttacgattttctgaagatttaatctattagaaaaaacgaaaaggataagatgatgatgtcatgatgacgtcatcaatggtggccggctcggatggcaacctcgccggagctagggtggtcggccgggattttggaggacacctacgcgtagaggacgtcggggcgaacccgatggtactcaccaatgcgtccaacaacgagggacggcggccggcgacaacgcaagagacggcggcggctcggttgaacggcggtgatggcgctacgacggccggcgacggcggagagggggcggccgagcttcctcgctcccgtgcgcacctaacggcggcaacgagaggcggcaacgacggcggacgcggcggcgcggcgtggccggaggatggccggcggcggcggcgggttgggtggtgtggcggcggcgctacaaggcacgggaaagcacgggagatggggcaaacgaaagagaaggactagggggtcctatataaagccttggattgaagagatcggactcctcccgcaagaaatcgatccgagaaaaacaaaactcggttttggagataaactcgaaaacgagttcgattcgggcaagatactcaacgatttgcttcgatttttgggggtaaagatagaggaggatgagaggataaaaacccccctaacaatcggactcggggcggctggattggggcggatttgagggcgcaaggcggcggctcgggcttggcatggccggccggccggaggtaggagaagggcccgacatgtgggccccacatgtcggtgtcccacgtgagggagggcgggcggtgtcggctgggccgaatgggccggctcggccgctcgggcggggagggggcatgttgggccaaactcagcccaacggcttaaaggaggagttttggaactttttaattaaaaaaaatttgtgaaatgttgtttcatttattaaaaatacttcccttgctcaaataattcccagaaaaatctagaaaatagaggagcaagtgtagtatttaataaaattttatctagctcatttttatgttgaaaattttcctagattattagggtttagcttgtaggcttttaatttaaatttctaaaaattccaattaaacaacaatttatataattaggatttttagggcgtgacacctactgcatggtagaagtaggcttacatgggtggggtccatgtgtgcaggtgatagctggtgaaccagtcatgcatgcatgatcgtgaggcctatgcagcagtcaaatcagtcatatggatatgtacactagtacatgtatatataactatacattgatacgtatcatcactatcatcccttttaactagacatatatcatcataagtgcctacaagtatcatcgcccgagcatagaaggtatcaccaccaacaactacattacgaagtgcgctgacgcgagctttctcaaacgtgtggtccaggtgccgcgctaccgtcgtcttgcctccatgctccaccacgcggctgccttatcctctctcttctcctcctcgtccaggctaccaggtatcacgggtaccagataccaagtacctggtacccgtgatattagctttgctccggtacctatggtacctacctatgggtaccagatataatattgacaattcgtctaatatgatccaactaaattaaatgagcaatcattagttggcccaattagccaactaataattgtgcatggttggcttaaaaatctaaattatttaataataaaaataacggaacaactattttaccataagcaaactcattatacaagagtaattaattttagtgcagactacagccagggaacactgtcccatactgacgcatatgcatagcttctactccgtagctagctagcgattgacacatagcacaactccataccagccggcaggcaagctactagaccctatagtgtgtctagggggcacgtcctgtcgagtggatacacacgcatctcgtctaggggagaggtaatggatataccgttgaacggtataccgttctctagcagccctcattgtccatcccaccgacagacgcacgatccggcaatggcctggctgcctcgatcgactaacgcgaggcggccggcaacctgccaggctgctaggcgcgacggtgctggctgggcgacgatctccggcgggcaaccaaagcagccgacaaggcgaccagctaggcgcgacggcaccaggcgggggcggcgggcgaggatcttcggtggagacgagcagccgacatacgtggcgagggcgagccggcgaatcccctccaggccattcctcaaacaggtcccgatccgatcacccttttgcctcatctcttcctccgtgccccctctcctcttggcaaggtaactgatgtttacactcttagtcttacagaaagaacagagtgatggttatactgaaatcgactgctctgcttagggatttggaatcttgggagtgctcttgggttgctagtttactactaggtcaatcgcaatgctgagttagtagaaagctccagtacagcatagttttggtctcaatagggccatgtacatgactttagtggccctgtactaaactagagtcagatgtcatggcatgcacggttgacatgggcgcatgatttgtatatttcatggatgttcagttgagttcacattaattgatagcaaataatttccaggtataaaaaataacccaaagattttaccaaaaaatttgatgccaaaagcgggacgcactagaacttggcataggaactgcaatcaccttaaacacctatatctaaccaattattatgcattaattggtcactcttaagagatgatatttggacaaatcatcagtagaaaagcagacaaacagtactaatgaggtaaaattacaaataacgtttgctcatctcgaacgaaaatcatgtttctttctaaagccatatgcacattccagttttttaccccgtgctaacaagtaacacgggtgggcggctcgggaggcgaaaccctagccgcccgcgccgccgcatcccggccctctcctccacctcgccaccgccggagcttgccggcgtgccgccggcgagctgggaaggcggcggcgaggccagttgagctcggcggcgtcctccttggcgcgaggaggttggggcaaagccgacagcgtcaacctcagcggttggaggcgaagatggcagggcatcgtgtggaggcggtagatccggccctcccacccccgaatctggtcggtgcggcgacggcgcgagctcgagcgacggcgtggcgaccgtggcagggccactgcggcggcgcggtggcccgtggtggcaacgcggtggctgggcgtcggtctggctccggcgtggcggcggctcgggctgtcagcgcgccggctacgtcggtgacgcggcagccggagtgtcgcttgcgcccatgtggtggctggtggcgcggcggccagtggtggtggcgcgccggctgtgtcggtggcacgatgtcgacgcatcggccggagtagagcctgcgtcggcgcggtggccgaagtgcagcacggaggtcggtgcggaggtgcggcagcggcggctcggcgacggccgctcggcttggccgcctagtggccggcagcccaagacgcggcgaccgtgggggggctccgaagccggagcggcagcatttccggcatcggcgtaggctcagatggtagtgcaaagggagctggcggctgtgggtcgtcttcttcgttgctggtcggcaccctcgccctttctggagctccccccttctttgcagggagtttctaggttggattgagacggcaggttgtcacttgtcagcgggggaagctcaggatgccgaagcaatgccacccagtcccaggttctccttcagccagatctggcgaggaggccggcgggtggtggcatggaggggtcctaggccagctctcagggatggtggttcgatgaagtcggccgacggtggggcgtcggtgcggtgtggtggcagtcttgtcgttggcaggactggaagctaatcgcggaggggcatcggtcgggtgtggtggaagccatgtgccgccgatgtttagatggtggattcggattgggcgatggaccacggcggtaaggggtttcgagcgaaagcttagcctaatttctttgggccaacggtgactacgccttcaggcatggtaaccatcctgagggcattgttgagatacccctcctccctcggcaaggaactctgggtgaaaaccttgtccagtttttggacggatgacgacggcgtctttcggcgtcgcgacccttgtgagggcgtcgttttagagtcttcgtgtcataatggtgttgttggcccggtggcgatcggtctcgcatagcgatggccggttcggtgcttggcttccctctctgtagcgtgtgtttggacggttggcacatggttcggggcgtgtgctctagtgcacatccttcctcgacagccagctgtcgatgtaaaacttttcttgtaatattttcttcctatcttaattgcattgaatgacctccttcggtcattccggcaaaaaaaaaaaaacaagtaacaatatgaatggtattctgattctaatgccaccattttttttctctgttccttatgtcatcgccacaacatgcgtaaattataaattcatagcatttcaactgcaataacagttcaataattcactgcaactgtcaatgggaattcatctcttacaatttatttatttgtcgctgctgatgccttgcagccactaatgtccaatcaattgttttgctctgtccacgagagcagagagaggtgtgttgcattccatgaagcctgtatcacccaagaaaatcatgtagttctcaacccttgagggcgtctcttctaccatcagcagtgcattcatcatctgaaattcattgaaacaattggcatagcaagaactgctctccatcatatatatggtttgctcaagtatcatcctccggatcccagggtaatcaacacttggtttcatattcgcattcagtgcatccactagcttcttcacgaatcttcgcttaatctgtccgtgctctagctcttgcacaaattcttcaggtttgactttgcatatctgtgaactaagaccaatgaggatttctaattctgccccttcaacatccgttattgtttccaagacctgtgtagtggaaccagcaatgtcatgtagcatgatgaacatagttgtaaactataattatacttatacaatttagtggtaaataaatgtccattttgattataaaataattatgtcttgacaaacattaatagacaacaaatgtacaaatgatacaacatactatacatatctaatattacacttgaagtatggattagcagggctcaccttttgaaaggcatcagataggtcattttggtttgattctgtgaggtcgggttgagcttgagcatgcaggtacagattacgcaacaggctcgcagccacatatatacatttcccatcatggattaggatcatattttttagtttattaatgaattctggttccttcaacataaccaagcagttatgcacattttctgatgccagcattgccaatgcttgcccagcaaccttcggaagcaagcaatcaccatctgtactagatggtccatcagaattgagggacgccttcatcagcctggtaatgagcacctgcatttgcccaatctcctgccttgtgtctcggtcaatggcaaggtttctgaggattcctgcgacgagcttccttaattcttgcatgctagtgttgtctcccaagatctccgcaaggtttcccaacaggaagggatgttttgatatcttgtaccgcaatgctatgccaatttccccttcaatgcttgtgagcctctacagcaccctcagtgatgactttacgagaaccttctgttgtgctacggaattcaccattgcacttctgaagcttgtgaatcctatgattttggggatcaggtcagttactttgtctatttccacacagttattttgatcacaactagcaagactgtagacaattgacatgcccaatgctgggagaagatcgtcctttgtcagcggctgctccttgggaattgaccaatactctgatatcctctgccaacttctgagtatggatacttggtcgttgctgtgtgctgattgggttggcgtttccagctagttgtcagtgtccgcaactaattcttgtctttgctcttgatcaccagctgcatctagtctttcttctgttggatcaacaaaaggatcttgatcatcatctgcatttagaagtgggtgtcctctttttggtcttccctcggtatccagaagcgttgatacaagctgcattgcctcagggacagttacaattcggaggctctttgcgaactcggccatgaccttcgcagcatataatctaatagttgtatgttggtttccattagtccagtccaacatgttgatcaacctggccttcgtctgcattgaagtggtgagtttctccaggagttgtgctcttgtcggatctctttgcagaaaagtgtgcatcatctggatcccgtacagttgattcttggacaagtcagagtttatagaatctatcgcaaagttgctgaggttgatcctctttggagcaaacacacctccttccatgtatttgtcgaaggcatattcgtagtacagattgatagattcaactccccactgacctgtaaatccagcacggcaaacgagggatctcagtgggatgaacgagaagacctccagcgtgccggcaacgatgtaaagtatgccttggccaagcaccatgctgtagaggatggtaagagattggccaagatttgtcttctcaccaacaccgatgtagtcatgtcgcgtaaggcgcatcctcgcgagctcttcgcgcacgatagctgcaggaatctgcaagttgccagatgacagtatggcaaaaccacataaatcgagcaagatcatcacgtgttgaacagttgaaggactggatcaaccatgaaaagcatcatcactatcgcagcaagcatgcacgagttaagaataaaccgacggttgccaaaaaaaaaaaaaaaaaaaaaaaaggaataaaccgacgccaaaatacgtgtttactgcccaaagcaggacgcacttggttgacaataattgagaaccgcagcctgctgaccgtcaccaagagcacaaccgcaaggagcactatgtacactatccacatgacaaaactgtctccgtacatatggaatatggaggaacccatcaataggattgcaaccacggggctccatagcgatatcacacggagcagcagactacaggtgcgtggtcttcgagctcctcgagatactaatgggccaaccgtaagtagtattactactaataccatgattataatcaacataaatgccccgtcctgcacctcccgaacaacaatggccaccttagcagcagaaaagtatacgatcgcgatcagtccgttcccgccaagtgatctgaaactgaaagcacctcttgtccggaagaacaattggtaatcaaatctattgttgcgaccgaacatcctgtgtaatcaaagaaaagtgaaaacttagactgcagaacaaaaaatcaaaaacaggtgtagatgggcagtacataagtagctgtatataccttgcggcttctaggaatacgatggctgtcgcgaaccaaaaatcgccatgcgagtcgagcaccacagggtagccacctagcaggacaacggtagcccaagtgaaagccagcgtgccgagtgcattgctcgtcctctccatcagtgtcaccacgcgaacgaagcaattcacccatttttccggcgccgcgaccttgtcttgccggtcggagctggctctggctgctatctggactcgatgctcttcgccggcgatgtcccccatttccggaccacgcgcttcaacaagagaccttgggcaccgccggtgatgcaactcaatctgtgttccaaaattttaaacaatggtgggcactgggaagtccaaagaaaaagaaaaacctgggcggtgctccattgccggcctgacaaaaaattcaaagctgcaacattgactctacgaagctggtcaattcagctacaatcgacacgagtgcgaagtttctaattaataattggcttattggcacattagtgagatcaattgggtagatgtgggtgacatgacctcatctcccctgttatttttatcaggtgcagatgtggtttcaccttctttctcattccccttattgttgtttttggccaggttgtcaccggcgcatcgcgactcacatgtgtcatagtcaatcaggcaatgtctccgaaaagacaggaattcttggccctgtttacatcccccggcaaaattttttaccctgtcatatcgaatgtttggacatatgcatggagtattaaatataaacgaaaaaataactaattatacagattgcgtgtgaattgagagacgaatcttttaaacctaattgctccatgatttgataatatggtgttacagtaaacatttgctaatgacggattaattaggcttaataaattcgtctcgcagtttatagacggaatctataatttgttttattattaatctacgtttaatacttcaaatatatatccgtatatccgatgtgacatgccaaaacttttcacccctgaatctaaacacagcttgtctgtcggaggcatccgaactcgggatggaatgcttggaggtaggacgtgaggtgaacgtgcgttcatcgcgacacacgggtttggcagttgggccgggaaactcagcaacacgaggagcgcgacatggacctgacgtgatgtcggccctgtgggaggcctgacgtagggctgtcaaaaaaagcacgaggctcgcgagttgctcgagctcggctcgtctcagactcgattcgagctcagctcgagatcttaacgagccgaacccgagcctagctgcaagctcgcgagctttgtcgagccgagctcgagcttctcacgagcctaactgtgtgtgaaatatttatctttttatatgataagttagtagctcgaggataaattagtatatattcgtgtgaaaattgtattttggcatcatatattaatcttagattctcattttttttccttcaatattgttaattaaaattatttttttttgcaaaattttgccatcaaaatatacattgtcttatacttgatcgagctcgcgagcctaaccgagctcgagctgagcctgcttaaaagctcgaaggaggactaggctcgattcgagcttggctcgagcctgtgtcacacaagctcgagcctaggcaagcaagctcgctcgagctcggctcgttgacagccctagcccgaccgatgggtgccaactggcaaggtcacagcctgatgcatgaggaagccagcagcaaaaacctgcggggtcaaagctataaatttttttaagttttctattgttacaacacaaatatcaattttttttatctattttgcaaaaacctatggggttagctgactatacagattacatgtagcttcgtcactggtcagagggcgaatgtcgtggactcggagtgtttggcttggcacgtgccggagcggccgggagccggtaacatccgaaggctatgcgaaacagctgatccggctgtttggcggagagtagctcgagccagcgaaggaaactcttaactacctcctcggctcctccacaccaactaccacctctatctcaaaatattgctatctaagatagaatttttaggtaacaacatgatttgtttatcgctaagcttttaatattttggatagcaatacctaagaacagaagatactaggtagtagtaatattttgagacagagaaagtacatatttctgtttctgttcagaaataaaccaaccgccccaattacatatcagcccatctacttcccgagatctcctaacttcacttcgcacgatccgagaaaactgaggggtgccctcgactagtcaactcgaccgagtaatcgcgaggtgaccggcgatggcggcgaggcgatcagctaagcgctagggtgccggcttgacggcaggcgaggctctacgaccggaccaagagcaaccgacgaggcgagggagaatcccatccaggccattcctctacgggtgctctctccccccttatccccctccgaatccttcttggatcctctttgcttggcaaggaaacccttgttttcgttgctttgctaactcgatctagggatgcaagtgggtagtcccgctacccacataaaaatccgcttgctagtgtatttcttgcatggtagttcaaaatttagaagaataaatgaactagaagtgggataagcgggcaaaaaaagcccgcttgcccaccctgcttgcatccctcccgatccagttctagtcctagtcatggttgtagtcgcactaaaaaaagggagagaatcatggttattctggaatcgactattctgcttagggaatcgattactagtttattactggttaattgcaaggtgagttgcagaaacccaatgcaccgcagctttggtctcgacacgaggggcgtgaatttgagaaccctgtgctcaacaaaatttcaggcaccatgggccatggcacgcataatgcattgacatgggcgcatgacttatattatataacagttgagcacccattaattaggagtaaagtttttgctcggtggacaaaacgagagatagaaacactgaacccataagttgcgcattgtcatggtctgaatttcttagccatagtaggtgagttctgggctgctacatgttagatagatctccctccccttgagcccaacggctcaaggaggccttgacccacgccctgatcgggggcgcccagcccaatggctggtgggcccccatcaccctgcgccatataaagaggggtggaggcagagcggcacaagacacgaagtttgtcaccgccgccaactccaccccacaaaccctaatcagatcgagagggggcgcagccagtgatgggaacgccccaccgccgcgccacgcctcatcgtcgaccacgactcccactgctacgaccaccgtcgccgtcaagcacaccatcgccgccgtccacgtcaagcccgcgacgacaacgacgatggccggccgcacttcctcctcctcaacatcgaccggtcacatccctaaaccctctcactccctctttgttaatccatctattgttgttcgtctatccaaagtgttctacccgactagatctaacctaggtgatcccaaagcaatgctaacaaatggtatcagagcaaccctagcgtttggatcttgttttcggggatggaaatccaaagagaaaagcaaaagaaagaaaagcaaacgatccaacggattgaaaagagaaaccctaaccctaatcttacctcgtcgccggccgtcgttgacgccgacaacggaggggggaggggcaaagaggcaccgccaaggagcccctcgacggctgcgcgcgcacccgcgggtgcacgcgcgcgccggcgagggggcccgcggcggcgccgccatctccttcgtcgccgctactctctctcactcggtggggctggtggcgcgatgggggagaagagaaaagaggcgtcgacgacaccgctcggcgcggccgagcccgcccgagagagaaagcgaagagaaaaggagggggcgccgcggcacagccgctcgacggtagcgcactcacccttgagtgagtgcgcgcaccggcgagggggagtgcgacggcgctgccgtgtcgccgttccgccgccgcgcggtaagccgccgccggggccgtgccgccgccggcgctgtgctagggtttcggcggtcgcatgagagagaagagaagaagctagggtttttggcgcaggcgactgggggtcaggttttgttttgcccgatctctccgcgcggtcgtccgatcgaaaccctagcgatcggacggccggcggcggccgggccgaaaatagcccaagagggcgcgcgcggggggcggctttcctggcccaggcctaggttgcggcctgggggagggggcatggccgcaagcgcctaaaggcgaccgtgggccgaccggcaaaggccaaaaaagtccatattaggtccctcggcgaaggaaaagaagtttaataaatgtccctattcagaatcattttcaatatgtttaatgattgtttttatttctaagcaatttgtaaattgtgaaaattgtttagagaatagataaatgtgagaaatgcttctgaacatgtattttgtatgttttcatgcaaattacaatagaattttgaattgtttttacatgtttttcctctgtttaaatttgaaccaacaggagaatttttacagagagtaaataacatagttttgttactgttcttatggattttaatatagatcttccgctgcaaatagatgatattgatgaaaattagtgtttctaaaattaaatttcgaaccaacgggagaatttaattttaggaacattaattatgtgctatgatgttgtaattttctgacccacgttgatgattgcaatgttatagttatggctttatgtgttatgtctattttctgcccaacggtgatgtagacttaatacataatatttttaatgttaattttgttctcacaatacatgattatctcaggtgactactccttgatgggttacattaaagatattccgaccctgaaaggagataactacaaagaatggaaaagagaactcgaccttgcttttatcttgggagaggtggactgggtgttgactaccccatgtcctatagaacctgctgaacttttcagaggtgaaaaagagtcagatgctgaatggcaaaagagagagagggaaaatgcttccctcatcatgtcgtatgacattgggcatacgaaatggaccttagccaacaaggaatgtttggctgcggtaaagaacacgattgagccaaccatattgggcttaatcccagagtatgacaccgtctctaagtacctcgaaagtataaagagccagtttgctggttcttcaaagttttatgcgacacaactgataaagcagcttgtgacagaaaggtaccatagaggtggtgtaaaagaccacattcttaggatgagcaacatggcttccaagttgaagcaaaaagatttgggcatctcagatgactttctggttcatctggttatgacctcattgccaaagcactttgtcaaccttgttgtcaactacaaaataagtccagagaaatggaatattgaagagctcatctctaattgtgtgcaagaggaggaaagaatcaaagagaccattggtggctcaattaaccttgttaaagataacaaggaaaagagccacaggtcaccctcctcaaaagcaaaacagcctcagcatctgcctcagcaacaacagttcacagttgagacaggatcagtgtctccactgcaagaagacaagacattccaagaaagatcgtcctgacttcgtgacagtgatcatggcaaagaaaggtgagaacattattacatttgtaaatgaatctcattatgattggttattctagatccacatggtggattgattctggagcaactattcatgtgtgtaattgtttaaagggattccgttcgatgaggactatgcaaagaagcgaaagatccattagagttgccaatggagttgaagcaaaagttgaagctgttagagatcttcgcctagagctcacgaatggcttcacacttttacttcgagatgttttttatgtcccttctttgcaaagaaataagtgtatccaaattgtattttgatggatatgattgtcattttggaaatggcaaatgtgaactatggtataataatgcatgtattggtcttgctgtgttgcaagattagctttatttgttatctctttttgagaatgtgaatgttgtgtcctcgttgacaaaagaaaacaagaaaagaaagcgaactcctgatgtctcatcgaaattatggcactgtcgtttaggccatatttcgagggggagaattgagagactggttaagaatgtaattcttcctccattggagttctcagttttagaacaatgcatacaatgcatagaatgcatcagcgcccaaaacaccgtatgagctatggatcctccgtgtgtgggggagtcctacagaggccaaagtatttaacccaaatcttgggaaattggatcccaaaacagtaagctgtcattttattggctattctgaaagatcaaagggtcattgtttctactgtccaaacagttgtacaaagtttgtagaaacgggacatgccgtcttcttggaagacgaaatgattagggggagctcggtagttcgagaaattgatcttgacgagaggcgggtgtctgagcccgctcagtcgattcaagagccttctcctctctacctgctgatgttgtgcttgcaatgcatgacgttgcggtaccaacacctattgttatctctcctgtggcaacaatgaaagaaagtgaggaacctgttctacaggattcaacagaaattattgccacaccagaggaggagctacaatagcctcaaacagataatgtgccaaaacaggaggcccctagaaggtctgaaagagtcagaagatcggctatccatgatgactatgaagtttataatatagaagagtcgcatatgcagaatgatcccacctcatatgaagaggccataagaagcgcccgctcatctgaatggttggaagccatgaaagatgaaattaaatcaatgaaattaaatgttgtctgggatttagaaaaaattcctaaaggagccaaaacagtaggctgtaaatgggtctacaaaaccaaatatgactctagagggaatatagaaaagtttaaagcgtgacttgtggcaaaaggcttcacgcaaaagagaagggattgattacaatgagacattttctccagtctcttgtaaagtttccttcgggattataatggcactggtggcacattatgatttagaattacatcagatggatgtaaaaacgacatttctaaatggagatttggaggaaaaagtatacatggcacaaccaaaaggtttcgtcatgaaaggaaatgaaaatatgggatgccgtctaaagagatccatttatggattagaataagctttgagacagtggtacttgaagtttgatgggacaataaagaaatttgggtttcaagagaatatcgaggacaactgtatttattcaaagtttaagaatgggagattcattttcctaattctgtatgtggatgacattctactggctagtagtgatgtcagtctactgcaggaaacaaagaaattcttgtcctcaaactttgacatgaaagatctcggtgaggcttcatatgttttgggcatagagattcaccgagatagaacaaagtatgcattaggactttctcaaaaggcatatatagaaaatgtgttgaagaaattcaacatgtacagatgcagtgctacacctgctcctatagtcaaaggcgaaaagtatggggcatcgcaatgtcctagaaatcagtatgagctcaatgaaatgaaaaacaaagccatatgcgtcagttgtaggaagccaacaggatgcgcaaatgtacacacgacctgacttggcatttgttaccgggttacttggcagatttcagagtaatccaggcccagagcactggaaattggtatagaaagtcttgcgttatttgcaaggaacaaaaggcctcatgctgtcttacagaaaatcagaatcgctccagatagtgaggtattctgattctgactttgcaaaagataatacaaagtcaacatcgggatatgtgttcaccctggcaggaggagctatttcatggaaaagctcaaaacagactatcactgcagggtctactatgtatgccgagtttatagcatgctatgaggcaacggggcaggtgaactggctaaagaaattcatacccggttttaaaggtggttgacagtattgagaaaccactaaagttatactgcgatagcgaacccacagtaatgtactctcacaacaatcagtcaagtggtgctgccaaacacattgacataaagtactatgttgtgaaagacaaagtccaggatcaaacaatcagtctcgagcacattagaacagaaaggatactcgcggatccgctcacgaaaggcctacctcccaacgtgttcaaggaacatgcagcatgcatgggtttaagggaagccttatgaatcctggactatagggcccaaaagttaaagtatctgtttctgaatagagatgtgtatagtggctgtcgaatccatcggtgattaaccgtgacgatgaaacatgctctatatgcaaatctatgatggaatagaaaaaggctaaaagaaatagtgagatcaagggggagaatgttagatagatctccctccccttgagcccaacagctcaaggaggccttgacccgcgccctgatcgggggcacccagcccaatggctggtgggcccccgtcaccctgcgccatataaagaggggtggaggcggatcggcacaagacacgaagttcgtngccggcggcaactccacccccacaaaccctaatccgatcgagagggggcgcagccagtgacgggaacgccccaccgccacgccacgcctcatcgtcgaccacgactcccactgctacgaccaccgttgccgtcaagcacaccgtcgctgccgttcgcatcaagcccgcgacgacaacgatgatggctggccgcacttcctcctcaacatcgaccggtcacatccctaaaccctctcactccctctttgttaatccatctattgctgttcgtctatccaaagtgttctacccgactagatctaacctaggtgatcccaaagcaatgctaacactacagagtactatcttgtgttgaatgggactaattaccagggcaggaaacccaattttcaggagtcgaataaacaacattttttttgaaaataatcgatgccaagactagaacacactaatacattgtgtaggaattgcaatcaccttaagcatctttaatcaattaagcattgtccactccaacaaatgataattggcagtagcaaatactcctagattacagtgcaggactaatgactaatgaggcacagatacaaatagcctttctcatctcgaaggaaaatctatgttctttctagaaaggtcatatgcacaataacttttttaccctgtactaacaatatacatgatgacatgatcgtttgactgaaatgcaaaatcatcttacaactttcttcagttggcactgttgatgtcatgcagccactggcgactgatcagttcttttgctctgtccacgagagcagagagagctgtcttgcattccatgaagcccatgtcacccaagaaaaacatgtacttctcagcccttgagggtgtctcttcgaccatcgacactgaatccatcatccggaattcattgaaacacttggcattgcgagaattgcactccatcatgtatatggattgctcaagtatcaccctcctgatcccagggcaatgagcattttgtttcatgtttgcattcagtgcgtccactagcctcttaatgaatctccgcttaatctgcccgtgttctagctcttgggcaaattcttcaggaatgagtttgcatatctgtgaactaaggccaatgaggatttctagttctgccccttcagcgtctattattctttccaacacctgtagtggaaccagcaatgtcatgtagcatgataaatatagctgtacaaactatagttatacttatatagttcattggtaaataaatccccccttctttttaccaaaaatgacaaaaattaatagacagagaatgcaaaaatgatatggcatgctatacacatctatgttgcactcgtagtttgtattagcagggctcacctctcgtaaggtgtgagatagttcctttaggtctgattctgtgagctcatgttgagcgtgcaagcacatattacgcaacagacttgctgcaacatatatgtatttatcatcatggattaggatcatattttttagtttattaacgaaatctagttccttcaacataacgaagcagttatgcgaattttctgatgacagcattaccagtgcttgcccagcgacctttggcagcaagcaatcaacatttgaactaaatgatccgttagaatcgaggaatgctttcatcagcctggtaatgagcattttcatttgtccaatctcctgccttgtgtctttgtcaattgcaaggtttctgaggattcctgccatgagcctcctcagttcttggttgttgctgctgctgtctcccaagatctctgcaaggtttctcaataagaagggatgttttgatatcttgtaccgcagtgttatgccaatttccccttcaatgcttgtgagtctctgaagcacctttagtgatgactttaagagaaccttctgttgtgcttcagaatttaccattgcacttctaaagcttgtgaatccaatgattttggggatcaggtcagttactttgtcgatttccacgcagttattttgatcacattcagcaaggctatatatgattgacatgcctagtgcagggaggagatcatcgtctgtcaatggctgctccttgggaatcgaccagtactccagtatcctctgccaaattctaggtatgtatctttggtcgttgatgtgcattgatcgggttggtgcttccaacaggttatcgatgtcctcagtcggctcttggtcaccagctatatcatgtttttttatcttgtctatctaatatatcaacaaaatgatcttgatcatcatcttcaactaggagtgggtgtcctcttttcggctttccatcagcatccaggagcgtagatacaagctgcaatgttccagggacggttacaactcggaggttctttgcaagcttggcagtgaccttggcagcatataacctgatagctgtacaatggtttctactactccagtccaacatgctgattaacctggccatcgtctgtgttgaactggtgagtttctccagcagccttgccctggtcagatctctctgcagaaatatatgcatcatccgtatcccatacagctgattcttggacaggtccgaatttagagaatcaatggcaaagttgctgaggctgatcctctttgatgcaaacaaacctccttccatgtatttgtcgtaggcgtatgcgtagtacagattgacagattctactccccactgacctgtaaatccaccatttcggatgagggctctctgagggatgaacgagaagacctccagtatgccggctacaatgtaaggtattccctggctaatcaccattccatagaagatttttagagatgggacaagatgtggggtgccaccttggccgtcgtagccctttggattaaggcgcaaccctgcgagctcgacatgcgcgaatgctgctggaatctgtaagttgccgaatgacacaatggccaaggcttctatgtcgacaaacattatcgcatatcgatatattttctcaatcatgaacatcggcatcacaattgcagcgagcatgcacgagcatcttctatatacaaacccgccggaaatggctgctctgggcggcgatttacgctgtcgtggcccttgccgttgcttggcacgtcatccagccggagcccaggggtggatttggagcgcggtcgttgcgcgcgttctccgccgttggatgaccatcgtgcgtcggtgcgtttggcatgccacattttcctttttctcgtccgctggttctctgcgttgcgtccgccacgtgttgttccctgtgtggtggcctcatttggttggtttgtgtgcggtgcattgcaccgcgcgcagggtagggtgggcgtccttgccattgttttctccggtgttatgcgttgcgtggtgcatttctttgttttttgaggtagccatggtccacagattgcctgtggctgccgtgtgggccgcatggcctctgcctgttcgtacctaacgtggaacaggtctatgctgtttgccttagctgctgtgtcagattgctttggtcgcttggtgcgcgtgtgcgctgtgtccatggcacagtttctctctggccggtgggtctgctttattctgaacctgtgtgttacggtctaggaccatatgctgttggagaccgcgcctgtagtgggattactctgtgatggcttctccgctattggtgcgtttgcgtgggttgtcgatatcaggcatcgctgtggtcctggtgtatgcgccccgttcctctgcgtcctgggccatgtccaatccgcttggatgcttggttcattcgtcttggtccatgcagtcttcttcttctgcagcctatgctgttagtctctctggtcaggttttcttgggttgtagctaggtgcgctgcacttatatcgctgataggtggggcagtgtcatctcagctagccatttgtttggttcctatttgtgggtgtttggtgtgcaggtgtacatgattgtttgcttccttgctgcagctcggcggagaaccccttctatctttgtctgtatatattactacttgcgtttctctttctttcttcccttcggtttctcctcctctcgtcggtttcttcgctccattgttctgttccttgctcgagaaactcccactcgttttgctcctgttcaacttttcgttatggcgtggtaaggcctggatcaatgcgtgtggttctcctgtccgttctgtcatttgggttttatgtttgttctctcttgtttgtttgcttatgactgcgcggctgttcttggtagcattgaccctgcaccttttgttccatttaggggaggcaatctgcatgggctgcaatggacctttaaaggttcctgatcatcttccattgcacgtgtgcgggctgcttctaagacctagcaggtacttttggttgttgctggtttcattggccttgtgttatgctttgcttcctacattcttattcactgatcatgctccgttctctgcagctctgttccgtcttcttccttgcctctgttcacagcttgtgtgttcgcttcgtggtgcgttttagtggattctgcctgtcgacgagcatattccttgctaaaggtattcccgcgctattaatctttctgtcctttatttatggttcattggtttagtattttgtttctattgcctgcattcatcgctgtctaaatctgcatgtggttgctccagagctttcggtcgttttatattgttcgttcactgtatctgtgtggtttgagccactttttttgcccgtgttctttgcttcattcttttcttgcctctgtaaaattatgatggcagttagaaacgcatgctatggatagagtgcgtagggtacgtgccagccggcagagaagggccacaaatgttctgtcccaacagagtgcaatgcatatagaacatgctatcgttccgctagggcagccccatcaggaaagtcggtgcaagaggaaatgttcgttgatggattttgcacctcagctggcaaagttaaataggcaaaggcgttccctcctgcgttcaaagatggatccgtccgttcctttggccaatgtggatggtatgctctttttgttgtctgtgatggtaggcttgttttttttcgtgcagtttaggttcataggctgttttactgtctttgttcgcagcaaatcacactgcacgagccaacggtagttcctcccggacagacaaggagtatatccgattgctaaagggttcggccgctgttctgaatacgtgcacgtaatgcattgtttttttacacgagactatttttgacattgtccagcgcttttgtggcagcatcatacccagacagatcatactatggccctccgacgtatgaatgcccgtattgtggtgccatgttctggtaccaggagagggtcaagagtgcatctgctatttcaaaaagaaaaataatttacaatctatgttgcaaaggaggacgcatacaattgccaaaactgcgtgcccctcctgagccactagcatcattattgaactataatggtgatgcacgttcgaaaaattttttgaggcaaatacgatcgtataattcgatgtttgctttcagctcaatgggtgcagctattgataaatcgattaacactggaaatgcaccttatgtattcaagatcaatggagttgtgcaccataggattggtactcttgtgccatcctgtggctcacctcccaaatttgcgcaattatatgtgtatgatccagaaaatgaattacaaaaccgattaaatatatttgaaaacgacggtgataattcagataaagcagatcctgagataattcgtgccctatcatcgatgcttgatgctgaaaatactcttgtccagagctttaggtatgctagagaacgtgttattcagcatggcaatcagcaagtgacacttcgccttttaggttgcaatgcaaaagacgatgtgcaatacaatttaccaacgaacagtgaaatagctgctattatagtaggtgatttttctgcgaaagaatacaaatttgatgtgcttgtctacgataaaggtcgtggcctgtgccagatttctcccttgcatccatcttatatggcattgcaatatcctttgttgtttccatatggtgaacgcggattccatttaggcattaaatacagtaactatgatggaattggcaaaaagtatgtcacgatgccggaatattatagatatgaaatgcattacagactaaatgaaccaaatcctttcacatgctatggtcgcttgagcgatcaaatcgatgttgatatattttctactattgaaacaaataggctacaatacttcatcgatcatcaaaaagagttgcgctctgagtctgtagatgga

SEQ ID NO: 15826 - DNA, 250 bp, Oryza sativa
cattgcctatagctaaaacccattgactaaaatcatgcaattcttttttttgattgtctggtaacattggattgagtaatctcatgtttatattcaggctgagtagcgctacatgtttccatagttctgagtttgtgatagatgcattgattatagcctgacgggatcctttaggaataactgggagtatttgtttgaaatcaccacctaggacaataggctttcctccaaaaggtacaatagaatttga

SEQ ID NO: 15827 - DNA, 10049 bp, Oryza sativa
  unsure (1)..(10049): unsure at all n locations
aatcacgccgcctgatgcgccgccgaatgagggaggagagctagggtttgccactgtgaaccggtgagaagagaggagaaaaaagggagataaggatgggaggaggtgagggcacgcgacctcttcacatgcgcgagtcgcgcgcggtcctgggccgccccgtccggccgaatcggccggatgcacagagccggcatctggagggaatattccctaggtggtggccatatcccagtaccgcccatcatccaaacacctccaaaatttgggcggccatatcctatcccagcctatccctccatccaaacacatcctaagtgttgtctctgctagtttactggctgaagagagtaccaactaacacaagaacagatctaagcatggcacaaaacttcttcactttcaatcagaagttcagagaaaggcagtctcaccgtatcatgtcagagaaaacttcagcagattcccaagtgcatgtccctgaacttccgcttgattcttcctggacctacgctttcctgggattgaaaaatggcatggacatctcatgatcaataatatacacaatttaaatcagaatcatgtacatctcatagtcaacaatattcatcacaatctaaatcagaatagtttgcgctctcatcgatcaaaggttgccactttaattgccttataataatttaacaatgttgttttcttctacatagcaaatcaataaatcaaaacgatggaacatgaggctcaattcttgtaaatccctatcatctcatactgatattcttgtttaacttcattagaatgatagattacatatttacagtgattaagcatagcattatagaataaaagcaataggacaagagtgcaagaccatgactaattcagacattcagtgactataaactatcgattcaccggttgcttagttgttcttctagctgctgttgctcgccgcctaatctgctagctgctcggctgtcagcgtcggcagtctcgttgcccagtcgcctggtaccttgcgcccttgcctgctctgcctccatatgctgctcgccggctcgccaccgcggcgcccggctgctgttccatgactgcgcccgcctccgcttattcgctatcgccggctcgccgaagcacctcgttgctggcttgctgcttcacccaaccgcccagccacccagccgcgagtccccaaccctaatctatagagagagatgcgtgcgtgaggtcgcggccgcaccaggatcgcacgacgatgacgccctggatggatgagtgggggcaacgtctttcggcgaggcaccgcagtggcgatggggaggagagcacggaggaggcgcgttggatgccgggagtggcggagggagcggcggagagagggatcgagccatcgagggcgagagatcgcggtggttgtgaggaacgaggagaggtcgacgactcggggggtggggaggggatgcatgtgtctgcgcctacagcacccattttgaagcgttggatatctggatccaatgggtacaatggcgcgtggctgtcaccactacaaaattttaaagtagtagagattaccggcaaggatcggtatcgctacttgagtttgcgagaccactcgctctcacgaactgcggtctcgtgtttttattgtgcaagatcgtaatatcaacggtatatctgtgcaaataaaattacaacccgaatatttatgagagaaaaaaataaacggtatatttttaatttttttcctttttttctgtatgcttgtagttgtagctagcaaccctcttggtagtacagatggtttacaaaaccaaacgggtttttttagaaaaccgggagctccattagttggtctaataagccaatgcaaaagttaaaatttaaagttttaaacttgattttgaagttgattttaagatatttttaactaattttcttagctttggattttgaattgcttcgaaaagtatataaaagttttaccaataaattaatttttattccctaataagctaaaaatatgggcaaccgatgaggctcgggacttcctgggtcggctagctctgaaccacaatccgcttggttttccagttaagttcaaaaggaaattcaaactggataattgttgataaagtttcctttatccttgtttgatgaaaacaaaacaacgaacacacagaaaatagggaaaccctgtattttattaatcatgattcattaacatgaatgtttacaaatatatgagggctcccgcaggagttcgccttttgccttcgtgaggaatgcttaatagaaaggtatgctgactggaaattgcgtgtagtccgctgattcccggtgcatagcaatgaggctaccggttaattacatccataggatgagcctatggaatacctccgattaagctgcgctttgtgatcactgtcttcaaaattaattgctcgccgaaggttgaggttggtgcagatttaacggtgaatatagtgaatgtggaacgggtggctttgtttcgccaaaacccggtcacactacactaccctcacatcggtgtgcggagggaatttggtgaagcgggtgactttttcctcgtcggtgcccagtcatgtatcctggcctttatcaaacatagattttacggttgcttttgcctcatcggtgcccagcaatggtgtatctagctcccgtccgttttagacgtgttaatagtatagtgacctggccttgtcggcgctcggccatggttttgtctagccttatccatcagacaaatgaaatgagtgaatggctatagctttgttagctttggccaatatgtcgtccggcttcatcggtctcggacgtagcacaaatattgataaattggccatttcatctcatcgacactcggccacgatgtcgacgtttattttaaatctgcacacctcgccctcatggctagcgttgttttatttagcgaataatgcttgtcttcaggaattgtgagaaattgctcccgtccatccggtagaatttggagagagaaggaattgctcccatacatgacatgcacgaggcaatatgtgactcatccggcatgaatataaatatgtataaatcatggttagtctgatgccaataagactcaaactcatcccaagtttatataaataaatatccacatccaatatttgatattgataatttagacggtccaaccctcacgagggtcaggctcgccttgtatttatttgcagcctatattaatggcttgacaaagatggcgtgtacatgtgtatgcgtcactggggatacttatatatccatggctacaagttcacaacacatccacgatatattcatcactactccactttactgttttaccgtccgggctgcgcaactgcacaacgctacggtgtatatttcctccctctaggagataatgccgggctatgcataatatctgcacagcactacggtgttgttgtgttatcttggataagcggcttgacggagaacgagatcagcttgtttctgaagactcgccgatagagatgccatcagtgccggcgattacaggttgctgatccgcgatcacgcaccctgtgccatgcgcatgcatcttctttctgatctctctgcgaatatatgtgggtgcgggtgtgtacctctagggcatattgctgcttaatggcgcagcgcttgcgccgtgtgttccctcttcttcctccgtcgcggggacggagtcggtgccttttataggcagaggcggcggcaacgatctgcctgatctgttccgaatttccagcataagccaacaatatcacacgttaattctcctgacaagccgacgcacagatgagctaatccatccacgagataaaaaccaaacacacgtactggagtctggagataatcatgcgattaacatggctgatgacggtgggccccatgtgtttaatcgccactgccaatttccaaattagagataatgaccgtgcatgctcacgtagcaaagcaagtaacgatagcacttgcttatttcttttcttttaatagctccaatcttttgaatcgtacatcggatttaaaatccatttgaaccattactttctattcaaattatacaacaaaacgagtccaatatcgaatatattcggacatcgtgatatttgaaatctctaggcccacatgacatagagacacgcctcgtgtatattgggttgcaaataatattttcatacaaaattaaacgcccaataaatttttttatcttctatgaatttttagcacaaaaattcatcaaacaatccttaaaaataataccatggtggcagtgagaaaacaatctatatagtaaaaatatagaaattgttctaccaggtggataacaaattttctttaaggacttcaaaatgttgaagtgattgttcctctataattcttaaacataccttcaaatttttaaccgatataagagtctagcgtcaggggattactacttctcatgtgaatggggcaatgaactcctcgcttgtactgccttctaattgtacatgatataacatatccttaaaaatatgaatttagacaatatatgaatttagacaataaaaaaggatgcgtcacattatattaaattaacttattatgagacagaaggagtatagttgtgacggagctcgtggctcctcaccgggagaccgcgcaggcccccctttgccagttcggccgggggcttagggtgaaatctcaagctctctctctctctgtatgtggaaagatcgtctgccagcaagaaacacgagacaccggcgatctatacaggttcgggccgctgagaagcgtaataccctactcctgtgttttggtggatctgtgtatgaatgagctacaagtgtgagctgacttctcccccgttctaagctctcgatctggaaaagaatcaaccaaccccttctctctgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatgatcagtgtcagactggtcacaaatcggtcattcttgtccaccgcgtgtaatcttggcaacgtgcatgtttgcccttcttcacacaacatcttgcctgtaatggttaggatgaagcctggcatatatcgaccggggctaacgtgtcatctctaagagataacacgcttaactccggcttgagacgagtgcatagaggctttcgtcttgacgggatggggcaaggcgtgcgtcagaccgccagtcgccacctaacccgtgatctgaccggtctgtgactgatcacagaccggataaaggaacgcgctgtactgcgctgcatgcagcgtgacgcgcttgaccagactgcaataaatgctgttaggtgagcacagctgtgctcacttatcccatatatgtggcgcagatttccttaaggggtcggggtgcctcggccctcggggccggggcaagcgcaacccgaccccccccctcgggggaaatcaggaggagggcggacacctcatcctcgggcccgacgtccccgaaggtgccaggccacgtgggcgattgcgtctgcctcaagcctctggtcatgatactcccggtcccatatcaccgacagtagcccccggcgttgtgccagagcaatttcccttcccaagggaagcggtctggcgtaacgccacccctaaagcctggtgacaggtgggaccggtctccatagttgggcaaaatccccaacggtcccaatccatgcacattggtattggtaactttggttgtccataatgggcggtctattcaagactgccacatcacttgagcagcgcgcgctggattcttccatcggggaggccgaggccctccgcttggcgggcgagatggggcccgacatgctttgggactcggtctcccgcatggatcgcgccggtcggcaagcgggcctttggaaaggccagacgaggacgcgccctagcaatctggaaggcctcgctccgcacctcaacaggatggcctgggttctcgaacgactccccgaggagcttgagaagaccattaagtcatcctcgagggacctcgcccggggggcggtcgaactcgtgctggcgagttaccaggcccgggaccccaacttctctccatggatggcgctggaggagttccctcccgggaccgaggacaacgcgcgcgcgcgggtcgggaatgctgccgaccacatcgtcaacagcttcgagggctcggcccctcggctcgcgttcgcccccagctccgacgaggagggcgacgccagcggcgaggacgacggtggcgacgaggccagcgacccgggtgcatttgaatgagcccccaggcccccgccaatcttaacttttttttttttttctttcttctaaggccttcatgcctcttttgtgtatagatcaacttaatctgcaatcaaaaatgatgaaaaattttctatgttaactttattttgctatgcatgtgagttgaggatgatctgtgccgtggtccttttgcgccttagcttgaaataagggctcgtgcccaagtcccggtcctcgaatggctcgggtcggggctagtgcctggggagatccgcatgtcgagactggccaggccgggaacgtggtgaccgaggggtatgggtgacccgattgtgggtttttgccggttcccccccggagttcaccacgccccggggcacggctcggttctgggccccgtttggcgattttagctgaccgaaccgagcccccgagggcaaggttgagcacgagtgaccttatttcaagttaagattcttcagaaggaaaaacggcacagacacaacctttaggaaattgaaacttcttttattgaaatgctgaaataaaggaaaaaggaatataaggaatatatgtgcatgtgtggtagcccccggccaaccctgcacaccaaaggggggtgcggggttggccccgagccaaaacctgacacccgaccccccccccccccttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcagagggccgcgcgccgccttcgctcttctaagtagtcgaggtcatctctgcgaagctgatcttggtcagcctcgcagtacatggtggcccgaggagacctcagggtgagctcggatgggagaaccgcttctgcgccgtagacgaggaagaaaggcgtttccccggtcgctcggcttggagtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgatagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaacgcgctggacgcgttcactcccttcgcggtcctcaggtagagtcttatctgtgaggtatgtttggatctcagagatccaagcgatcaatctaagggagcttggagcactcccttcgggtcccgaggcctggactccgacgggcctcgggtgccggtctggcgcatccgtctcccctaaggggtcgggtcgcgctgacggctgggtaagcctttcttcaaaggcgcctggtggggtctgggctcgcgaggacgcgagccgtgagagttcgtcggctatcatgttatcccgtctgggcacatgccgaagctctattccatcgaaatggcgctccatacgccgcacttggcgtacataggcgtccatctgtgggtcagagcaccggtactccttacagacctggttaacgactagctgggagtcgcctaacaccaagaggcgcgggatccccagtccagctgccactctgagtccggcaaggagtccctcgtactctgccatattattagtcgctcgaaagtcgagacggaccaagtatttgagacgttctccagtcgggagggtcaacgtgacncctgctcnggcaccctgaagggacagaganccatcaaactgcatcaccagtggggtggtgtgagncagcttaagaggggttcgtgctggcctcggggattgagacggtctctggagccggggtccactctgccacaaaatcggcgagggcctggctcttgatagcgtggcgtggttcaaagtgcagatcgaactcagaaagctcaattgcccattttaccactcgtcctgtaccctctcgattatgcaagatttgcccgagggggtaagacgtaaccacagtgacccgatgcgcctggaaataatggcgcagtttcctcgaggccatcagaatagcataaagcatcttctgggcctgagggtatcgggtcttggcgtcccggagggcctcactaacaaagtaaacaggccgctgcacctttcggcggggccgatcttcttcgctaggggccgtatccccgaggtgctcttcgtccaagtggcctctcggggcacacttgtcttctgcgctgatgaccttggggtccgaagatgacaggtgcggccttcccacagtggcctcggggccgtcctgggagtcgggggctcctggcatcgttagatacgcgggcaaagggccagctccggtcgtcaggggcctcaggcctccgttcggctcgggggcctcttctccctgctctctcccgggtcgaatcagcacagggttagcctcggggtcaaagggtggtagatgcggccttcccgcagtggcctcggggccctcctgagggtcgggggcacccagcaccgtctgacaagcgggcagagggccgtctccggtcgtcaggggccttaggccaccgtttgactcgggggcctctcctccctgcttgctcccgggccaagttagcacagaatgggggtgcacgaaatgaggattgtcttcatcgcgctccacaaccaatgctgcactaactacttggggggtcgctgctaagtaaagtagcaggggctcatttggctctggggcgactataaccgggggagagttgagatatgccttcaactgggcaagggcattttcagcttcctccgtccaagtaaacggccccgagcgcttgaggagcttaaacaagggtagcgccttctctcccagccttgatatgaaacgacttagggcggccatgcagccggtgacgcattgcacatccctaagtt

SEQ ID NO: 15828 - DNA, 307 bp, Oryza sativa
aatagatgggtttatctgtgctgagatacctgactatgacaccgaccggctaggatatgaattggttagcgagtttatgatgcatggtccttgcagtgatgcgaacaagaagtgtccttgtatgaaaaacgataaatgttcaaaacattatcctaaagatttccaagatgaaaccattgttgatgaatctgggtttacaatctatagacgaagaaatgatggacgatctatcatgaagaatgggatccttttagacaatagatcagttgtaccctacaacatggctttactgaaaaaatatgaggca

SEQ ID NO: 15829 - DNA, 11080 bp, Oryza sativa
  unsure (1)..(11080): unsure at all n locations
ccatcccttggtatccttgtgcacttgcatacttgctgtgtggcttgttgagtatgtcatatgctcattcttgcaatatttaatcatcagaagaggagtatttcagcgaaggtgatgatctgaaggattgagcttgttctggttaagatgcctgtggagtggagtcgccatagctgttccgtagtttgttatagttttatttttttttccgctgcgtagaaggttattctttgagaggaactatctacctctgtaataatttgtttgcgaatattaaatagttatttatttgtactctattatgtaacatacccgaaattttaggacttaaaatttcttgtcaaaatagttagaggttaacttctccaattttgagagccaaaatttccgttttaatttaggtgatgaccaacttaaaccattgcatgattaaaatttgagaacaaaataaaatcttttcattcccaacattagactagaaatgtcaccaagcatacatgtacataatgcatgcctaggctcgagttctttgtgcatttggagttttggtcttgcattccataatagatcccatgagcataatctaaaagaattacttcactaaacaaacctatagttaatcttgagtgataacatgtggacttaatattaaactcaaatatcatcttctcagtctaaaacaagtttaatgtaatccctataataatattagatgcaattatgaagtgggaacacatatacaaacaaaggtcaacttaattctctaaaatattttgtgcaagataaaatcatggaaaaatttatgtggacaatgattagcacaaacttatcctctgtaatttggtaacatgttaacactcaagttgatatctcaaattaatcggttgaagcagacaactaaaagaaatcaaattaaatttaattggctaaaaccatatttcatccaaaagtacattgaactgcacataagtgaacatgggaaatgatttattcaaacactagattagttatcatgaataaatgtaatttttctagaattttcctcctctgtttaagcctcctaaaaattcaatctagctttctaatagcccatctttgtttaatttctgtgagcagtctacccattatttttgagtgcaaccaaagaaaatggaatctaggtgtaatcatttacctccagtaaattcaacactagataatttggtccacacattaagttatgaagctacaaagttagaggagaaaataattccgaaaattaatctaaaaatcaagtttaccagtcttctacccatatctctctccctggcctagtttccatcgagttggccccacttgtcagtgccttaggctaggttcagccctgtccaacacttcctccttctacacctctctcttgcctagtgggaccccattgtcagcctcacatccctctccacacgggcccacgactcagacccgcgcgccacgcgtgtgagcacgcgttgagcgcggaagaggccgaggccttcccctcccctcgccccaattctttcccgcccggggccgaacccggttaccttaaatccccgacccgggcccgacccaacttctcnanactctctctcagcccttgtctcgtttcgcggaagaaccgaggtaccccgcctcggattcgccgggaacgggggtgccaactccggcgccggtgagagaagtcctcgacgccgtcgcaatccggtgagctccatttccgttcaataagcattctgtaattccctctcaatgccgtctctaacgccaccaagaacgcctcttttagtgcagccaatctccgggaacgcgaccgcgtcaactcggaacaccgtcgcgctctggccgccgacgccattcctttctttctccttctctggtgagcttcggcgcaatctttttcgcctagagctaccttgtgctgatctaaaccgaagcatgcaccctctatatgcagtagaagcccgggagtacaccgtcgacgacgaccgtagcagttgcgccgtcgccgaaccagtacaccgtcgctaagacttcgccgagccgcgtttgattcttggtgagcctcctagtagtccctagagtccttatcatacgcatgcacgattaaatcgagcctcaaaacccacgtgcatgtgcaagccgagcttagccaccgcctctaacaccctaacagccgctatagagcaccaaatcttgccagaaagccaccaataggttcgcacggttgttctctacactttttgttttgggagcttaagctgaatcgccgttgttcgccactggtgatgctgtgaagctcgcggctgtgctgctgctctgctctgtccagagcaagggcatggcttttgaaatttaaagactcccagggatgtattaacaactggaacagtcacttacaagtaggaccagtaataatctgtaaataaactaaaactcaagcatcgttttgcatacaaacctaaaactaggggactgcgggatctatttcccgagaaaccaggggtttttgcgaaaaatgttagtaactgacatatgggcctaggactgcgggttgattcctagaaacctcaagggcctttgtgcatattggtccctcacagccatgtggacccatcctttaaaatctgaagaaaaattaggaaaatgcccaaacaattatatgtttagcagaaaaatgcacaaagttgtaaaatctatataaaatcaaatatagctcattttgaagtgattccagttgctgtagattcttgaagttatgaaatttattccaggaatataaaacttgacacttactgtacaaataatgtctctaagatttatctaagataagtcatacataaaacatgtacaaacttataaaatgcatagaaaattcatttcaactcattttgaaacaaaatcaaattctacagattcatcatcatacagtctctgattaggtgaaataaaagtaattacttactttgcatcaaatgcctctaaaactataatctctataatgattaattttagataagctaaactttagaaattgatgtagaacccaatttagcttcaatttgagtaaacttaagttctgtaggatcattaaaacatgtatttccaagttatgaaataatattatatacttactgtgtagtaaaagtctctaaatattcatataaggatttactaacatagagcagccattaatttgtaaaaacttgtagaaaattcatttttagtccaaatgaaatgaacaaagtttctatagaaccagcaaatagttatcttcaacatagtaaaataaaatttggcaccttctgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatcctcatccactaaaattagaagaacttagctcatataacaatttctaggttaatataatatattgctagtttagattagagcatctctagtttataaaatatgaaccatactagtaaagatcataaacatgtgaactaaaaatgttttagttaaccaaattattccttttattcaacttaaacaggaagtagcatgttctgaacctatcactcaaaagtcatgaacatataaaacactatatgcctaaaacatgttgtaacttgtaaaatctataagaaaatcattataactccaaaaattgtgaaaccaaatgtgttagtcttagaaaacacaacttcacactcctatgaagtctaatctagtaaaaatcactttacaaaagtatttcataacactacctaagactatactactataaaccgataaaacttctaaaattcataactcccaaatggaataaaataaaataggaattatttcacctaaattcattttagatcagtaccaacccactgtgcataaatcatgcattttagagcattttggattttcagctctttcggtgtttaattgcatatcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaacttagactatatcggtatttgaaattgggttaaggtagttatgacttatttgctgcatattccaccttgaataattgatcctcttgctgtttgaacccctagaaatggttagagtacactctttgtgctcaaatgggtttatatatgctctatgtgcaactacttgctcagccatgcttagaaatatgcaaatgctcattccatctataattaaaatgtgaatttttatacatgaacccttgctggaataaaatgaatatgatgggtatttacgaactaaaatgtgtaaaatgtgattttatacttgggcggcaagtggtgtgcatatggtattagttgcataccgataggggaagtgtttgcccaagtccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtggtgggttcccgtcgtgtccgccaccacggcgttaagtttaaggcgtgggcccgccacttaacggttctaggtatattccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaatcgattagccgtgctcacggtcatgagagctttggtgatgtgtcatgagtatagactatgttttaaaaatgtgatcttgtgacattggtttgaaattgataaatgtgttgagttgtgtatgtggtgatacattatgacttattgttaagtatggcaataagagattgtttatgatggaattatgaagaagttaataatgaaacttaaaacttgtctttgttaattgaagcatcaactcttttacaaaagaattgcgaaacaaaacttgctttatgctgaaaatgaactacatattgccttcctttgaatatatgccttacatgtagtatggtaggattgacttgtgcttgccagtacattaacttgtttaatgtactgactcttgctgttgatataaccctttgtttgcaggtttagtcttagtctttgagtgatgcgggttccgattgcttcttctaggatgagaacttaatggggtaaacccctagtcggtgtgcttgtgattgggtagtcaagcttccgctgttctctattaagtctatttggccggtcggcctatgtaattattaagttgttgtaagtcttaagttctttcatcttagttgtgtttgctatgtataatcatgcttaagatgaaagtgtggatctagtgcacatcctgggaactagattcacatgagtatgagttaggaatatttgagaggttgtagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacatattatcaatttgttattgtgtgcctcggttgattcctggacgagggtttaacacacatgtaagcgcttggaattttggatagaaattccgggcgtgacagtaggcaagaggagttaactgctccttgggccaaccattatgcacgcatgcacatagtcaccagctatcaacctatcacctggccctactgacgcatatgtaaaagacgcgcatgggtctatatactttcatgagagagctgatgggggtgagatggtaacggttcgggcacattaagtttgtcccgtgaccgtcgcaccaccacatgatgccgttaggtagtttttgtgatggataatagatatagatgggctaaatcggtttttttttccgtagaaaagaaatatactccatatttgggccggttgaaatttgggaatgcaaagtaacggatgaagactccaacatttcaaacggacatacttgatcatttttatataaaactacttacgtattttatattgggatcatgagatttttttaaggactgttttctcaaggaagagtggttttctatgatgtttttttatgagagggagcggtttttgacgaaaaaaggaaaatgattgtcttttaaagtagttaagaaatacactggcttctttaaaaatatatagttcaagataaatataattatttaacccttttttagagaaacatcaataacctgctggaaacaccaacccgatcaatgcacatcaacgaccaaagatacatacctagaatttggtagaggataccggcgtactggtcgattccaaaggagcagccattgacagacaatgatctcctccctgcactaggcatgtcaatcatttatagccttgctggttgtgatcaaaataactgcgtggaaatagacagagtaactgacctgatccccaaaatcattggattcacaagcttcaaaagtgcaatggtaaattccgaagcacaacagaaggttctgttaatgtcatcgttgaaggtgctgcagaggctcacaagcattgaaggggaaattggcataacactgaggtacaagatatcaaaacattccttcttattgagaaaccttgcagagatcttgggagatagcagcagcaatcaaagaactaaggaggatccttttacaatgggtcctcctgttggattacggtcgtctacggtccccagtccgatgcggacaaggtgctattccttcaggagctgtgcgatatcagaagtatgcgtaatgggccatgggtagttgttggcgattttaatctaatctaccaagatagggacaaaaacaacgccaacctcaaccatcggatgatgagtcgtttccgtcggactatcaacgatctagctctccacaagctccacctgaatggacgtgcttttacctggtcgaatgggtgggagaacccaaccctggagtgacttgaagccgactgggaaaaactcttccctcaatgcttcctcaaggctctgccttccttgatctcggatcattgccctctactcctttcaaccttgccggcccatccgtcgaaggggagatttcacttcgaaaatttttggtgcaaattgaatggattctctgatgtggtgcagcaatcttggtcggaatcgtgtaccatcatcgatcccatttccaggcttgactccaagctcaagtcggttggttgtgccctaaaaagctggagtgatcggaaggtggggaatgttaagctacagctagaaatgattagagaactcattgggaaacttgatcgagcggaggaagtgcgcggtctctcggcacaagaaagattcctgcaccgaggactaaagaagaggtatttggcgtactcttccttagaacggacaatggctaggcacagatcgtgcatcacttggttgcaagaaggagatgcgaacacgaagttctttcatcagcaagcagcttggcgtcgtcggtgaaactttgttcagcaattggaattcgactcagaggtcgcaactgccccggaagagaaggcgtaacttgcacagtccttcttctccgaagttcttagctcagtcagtccgcgtgagttctcgctcgaattgagcttccttgagcagccggggcagccgttatccgatttggaggaccctttcactgacgaaaaggtgtggcaagcggtcaaggaaattccttgcgacaaagcgccgggaccagacgggttcaccgggcagttctaccattgctgctgggacatcatcaaagtggatgttctagctgctctccaacagctccatcgtatggatggttcgagtttggagaaggtgaacaaggcattcattatgctactgccaaagcgcccagatgccaggaacttgcgggattttcgcccaattagcttggttcacagcttcgttaagcttttcacgaagatcctctcacgccacctagctcccaagctagattctcaggttgccaataatcaaagtgcgttcatcaagaagagatgtattcaggacaacttcatgctagtgcggcagtcggcgaagcggttgcatgagcggaagcaatcctccttgcttttgaagctcgacattgcgcaggcattcgattccacctcctggcaattcattttagaggttctggagcacaaagggttcggtagccgttggtgtgcttggattgccatgcttttcctaatagcaagtacgcgggtcctgatcaatggcataccggggaaccctatcttgcaccggcgaggggtgtgccaaggggatccaatctctcccatgctgttcatcctcgctatggactcattaagctctcttttctctaaagcagagaatgaagggctgttacagccgctgcacctgccctaccgaacttccctctacgcggacgacacggtcgttttcattcggtcggatcctgaggaaatcagcacagcaaaggaaattctacacatctttggggaagccacagggcttgggatgaatttcgctaagtgtgcagctctcccaattcagtgcaacgacaacaacattgcactgatccaggacgaactaccatgtcaggtcgcaacattcccttgcacttatttagggctgcccgtttccatcttccgtcttcgcaaagaagacctgtagccgtttgtggacaagatagcccgtcggttgccggtatggaaggcagagcagatggcgctcattggtcgggtcactatggtaaatgcggtattgagctctataccgatctatttgctgatggccatcaatgtgccaaagtgggtgataaagggaatcgataaggtccgtcgcggcttcctctaggccgggaaagcaagtgctagcggtggaagttgccgggtcgcttgggcacgtgtttgcgcacccaaatcgtatggtggattgggtgtccctgatcttgagcgcatgggacttgcgctctggtgccgctgggcttggcaactgaggacatcgccagaaaagccatggcatggactcaatgttccgatctcgcaaaaggagaggaacctactccaagtctctttgacatgtcgagtcggcaatggaatgaacgtgctcttctgggaagacaactagatccaggggtcgtcgatccgcacccttgcgccggctgtgcatgccgcggttgcagcaagaacccggaatcgcaggacggttcgcaaagcactccaaggtagaacatggatccgggatatatctggggctttcgaaatccaagcaatcctagagtacctcagcttgtggacatctttgcaatccttggatgccctcacggaagagccagattcaatcatctggagatgggagtcatcaggagaatactcagctcactcagcttatcagtccatgtttgtggggagggtccaattccaggacaagcctatctgggggtcgttagcaccgccccgatgctgctatttcctgtggttagtggcactaaacagatgttggacggccgatcgtttgcggagacagggtttaccacatcctgatcggtgcgtcctatgcgatcaagatgacgagacgattgatcatctcctagtcgcatgcccggagtcacgtcaactgtgctggttcgcactccgagcaattggtttgtcggacatactgccattcaatgaaccctccttcctctcatggctttgtgacaagagaatgaaggttgccaaagctcagcgacgaggattcgacaccgttgcagccttgatagcttggactatctggaaggagtggaacaacagggtcttcaaccaacagcaaaagacctgggtcgaagtggcaaagtgatggcggctgaggccgtgctttggcgcttagcgaacgcggcaatgctggagttacctctactgaccacggagtggcggtcgcaaaattttgtacgagattaggccttacattttgttgtccatccggtaccctatccccttctttattttcattttcaaatctctgtaaataaactttatttctcttaatacaaagatgcgcttcttgcgtattcccaaaaagaactaaggaggctcgtggcagaaatcctcagaaaccttgcaattgacagagacacaaggcaggagattggacaaatgaaaatgctcattaccaggctgatgaaggcattcctcgattctcatggatcattttagttcagatgttgattgcttgctgccaaaggtcgacgggcaagcactggtaatgctgtcatcagaaaacccgcataactgcttcattatgattctaatccatgatgataaatacatatatgtggcagcgagtctgttgcataatatgtgcctgcacgttcaacatgagctgacagaatcagacctaaaggaactatctcacaccttgcgagaggtaagccctgctaatacatactacaagtgcaatatagaggtgtatagtatgccgtatcatttgtgcatttactgtctattattttttgtcatttttggtaaaaagaaggcacatttatttaccaatgaattatataactatagtttgtacaactatatttatcatgctacatga

SEQ ID NO: 15830 - DNA, 10351 bp, Oryza sativa
tgcatatacatgatggagtgcaattctcactatgccaattgtttcaagagaaaatcccttatatacccctgaaaattttcctaatcccttctatacccctgaattttgcttacttccttgtataccccaaaatttgattttgatcccttgcatacccctcccgtcagttgactgttagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaaatatttttagataatgaaataaaaaaatacgtatttattttttttaaaaaaggtcataaaaatgaggagcattcatataaagataggtataccaatgttcacaacattttttttatgaatgctcctgataaaaaatccattgtcctattaaaatttcaaataaaaattttaatttttacatttattttattttcaaaatttatgtcaaaattttctgcactaattatttagtctcattagttttataaaatgcacatgatgtgcactcaaacaaaattttcaattatttttgaagcttatatttaaatctaaaacatcaagggcaaaaaggacatttgcaaccaaacgaacagtgaaatgatggaaaatgtaacggtaggggcatggaagggatcaaattgaaatttcaggggtatagaagggatcgggtaaattttaggggtatgaaagagattgagtgagttttcaggggtacacagggaatttactcttgtttcaatgaattccgaatgatggatgcagtgtcgatgatcgaagagacaccctcaagggctgagaagtacaagtttttcttcggtgacgcaggtttcatggaatgtaacacacctctctctgacctagtggggagggcaaaagaactgttgagtcgccagtggtcgcatggcatcaacagtgccacctgaaaaaaactgaaagatgatttcgtatttacagtcaaacgaccatgcatactttttagtatatggtaaataagtgattgtgcatatgacctttctagaaagaacatagatttgcctttgagatgaacaaaggctattgtatatgtacctaggttcaccagtcgatgcttgtggatttcaatggactgccgctgcttcgcttccgccatttcatttactttatttgacattttgtaatatgcatgaccatgcttggtctatttggggtcccaattgggtaacccttgtattttttttttagttcaaccggcgcgctttattacatactaggatcagtgaaatcacgatccacaatagtttgaacaatgtcagggacagggtcagtccacacacttgcttgacccggttcccagcacacacccatttgagatagcttatgcgcagccacattacatgatcacggagcataattaaacacaacactagagaaatttaaatggacgaggtccttgatctcccttacgatagaactgcatggagacagagcataatcatgagagtggaaggctctctctaggatggatgaatcagtttccacctggacggagttaataccatgcgaaaaggcagcttgcaggccagctaaacaagcttcagcttcagctgcaacagcatcgtgcacatgttccaggcatcctgcacccgcaagaacagcacatccaagatgatcacgaaccaggaatccataaccaccggacttgtttgcagctcagaaggctccatcaaagttgagcttcaatcttccatctacagggggaacccatttattccgttgcacattcacatggggacgtttatctttacgcattgaggcataatcatagaccagcaatttcaccttatggaccacttctttcactctgattaactcctcacccgacttcaccttattgcgtgcataccaccaaacccacaaaagaaagaagacctccattcttcgatcatcctccagcttcaaaatggtctgtaccacatctctagcagaaacaagctgaatcaagcttaaacggatatcttcaaggcataaaattctccaacagagtttcatgggcttgcatttcaggaaacagtgtccaccattctcatcaaaccgtttgcagactgggcatagagttttagcgtctggtactctccttttaatgttgattttcagggggaggctgttatgggcaagccgccagataaacagtttgactttaggaatgcattgcaaactccagattttatcccactcgaaattccgctggtgcaccgctccagaagaggaatcgcccacttgcttcttcgccgatctctccctttgatcttccaggacatgatacgcagatttaaccgagtacattcctctcgtatcaaaatgccaggcaacaaaatcatctgtgtctgatctcaccggaatcgccagaatgttcctggcatcagactcccaaaaaatctcctccactagtggtttatcccagcaacccgtaactgggtcaataagatcagctaccttgttcagcacagtgcctcttcgtggagttatcagtcttcgggtaactccggcagggatccaaggatcctcccatatatctatgccgctcacattgccaaccctccaaatcatcctagccttcagggcagaaagccctcggataatacttcgtcaagagtatgagataccaggaccttccttgacattcaacaaattaccgtcaggataatacttagccgttagaactctcgcgcacaaagagtctggctgatccaagagtctccagcattggcggcctaacatagcaaggttaaacaaatgcaaatccctgtaacctagcccacctttctccttccggctgcaaagtaactcccaagaaagccagtggattttatattcctgttcttgctgagcccaaaaatacctgcagatcatcttgctgatctcatcacaaagagtgcgggtcagatcaaaacaagacatagcaaaggttgggatagcttgagctacagccttaattagaatatcctttccagccttagacaacagtttttctttagtcacagaaaatgatgtcagcttgtgatattcgactgtgccaactgtgtaccacctattgatccagggagtggtactgtattatacatggggtttccggtatataaaaccgggggccgacaaaagttccgattataaacaagttttagatacatgaaaactataaatacgactagtttatttgaaaaaaaaaatcaaaatatgaaataaatctaacatttttggaaggagtacatgatatagaaataaatggcccactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaagccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctaactttctgtttaataaataagaggttaattagcacgttttgaatagcaatgtagatattgaaatgagcttattcgccattagcaacaaccttagggtcgaaatctttcacctctcttagaagtgttgacatgttgtggcacacgtggaaaccacattggtctccgatctgttgtgcgcatgcaaacttggtgtcatgataaaattcattcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccaccttagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgcctcgttcacgcttctggcccttgacaagtggtggggagctatcggcctttcttgtggtctttattggagccaaactttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaatcacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatacttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgcttgattccctaaactgttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgtcgtccaagctcgctctttctcggcttctgtgaccttgccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggtatataaatgaacaagtgtaggggcaaaaaaatgaacaagtgtagataatctgttcttattgagcaattcatcactggccatttaataaggaacacattgggcagcagcagcaagggtatataaatcatcaaagaatgacagaaaacaagtgtatatagtctcctcttatcaatccagaaaaaagagcaagtgcagaaaatctgttcttatgcataaaaaaagaacaagtgtagataatttgttcttattgagcaattcatcactggccatttaacaaggaacacattgggcagcagcaacaggggcaaagatactccacaggggcagcaacaataggggtgtattaacataaaacatcactggccatttatctagttaaaatcatgcaaaattcaaccaatgcagcaaaattaatcctaaaatcatctaatacaaaaagactaattcatctaatactgcatatatttcatccacaaatagtccaaattcatcacctcatatagcccatatctcaaatatgcatatatttcatcaaaaaaaatgagacagtactactaacttcatgtaaacagcaattcatccattcaattcaatcaagtgtagataataaaacagcccacaatcatttatgtggcagcagcagcaagggtatataaatcatgtatataaacaacaattcatgcaattcacctattcatagacaaaaagggtatataaatccacaagtttagataatctgcaaagttccttaatcatcaaagaatgacagaaaacaaaatgcatggagaattttggtgtctaggtcggttccgtccatggactacactgaccaatccaccaaaattccccatgcattttgtattctgtgatggtttgataacctcggaacaacattaaatctgcggccaatcaatcaattcttccatttgaactaaatttcaaaccctaaacctaataaagttccttaattatcaaagaatgacagaaaccaaaatgcatgaaaaattttggtgactaggtcggttccgtccatggactacactaaccaatccaccaaaactccccatgcattttgtattttccatttgaactaaatttcaaaccctgtatatgctttatttataggaaaagggaacataacccctaactagctagctagataaactatttctagctagctaccctaccaagctagaaacactgttgccaatctatcaatccatcctttttcagctaaatgtaaacattatccccaaaattcaatagttctagcaaaagggaacaaaacaacatataaagcagtacacactccatgaatggttacatgtcaaaatggcacttaaatccacattcaagttttaaataacagttgcaacaatctgaacggaatgacaaaattcatcgttcatccaaagttcatcattcatccaaagttcatcattcattcatccattcaattgcatcatttattcatccatccactgcaccattccattcatgggcatcagagagagaggggtacctggagaggagacgacgagcagaggaggcggcacacggcgacgacgagtcccggcaggcgcacggtgcacggcttctcagcacggcggcgcggcggcggcttcttggcacggcggcgctgaggaggagaagagggggttaatcggcgaccaatagtaaacgaggggaggcggggggagtgggctcaccgtggaggtcccggtcgagaggaggaggcggcggagaggagatcccggtggcggcgacgacggtcctggcgtggcgactgagaggaggtcccggcggccgtcgagagagtgagtgaggcggcagcggtggagaggtcgaggcggcggtggggagggcggcgtagagggcggagatggcggtagagagggcggcggagatggcggcggagaggtcgatggagatggacggcggcggtc

SEQ ID NO: 15831 - DNA, 1866 bp, Oryza sativa
  unsure (1)..(1866): unsure at all n locations
tcaaccctagtcaaactcacctgtgacgggctccaactatgtggccgtcagaggtggcctcacctgtgacgggcgccaaccgtggagccgtcacaggtaagaccacctgtgacgggcccaacactctgggccgtcacaggtgaggtcacctgtgncggccctacagatagagcccgtcacaggtgagtttgcctagagcaattttattttattttatttcacttagttcttttattttccttaacatattttcacatacactacatatttttttatacttaattattttatttcactaacagtagtaattgcacttcattattatactactttaattatattatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagcagcctcgatgcgtaaaccactgttctgcactgtgcatttgctgtcttgcttgaccgtgtgaaaggtgtatccatttatgtcatatccttgccaggtggtgccactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccagatacctttcgcaaagatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaat

SEQ ID NO: 15832 - DNA, 26508 bp, Oryza sativa
  unsure (1)..(26508): unsure at all n locations
tgcatcaccaaagaacgatttgccactcaatgtaggcccacatgtcactgagacaatagcgaaagatcctaaaccagtgtgcacctcattggagcagcaaatcctaaagtttcaatttgttgacgatcatcaacattcagtaccatacaatatctgtacctgctcatctacattactccctctgtcacataaaaaaccaacatagtactggatgtgacacatcctagtactatgaatccatacatttgtccagattcgttgtactataatatatcacatctagtcctagattcactttttttgggacggagggagtacataaacaaaatcgaaggaaacgtaattcctacaccagaccattctctttgtaaattagagaacttacagtgatgcattgccatcgtcatcaggctcgccactatcatgggctgcagatgaaatacctgtcacatcaattagatcactttcataagcaagctaggtagcatatcagatgcactgttagaaaatatttcataattaatcacactgaatcagaatcccaaggcatatatcatgaaaagtctgctctaaacaaagagtacattgctcctgacattccatatcgtaatcaccatagcactaaaccagcattacaaatattaaatgatattctgaagatacatagaacataatactagccaaagaaatatcaacacaggaattccaagtgaacgtacgaaaataaattgcaacactagctgttgtatgatcagttctctcaataatcaagtcttcgttaactttcttttaattcatcgcttttgcattttgcatagaacagggtattttccagaagaagtataagagataaacaaagagggcatagttttttattccacggttaaacatatgcaaaacaaagtgcaaatgcaatcggagagaatactggtaagtagcatgttcagtgatactatttcaatgaggttcccacctgagtcagctgatgaggatgcatcatctgaagaagtttcaatggcagccttttcacttccgatgcccaattcatcatcagagccatcactgctggcatcattgaaaattgtaccagttcctttgtcttttttggatttgccactggtttgctcatacctttttcttggaactttccgagctgctagtaggataaatgggcgccaaaatatgtatttgcgacccaaatcaccctgtactcggctgattataattgggaactgcagcctgctaatagtcactaggagcacaaccacaaggagcaaaccgtacaatatccacatggccagctatgagctcctgtgctctctgtaaacacagaaagcaagtaataaagagtgcaaccactaggctccacagcgatatctgacggcgtagccgactgttgatgcgtaggcgcattcctagaacttcagcacatagaaactggccagcagcaaacaatactaccataatttcaatcactatacgtggccggcgtacttcccaaacaaccgtagacaccatagaaattgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcatatgtgctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatagggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaagggataaataatccaaccaaccgagtggcttcgataattatagttaactaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagcttgtatgttgtgaataaagaaatttccaaagtattgggcataccccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacatgacaggccacacctgaaaatatgggctgcagacatattaggccttggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcggttgataacccttacggggaataataaatagtccagtctttgagcatagaaaatagacccatgatcataaattcatgttgcatgtatccggaacaagtccaaattggagacataatacttgtgtttgaactagtaagcccctgagcatatagcttgtccttatgtcgtagtcacaattgtctattgatggtagctgacgcagttggcatagagacaagataaccaatatagagagaatattgcccaccagaggtggcaaaaatattggtggtagtgaagatagtgataccaatcaaaagtactgaagtcgcatagccatggaggcgaagaaaccagtncgcggcagtcaggtcagccagcaatgaatatgaaggcgctcagcgataaaagtgtgtagttgacaacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtccaaaccgaaatatttgaagttgttgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaaccggtagtgaagacgcgcagttgtgaagataaaagcactagtcggcggcggcataacacgagttggcggcggaagacgatgatgtccatcagtagtggtagctgtataaaccaaatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtattgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcctaacaacggcagcataataggccagccgtgcaggcggaaacaccagtcggcggcggtcgaggcagccggtcggtgaagacgtagacgcccaacaacggcggcataataagtcagccgtgcaggcggaaacaccagtcggcggcggtcgaggcagccggtcggtgaagacgtagacgcccaacaacggcggcataataagtcagccgtgcaggcggaaacaccagtcggcggcggtcgaggcagccggtcggtgaagacgtagacgcccaacaacggcggcataataagtcagccgtgcaggcggaaacaccagtcggcggcggtcgaggcagccggtcggtgaagacgtagacgaccaacaacggcggcataataagtcagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggtggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagcagtttataaatacgtatttcttctcttgttaattttgatttccccaagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcctaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactactcaatggaagaccaattggtgtagtgaggcagaggaaaaggcaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgcgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtataggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcagacggaaacaccagtcggcaagagtagtgccgcggcgttacatgcaaacagcagaaaataccaagagagattaatctgacatttagagatcaatctaataaacaacaataagttgaaaaggaaaaaacctggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcatatgtgtcacgtcctgataaattcatcccgaaataaaaatcattttctaaaaggaataatagaattaattaaaattcgaaaagaaattggcaaaccctaaaatacgtgcaagaaaaattcaaatgtggcccggagaatttttgttaaattctccttggtctaaaaggagccctcaaattttacttgaattttcagaacaccggaaataattattaaacaacaacaacaattatcaaagtttaataaaaagaaaatctaaaaataatcctcctccctttgggccaagtctggcccaaagtcctccctctctcccctcggcccgcggccgaagttttcctttcctccctctctttctctccctctccttctctccctcctcctcttgggcctcctcccctcccggcccactccctcctccctctctctcccgggctgcctttcccccccctctcccctcccggcctgctcggaccaagccgcctacccctcctctcccacctgggccgagtcccggcccagccgagcccccccccctgcccgagccgccgcctgaccgcgtggggcccacgcgtcaggcgagtcatcgtcctcctcccgcccagccgtcctctctccctctcccgtgaaccctagcgccattcctccctcaaatccgcgcgattcaagcatgggattcccaaattgattgaggggaattaatcccctttccctcctctctctttcccccttaatttccccttgaatggtgcccccaatcgccgggaacggccgcgccaagtccggccgccttcctttgccgccggccaccattcccgtcgccgttccgccctctcccgtgctcggctcgcttccctccgctataaaatgcaaccccctcgctccgttctatcgctttagccccctcccgcggtctcccgtggtctctagccacctccccaccgtcgccctctctctcccacgttgccggccggcctccagccgcctgtgccgcctcgcccgcgcaccggccggccgcgccgtcgcctcttccagcgtcgccgccacctcctccaccccggcctgccctccgtctcgcgaggtgacccccggagctacgtttccgccgtcgcccttccatttcctccgcgccggccgcctccagccgcctctatctccctgcctgagcgccggtcgacgtcgccaccaccttcctcggctccacgacgccgctctcatccccggcatcacctcctcctcgcccgaacttcgccggaacaccgtcgcccgcgccggcttctccttcctcctcggcggcatctcccccggctgcccttttcgccatgcccatgcgtcagccggcgctgccgtcccctccctcggcacggtgacgtagccctccacctcgtccacccctcggtttcgcccggaagccgccgcacatcgccgcgaacctctccagccgcctcgccggagttgttcggccgcccgtccctcctcgcccgtgcaccggtcggccacacctccaccacctccggcatcgcagcggcaaggccgtcctcggcatcgtttcccctccatccaaacccctccgcggtccatcatcgtcgtctccgatcgttctcgtcgtcgacgtcccgtcggtcgcccggctcgtcgcctcgcggcgccgcctccgtcatcgtcatcgtagcggcgtgttccacgtcatcctcgtccccgtgcagccgctgccggctgtcctcgtcgcctcctcgccggtcccggtcgtcgtcgtcgtcgttgtcctctcgtcgttcccggtcgtcgtggcgttcgtccctccgtcaagccgttctcgttcgtcgtcctcgcttcgtcaagatcgctgcagccccgtcctcgtgttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttggtgttcccacgcctcgccgcgtggtggtaaggatccgtcctctcgcttccccgccctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgcctctgtgtactcggtctaccgcggtcctttaggttgatatgtggggtccgcatgtcaacggcgcagccttcctgtcttttccaggctagcgcttgcacctgttttataattgcaaagcttaattataataatccgcaaatctccatataacagcattaaacttcggatgatcatatcctggtcatacgagctccgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggtttccaaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattattgttattgatattaataccttgttcaccctagattaaacaaaaccccatctagtggacactctattcgtggttccactagtatgaatttaggtagatgcttcgctgattaattaggcaacattaggtggttttataactatagactttgggaaattctcatatcatttggacactatggaattgttggtttatggtggaattggatatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcattggcagagggttggtgccctgctgctaggggctcagtcttgcctgcctgtcccgggggttccggccgtaggcaggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatatggaatggtcggcctggtttggcttgggacgagctgggacccagggtcgggttgccagttcggtctgaatcatcgtaggccttgggttaaggcaggttcgtgagggttcacggccttgattaataatactgtgtagctctaggatcgtctttataaaatggctttgggcaactaagtgacttttaaatgctgtttactgcaaaacttaacctctatgttattatccccttgtactcccttgcattaattgtgcatctccggtgtggcttgctgagtactgtggttgtactcattcttgctctatctttctccccccttcagtaagagaagctttggaaaagaagtcttaggtggagtcctggcttataccccagttgagcgcctgtgaagatggagccgtaggcccgctagtccgctgctgtttatttttgtttgtcaggcctgaagcgcctttgtaataatgtaaatattatcgatataatgaagatgtgtcttttatatcatgtttgtatggtgtaccccggcttttcctgggacggggattaatacattagcgttcgggaaaaggcaattttcccggtcgcgacaatatgtgctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatagggtacccataatctccacagaaatggagaagcacacgattaccatcagcccgttccagcccagtcgtctaaaggcacctctcgtccggaagaacagttgataatccagcctattgttgcgggtgaatatcctgaaagtagtcatattgtttaatcattaaacagaagggaattgagggggtgtttagatattgtaaagtttgggcgtgtcacatcagatattatatccgtcattagcaaatgtttactgtagcatcacattgtcaaatcatggagcaattaggcttaaaagagtcgtctcgcaaattagtcgcaatctgtgcaattagttatttttagcctatatttaatacttcatgcaggtgttcaaacattcgatgtggcagagtgtaaaattttgaggtgggatctaatgagggccttaaagacggaattttaaggtaccctcaaatgattatgagcctttaatcgcttcagattcaatggatttgattttattgtactacacccggtagtagtgtagtagaaattatataggggtaaaattagaaataatatatataacattacaataaattcgtgtatcatataccatattaaaatagatgaattggtaaatatattttactaaagcttcaaataaaatattttatatacttatgaaaatatatagttagatttaaaatttactacactactacacatggtagtagaaggtaccataccataaaaacaaaaaggcgcataggagccaattatttgattatcaaaagttagtttcacactacaagtttgaaacgcttgaaatcttagcgtgtgtttggttctgggactaggtgggatgggatgaaaccatccctgattttaggattgggatgattccattcgggtgtttggtttgtagaataggacgatcccagttttttgtttggttgaagggacgagggagggatgggatgagcgctgtttgcaaccaccgataacgccgtttacaacaaacatggccgacgccgcctctgccctcacctccggacgtggtcgtcgccggcctccttgatggcgtcgatgagcttgggctggtcggggcctgggtcacacgcaccgaggagatgacggtgtcggcatcacagacgagcgggcggaggagcgcgacgacgacagacgggatgacccaaccgagcgctggcggcgatggtgtcagccttcgcgcagagcagccgcggcttggcgatgacgacggcaacgaggtccgcgcgggagagggagagggagaggccggtggagaggagggcgagcacggccatcatcgcggtcgggcgggcggagaagcgcgacgacgcacggtcggcccgccgccgagttccccggctccagatccgtcgccgccgccttccccatcgccggatccgccgccgtcgccttccctatcgccggatccgccgccgccgccttccccaccaccggatccgctgccaccgagccccccgccgccgctgtcgccgagcccaccgccgtcgacgtcgcccgagcccaccgccgccgcggtcgcccgagccgtccgccaccgccgtggcccgagccgtctaccgccgccgccgccgccgtcgtcgagcccgccgccgccgccgtcgcctagcccgctgccgtctctcgaggacgagcgcgcgagcagggcggcgagcgtgcgatggtgttcgctcgttcacgccgttcactcgtcccaggtgggatgagttggtccgccagttttggccggatcagttggtcccggatctgagaggaatattcctctctagggaccaacccatcccactcaaccttgaaccaaacacccctaaaaatgggttcatcccatcccatcccatcctatcccagcaaccaaacactaccttattgaacagctttgcagccttatcttttcgcttacgctcatgcttatcagccgaaatttaaatatttaatcttaaatttaaagttgattttggggtttttcatcaaagtttattttttagtcttttagatcgttaagaacatgtatataaaaattttattcacaaattatttttcatttgtaaatatgttgtttgacttatttaccgaataagcgaaacgatgaggccgttgatatgattgctaggttggagtgcttctctatctagtgcaagcttgcaaagtcaggtggcatccaaacaggaaaaaaaacgctaattgcagaagattatcaatgtattatagaaatggaattccatctatccaaattcttgtcagccaaacattgcaagaccaggagactttgcatgtatacatacctcgtggcttctaggaaaaatatcgcagtcgcataacgaaaatcgctcttgagaacggacggatagccacccagcaggacgacggtggcccaggtgaaggccaccgtgccgaaggcgttgcccacgctttcgatcaccgcgagcaagcggacgaagtagttcagccacttctccggtgccgcggcgaccgccttatgatcagcttgtcccgactccgatacctgtatccggtgctcctggacagcgctgccgtcgcccgtcggcggccatcatactgattaacttaggtaattagcgatcctgcaggaaccacaagctatagcctcagcacatttgtagagcaacccaaacaaagccgatactcctatatatgtaccaaaagtgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtgttattgattgtatgatttggagaaaatcaacatccgccgctagaggcacccggaccccccttatatatgggaaggagtccgtgttacaaaagataatctatatccctaacggaataggcagatacagataaaatacagtcgtgaccgactagatctcaaggtatttcctttacgtacaagttaagaaacaaacccgagatacacacaagatattctatctatattcggtatcctatattcaacccaaatatcatcgccgtgtagatatgggatatccataatctccacagtagcccccgagacctttgcagtcaaccattatagccttctcaaagatagtaatccgagtgcttcaaattattcatgccaaggcctgccgagtagcgaagacgaagactgtaaagggcgaaacaataaagaatacggtgcatcgaatagatgcacctaattaggtgtagcccccaactatgtgattagttaacaaactaaacatatagttgagaacaaaataatagcacaatcatgcatcatatgacaaaagcatacgcggcgcctaaagaggcatcctagccgactgctttttagccataataaaaggaatccgagtggtttacactctaaaaggttcacgaatgaacacacttgacagtcatccgaataaaaactctaaagattacccaccaagtattataaaaattatggtaataaataagtctaatagcctaggctatgactatttaccataataaaaacaggcatataacataccagggaaatgactatggtaaaaacaagccactccaagttaacccagacagcttttgtagcctaaaaaagcttacaaaaagcagcatgacgcctttctgtcgggcaccttttaatttgcattgcaataattccaaagaattatatgaccgcataaaaaggattttatcagcattgggcaacactattgtgcgcataaattgccaaagcaaaaaatgcccaagtccctaaggaacacaatgggccacgctgttaagagtattgggctgaggtactgttcaggcctaggcccatttgcacctccgatacccttaacaagaaatcccgagatccaagcgacgcttcgtcttccccgccggaactctcgccattttccccactccctgctacagtaaagaactgcgccggcaaactagggttcaccattccactcaaatccaccttcaaaaagtgatcaaaatcctccccgtgatccaccgcctcaattcctcacctctcccaagccatccctcgaatcaaatcagcgcattcggggaaaatcgatggcggaagagaaagaaagctttgaaggccagtgggcgccgtccgacgtaacagaagagaacctgaaggagatggtggcgcacggcgttctccctgccaaggagatcatcgggtggcggccagcgtgcggtgagatttttccgacccccgatacacacgagattgtggtcttctctcatttcttctatggcggcttcgctcttccgacctcgaaatttttccgcgggatattaagtttctatggaatcagtttgcatcacctaaacccaaattccatagtccatatcgccaatttcgtccatgtttgtgaagccttcttgggaattaaaccccatttcgctctgttccgccgaatcttttttctcaagccccaaccgaacaagaataagccatgtgtagtcggaggggcaggatttcagttgaggggaactctgagccagaagtatttctctatgcccttcaagacctcaaacaaagggtggcatgcgaactggttttatgttcagaatcctgagcctgctcttcccgagtactcttgtcttcctccggtgtaccaagatacttggaactctcttcctatcggagataaagctgctcaagccttggaattgatggaccgcatgctaaaactcaaagaacaaggcttgcaaggagagcagattactcggcatttcatcaaatgccgactggcaccaattaaagaaagatcccgtacagcgttcgagttcgacggcaagcatgatcccaatcgtgaagaaccagactctctggactttaaaatcatgaaggagagaatgtataaaattttctcaaatgctattgtcgtcagctactcgcatcagctgccagttgtgccatataatgcattcaatccgcctccgcaggtatgcatctgaaatcttcaatctatgactaaaacattatcttgtcttcatgttgaattaattaaccgtggaagcatctcatttaggaatatgcgttgatgaaatctgatcccccaatcactcagcgccggtcgcctcgtcagcacaccgttcagggaggtggagggccaaaaatcagaccagatccgcaacctcaaacctccaatccaactggacagacaggttctcgcaagagaaaactggtgctcgacaacgatgaaggcgacgacgataaatctggggacaagggctcgcctaataaactcccaaagcgtaccatgcccaagaaaaaactggctggccgtcaaatgccaaagattagaacattttctaggtataaacctctcggtaccatttcccttcgacatgcttctctcatagaaattatactgaatatcgaaagaacactttgcaggaaaccatccgacatagatcccactgggaaagattctgatccgactgtgacagaaccaaatttatccaaggatcctgagccaactgccgaaagccagccgactgccgaaagccagccaaccggcgcccatgctttgggtgataaggccaatccgagtgaccggccgccaactggagaccagtcggcaacagctgaaactgcaacaacacaagagcccccgactggaaaccagtcgaatgtaggtcccgatgaagaaatccctgaagttgaagcgcagacgacaacttcccaaggaccagaggctggtaaagactcaatgattgggtctctaaataaagaacaaggatcaccctcatgttcagccaggaacatcctcaggtaacacatcttctcaagtgatgccgatttaaataacttcagcttactcgtctaatgtcttggaaatacatcaggaacactaggcgatgacgaagaagcaattcctcgcataaaggcggctgatgactcccgtcctcctatcttgctcaaatggtgggacgagaactcgcaagttgccggcatcgtcataaatcgtcaaaaagaagatgaggaagtgtgccagctgaagaaagcacttggagaagccactcgcattgtgaatgtaaatcttccgggtgactgcctttaataactttgttctctctttagcagaactgaaccatgatccatcatgcagagaatccatcttcgcaatgaggccaagactacaactttggaaaggctggttcctcatttgggaactcttgaagcagttagggaccagctgcatgaggccaaggagtacgccaaaaagacagagaaggagttaagggaccgaattgcccagctccaggattcaaacttcgagctaagtggttcatcaaaaggtaatcttctagatctgtcccattaatttatgctgtcatagctgtatcctcaaacatttggatttcaaacagcgcaagctaccaggatggctcaaatggagaaacagattgaagccctgaaaagagacaaagtagaactagctgcgcaaagggactcggccttgaaagaggttgaaggtactatcagctaacaatctggtctcctctcttttaaatgcagcagattcttatcataaatgtgttttgtagaccgtaaagtcaaatctcaagctcagtttgacgtcctggttggtaagattaagaggcttgaaggagcaagagatgaagtcgccaatgtcgctacaccacttgtccaagctatgttccttaataacaatggtccaagttgtcacgtcctgataaattcatcccaaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaaggttttataaaaagaaaaaccctaaaagaagtcttctttcccccccttcccttcttgggccggctcggcccaactctccctccctctctctcctctcccccgcggcccatcggcctcccccgcgcgcgcgccgctgacaggcgggcccgcccgccgccctcgctgacgggtggggcccacctgtcatcgccttcctcccgccgctcccgccgcccgcccgtgccctagcgccgccgccgccgcggattccgccgcatcccgccgtccccgcgcgcattaaagaggggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgctcgctctcgccgtcggattcgtgctcgcgccgtgctcctctctctccgccgtcgccgtcgaccttcggttcgccgccgacgtcgctccggacgtccttccgactcggcgtcatttccatcggcttcgccgcgttcccgtcgaccccgtccgcatctccgtttcgcccgccgaccgccggagcaccgtcgtcatcgtcatcccgaaccgcgccgccgccttcttccgcttcggccgccgttcccgtcgtcgccgtcgaccggggtgagccgaagaccgtccccctcgcttcccccttccctcctctctctcgggtgccgctccgccgcgccgttggtcgccggcggcgaccatcggggcgcgggtgcgccgctcccgtcggccgtgccggcgaggccgccttcggcgcgccctcgcggctgccaagtgggcccggccgtcagccgcccgcgcccgcgggtgcggctgacgcgtgggacccacagcgccggccgccgccagccgcgtgctcccggtccaccgtggaccgaggggctgacgcgtgggccccactcccgtggacccggtccgcgcgccctctccctcggctgacgcaataaacccgatttttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtgtggagtttattagagtaaaagccttttcttttccgttggtcgtgtagacgctgcagcttcggaagatccgctcttcgtggaagttgaagccggcgtttgggaaagcgagcaaggcaagtcacatcacccttgagcatattgaatcccagtttataaaattattttgatttaaattattgcattatcgctttgtttaaattcccgcgttaccactgttttatttagccatgcctatttacctttgttatgacattattattgctattgttattattaccttgttcaccctaggaaaataaaaaccccaactagtgggtactctattcatggttccactagtataaatttaggtagatgcttcgctgaataattaggcaacattaggtggttttataactttagactttgggaattctcatatcatttggacactatggaattgttggattatggtggaattggacatacacctctctttctctttcaaaacccccaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggcctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacctaacccctattattatccccttgtaccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacacaagtgcacttgacgcaaccgaaatttttgacaagctgagagttgcaccggatgtatacttcaagaatatcaagaaagctggaagtatgggagctagcatggcattggcgatgaccaaatccttgtacccgagaattgaaattgacaccattgatggctttgcagacgggacaagcgaagaggctgctcttgatcttatcagtaatgctcaaagtgcggctgacaagattgcaagtgatgttgtagatcaattccgcaacaacgaccttcagccgagcaacaataactctgatgatgaaagaactgattctgactgagtataaatgtagcaaatggaggctcaatttgtacaatactggtgtatttatgctgtgcttgatagttctagccaagtctttgatttcttaaaagcttttatcaagctttgttgagcctaaaacccaaagaagctattaaaaactttcagtcctcgcagactaagtagaaaaaaccaaacaaggcaatgataaaccgagcaagcaaattgaattgataaaaaatcacactccattattatgatgatagcccccgactgacaacggcaagaagaaaacttgatgttgacagtcaagatagggaagtacaatgataaacttaagcgtaaaaacgacgaagatgctcaatgttccaagagttgtcgacgagagtaccgtcttcgcgcttgagtcgataagaacctggtcgggtaacttcagagatgataaatggcccctcccataaaggagataacttgtgccgatcccgtgtagtttgaattttcctcaaaaccaggtcgccgactaaaaaggcacgggatcgaacattgcgattatgataacgccgcaacccttgtaagtatcgagccgaccgaatcaaagctgcttcacggacttcttccaatcggtgtaagtcatccactcggtcctcttcgtagcgttcttcacggaaatttcgaaagcgcaaagactcgaattcaacttcactcggcaacattgcctctgccccatagacaaggaaaaaaggtgactggcctgtggcccgactgggtgtagttcgcaaagaccaaagtactgatggcagctgttgcacccatttgccggcatagggttttagccggtcaaaaacacgtgctttaatcccttggagtatcatgccattggctcgctccacctgtccattgctcatggggtgtgccactgaagcatagcaaatcttaattccgaagtcttcacaaaagtctttaaaaactccaccagtgaattgtgtgccattatcagtgatgattcgattgggcactccaaatctatgcacaatgttgatgaagaaatctcgagcgttatcagctgtgattgtgacaaccggtttagcttcaatccacttggagaatttgtcaatggccacaaagagatgcgtgtaaccgccgactgcctttttaaacgggccaaccatgtcgagcccccaaaccgcaaacggccaagacagcgggatagtctgcaactcttgagctggtagatgaatttgtctggcgaaaaattggcaaccttcgcatgtgcgcacaattttgtcggcgtcggacactgcagtaggccagaaaaaaccctgccggtaagctttgccaacaatggtgcgtgcagcagcatggtttccgcatatcccagaatgtatgtctttcagcaattgtctcccttcctctaaagatacgcagcgttgcagaattcccgaagggcttttcttgtataactcagcttcatgcataacataaagtttgctccgccttgaaatccgctcggcttcatctttgtcttggggaagttcttgagaagtcaaaaatcgtataaggggctctcgccagtcggtttcaaccatagcaacgtcacgagtgcccgcaacttgagtagtatctttctgaggtactgtcggcgtataaaggtgttcgacgaaaacatcagagggtgccgtctcgcgcttggatccaaagttggcaagtctatcggcggcttcattattgtgtcgaagaacatgactgagctcgagtccatcgaacttatcttccaatttgcgtacctcttgtcgatatgccatcatattgtcgtcaaggcaggaccactctttcataacctggttgacaaccagctgtgaatcacctcgaactattagacgctttatccctagggaaattgcaatccgtagtccatgaaggagtgcttcatactcggcgacgttgtgggatgccgaaaaatgtatccaaagcacatagcttaatctttctccagttggggaaatcaaaaccactcctgctccagtgcccgaaagtcgttttgatccgtcaaaatgcatggtccagtgctccatcttctccgcgggggtatcctcctggcactcggtccattcggcgacaaaatcggctaacgcctgggacttgatcgaaattcgggccttgaatgatatgtccaaagacatcaactccaaagcccactttgcaatccgtccgtttgcttcgcggttgtgcaatatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgctggactttctggacatggccttcttcctcgcgctcaacaaccaagactgtgctcacaacctgggaggtggctgatacatacagcaacaacggctcttgcgggtgtggtgaggctaagactggtggctcagtgaggagtttcttgaaatcttcgaaggccttctgtgcttcgggtccccactggaagtcgtctgttttcttcagcagcttaaagaagggcatcccccgctcgccaagtcttgaaacaaatcggctgagcgccgccatgcacccagtcagcttctgaacatctttctgggtacttggcggtttctccgggttggcttggatgcccctatgagacaccataaaaccaagcagcttccctgacggtactccgaaggtgcacttttcagggtttaatttcatcctgaaagcgcggatgctcgcgaaggtttcttccagatccgaaatcaaatcatccttttgcttggtcttgacaactacatcatccacataggcttcaacgttgcggccgatctgtgttgagaagcatctctggatcatacgttgataagttgctcctgcattttttagtccgaacggcatggtgacgtagcagtatgccccgaagggcgtgatgaatgaagtcttcaagcagtcggattccttcagtcggatctgatgataccccgagtagcaatccaaaaaaactgagaagctcacagccggcggtcgagtcgactacctggtcaatgcgaggcaacccaaaaggatctttagggcaggatttgttgaggtcagtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgctgtttgataggcttggcgtcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagaaggatctaggggaattttcttagtcttggcttcgctttctccactttttgaagtcttggtagcgggcacttctccttcgctcgccgtggctgcagccagtcggatttcctctcgggcagacgtcatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaatttggctaacgccgggcgtccgagtatggcatggtatgctgtctcgaaatcggcgacttcaaagctgatattctctgtgcgaaagttttcccgagtgccaaaagtgatcgggagagtgatctggccgagtggagttgcggataatcctggaattactccgtgaaaaggcgcattgcttggttttagctcagagcgaggaatctgcatatcatccaaggtcttggcgaagaggatattgagtgcgctgccaccgtcgatgagggttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15833 - DNA, 5197 bp, Oryza sativa
ggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacctaacccctattattatccccttgtaccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagatcttggagaacctgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaaccaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattccttccgaggtgcacaacagttgacagagcatcttttagctaatggaggtagagtgtctggtagtgaagattcagatcaagtctcctcagatgatgaagatgagaagtctccccaaggttttaaccagaataaaatagaacttaaggcatgctctcgttgtggagaaatcggtcatgttgccagctcgtgtgcctctacatgcgttcattgtaaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaatacaaatccccgccaagatcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacaactccaattccaatgagtgcactaacacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcagtatgcagtcctatcacatcatcacagaaccaatcgaggatgcagtcactggaacaatgccagctatatctctccagaatcaaaatgagcagccatgtttgtggttttcagtccgctacttatcatggtgtaatcgaaagtttgcagcaatcatattcatgtctataaacagtgagcttgctatgcttatggatgattcatattgagaatacaatgtaccgatgttaagcaccgtccctttttgtttaaggtagtgcctcgtattcatgtaatgagggagaaatgtgtaatacagacaagttccatgaggattcgtttgaaagatgcggatatgtgatcatgtgtataattgtttactgacaaaggagacctagggtctcgtgttagaggaactatattctaacctcgagttaatagccaacctgtggatggaaaagaaaaacaattaaactgtgttgggttaaaaagccaacgagacagtagttgaggataggagttcggatacgccttttacagatcaagataaggattgttggaggaaaccccgaagggtacccgccatgcctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggaaattaaaccctagtggtatagatacagatagcaggcaatgtatttccctgaaggtagtcagtgcagcttttgacgcaccacatcaaggtttcactgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaatagaaacatgctctgcatcgctcaaggaagacccctgattgtaattgccccgcaacagtcaccttgtcattaagtaagcaagatgacctaggtaaaagtgtttctatgaaggcaaagagtgaaatcttccactcggtatcagatgctacacggagtgaaaaatgcaagcaccggttaccaggcaacgccatgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagataatctacagaggtcagattaaaagcacatctaacaacgaagcctcagattcgacagggtaatgattagacaataacaaatccagcaataaagccattgaagaagacgtcaaagtatgtcaagtgggatgaattggttctcttgggaagcataacttatagttagagtggttgacccttgcatcaaatagcagaagtagctatcacccggagaccagggaagctaatatgaggcagttggtggcgagttagaagcaaataacaagcatggtatcctagtaatgacaagcaggttacgacgcatgacatgaagttgataacttgtccgaggttgactccgaagatatgaatcatgagaagttctggaacggaagcatcacagaactaccgcaacctagtctgagtcagccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagcccgcccaacctatcttcttgctagcctcctcgaatctcggggacgagattcttgtaaggggggtggatttgtcacgtcctgataaattcatcccaaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaaggttttataaaaagaaaaaccctaaaagaagtcttctttcccccccttcccttcttgggccggctcggcccaactcttcctccctctctctcctctcccccgcggcccatcggccttccccgcgcgcgcgccgctgacaggcgggcccggccgcctgcctcgctgacgggtggggcccacctgtcat

SEQ ID NO: 15834 - DNA, 263 bp, Oryza sativa
tttggatagacgaacagcaatagatggattaacaaagagggagtgagagggtttagggatgtgaccggtcgatgttgaggaggaagtgcggccagccatcatcgttgtcgtcgcgggcttgatgcgaacggcagcgacggtgtgcttgacggcaacggtggtcgtagcagtgggagtcgtggtcgacgatgaggcgtggcgtggcggtggggcgttcccgtcactggctgcgccccctctcgatcggattagggtttgtgggg

SEQ ID NO: 15835 - DNA, 1496 bp, Oryza sativa
gcttgtgctaaagctttgaatgatcacttcaatattaatttgacttcagatcagattaataatcacattaggacttggaaaagaaaatattctaagatagctgatctaaggaagttgagtgctgctctttgggatgatgagaattttatcatattacttgatcataaacattacgcagaccacatcaaggtatgccacaaccacacttacaccattttattgttacctatagtggttgctgaaatttgtagtggttgctgaaccttatagtggttgctgaaatttataatggttgctgaaacttgtattggttgctgaaatttgtattagttgctgaaactaattttattattaaaccatgttgtaggatcacaaggctgatgctgaatatctgaacaaatctattcacaattatggcaagatgcttgtgatatttggcaatagtttggctacagggaaatatgcaaaagggtcaggtgatcctctagccaatgaatctattgccattgatgatgatgaagaagaagaaattggtattggaagtgctgcagcaactggatcagctagtagagttcatgcccttaatgaggagaatggtgcatcatcttcagcacccaaacccaagaaaacaaagactgctgctgcaattgaagaggaagggctgataggtgcatttaaatctgttggtgacaagcttgctggagcaatagttgaagctggaaaagaggctgcaaaatctaacaaagagctgcccgataacctgtatgagagtgtgcatagcattccagggtttgaagatacatatcttgctcattatcatgcacatctagttgacaatcctccaactgcaagggtgtttgttacccttgaatttgctcacaaggtcacttgggttgcaagatatattgccaccacttttaatgggtgaactgtgctgtgatggttgtgtgatgctgttggtagttgccctgtgttcaaccttcttttgcatactcagacaatgaactatgagtattgagtgtgatggtagctgttagatggtagtaggcatgcattcaaccttcttttgcatactcagacattaaactatgagtattaagtgtgatggtatttggtagatggtaataggcttgtgttagcctacttttgtccctaaaccagtcacttttatggctgtatggttgatggtaaaattcagatgtggtggttccattggatgatggttaattgatatattttttcatatttcatttctgggagcatatggcgtgttgtatgtgtgtgctcctctcctggtatgtgtggtaactggtaacacagatgcatgttaaaaatttctgaaaaaaattgtcttgggctcatgatccatgtacaaatatgtagacaagtaacatgaatgctcatgagcatcttgtttaattttaattttctgttctcaaggtagacaacaaatacgttatgcatttgattatttgtacatgcaactatccaatttt

SEQ ID NO: 15836 - DNA, 4625 bp, Oryza sativa
tttgtaattctatgaatctttctacgacttgcagttgagaggttacgtgaagtcttcaatatagtctgtttagaatctcaagttcagatatttcagaatatccactacgctttttacctttatctcttggtaaattaatttcagaatgttgttgtaattcagtttagcatggattatggagatggtgtttaataacatggtagttcaggagggtttttgaagtcaggcatcgtttctatgctaatataaaaccatttgaatgaaccatcaacaatggatgacctaagaataatagtatgttgggccactaccattcaattatttttttaccatgacaaattttagatatgcataatgattttaagaaagtcaaaattcacaaacttgcactcgaggcaattggaaaacacaaggggaagtgtgtgcttgttcaagaaaattaatttcatactccatgtgtgggttctggctttttgtgccgaaaccatcatcagatggaaaaataaaaggcggaaagaagtgaagtataaactgaaatcttgaactttgactcctaactatatgaaaatatacacaataagatgataaagccagagccccaaagatatcaccgaactctggtgaaaataccatactcttctatctccatttctatcccctgaaaatctgcaatgcatggtccttctattcatcttcatatatatatatatatctgagtttagaaatagctccatatcaaatccatatgttaaatttctttcctgggagaacaaattagtgtatgccatctggtgggaaatcttctctcccctcttagaactcacttttgacaaggtcaaattatagacttgagtgtttgtcaatgatgaatcgtaaatttttttaaagagttatattttttccgttgcaacacacgggcacctaactagtcactgattaattagtgattaattatcttaattagtgattaattaaatcaggataattaatcactaattattattaattaatcattaatcattcaattttcaaaacgttctcgcacactcaccatgcgagaccgctcggtctcgcgcctctgccgcgcgacactgcgcggtctcgcgtcttcttcgtgcgagactgcccatgtcgtcagtccacgtcagtttcgcgcagcggtttagcgataccggtggtatatttgtgccaaaaaatttatatcaagactatttctaagaaaaaaaatatgaacggtatatttttaaatttaagtccagaaaaaagaagcacgagtaaagtttgattctacgcatgttctgtatttgtgttgtgttgtatagagagatcagacgaacttagtgttgcgtaccttgcagcttctacgaagattatggtggttgcataaaggaaatcttcatcgggtcggagcaccgaggggtagccgccgaggagaacgacggtagcccatgtgaaggccagcgtgccgatggcgttgcccgtcctctccaccagcgccaccacgcgaacgaagcaattcagccatttttctggagcagctaacttaccttgcccgccggagttgcctgctatcttggactcgatactcaccgccggtgatgtcccccatactgccgtataccggccgctcgcttcaacgggccggagaccttggcgcgcgttacaatataagagcaggtacagtaacagcaagcataaatgcataatacggagtagtgaactataataaataagctatatacttatatatacttatgtgaaagagagataaataaaagtgaaaagtgttaactctcatacaaaagctaactatacacaagcataaaaaatatgcattaaattcatggtgagagaaagagagagaatgaaaaaaataaacataacctggagtagctaacttattatacatgttagttttaacattaactaatagtaagtagtgagctcttactctacattgattaaacaggctctaaaattataccacatcagcctattgtatatggagtggagagaattgacgagcgagaagaaagcggacgacaaatttatcgccgggcgattgctctcctcgcaatgcgctatcgctcgactgcagcccaactcggcgattaaaaacgtcatttgtgggtggccccgcacaccacaacggatccccttccccaccgagcaagatcaatctcttccctctccaccccaaccgcgcccgctggatctccgcctgcccctcccgcgcgcgatttctgccctctttcccgtgcgccatctccctccactccgctttccacgagcgtgaaaaataatcctattttaccggtcccaaaaatccggtagattgatggttgccaccctcactatctgccttcccctcatccaccttgcttaatctctcctgcccgcagtcccgcacgctacaaaattgtactgaaaaccctagttccccaccaccaaaagccatgtcccgccggaggaagacagattgtgccacagttcctggtgttcctagttcctaccccgtgtgtttcaaaaaaaatagttcctaccccgtcggcggaggtatgtttttttttttgaacggtgggtggcttggttcgtcacaccaccgtcagcttgatttgcttctccaccgtcatcagctggatttgcttctccaccgtcgcgataataataaatattatttgtgtttcaaaaactgtgatacatgtgcccacaagttttagtacctagtttttttaggatcagtggtatttgggttgtttttttttagatcagtggtatttgagttatgtagtaactggctaggtggcccgtgcaattgcgcggctagcacccatacaaaatatcttttatctatgtatgattttacttaaaatttgttaaatagctatctcgttggcttaggactttgaaagactgagctttaatatctatgttttttttctatagttttaaaatatcacactgatcactaccccttattcctttgttgctcgatctgccatggtttttattcatcctccttgagcctttaaaaaatcaaacttgtagtttttagaattcattgtcatgttgggttttgtttttataattgttagaagtcccgtcaaacgctaccactgtactcctctacggcttgtctgctgcctactctctttattgtctttgggattttaaaaatcaaacataattatcgttgcggttcactttttactttttataagtttcgtgaaatcatcagcggcttcgccactatactcctctacggcccgccaactgcctcccctttttattttcattgggattttcaaaattgaacatgattaatattggggtttacattttactttttagaagtcccatcaaccgctgtgaccatcatgcttaatggcatgcccgtcgtcccaccttttaatcgctattacaattttatttgggctttgtttatagtttttatatgtcctatcaaatgccaccaccctaattctttaggcaattatttacggtactgttgcctctcttctatttattgtcatttgttatcgttgtgttctagataaactttttctttgaaaaatccatatttttcattccaatattttttatttgtaaattgtattcatatttgaactcttatattttttttctatttttgaaatttattttattttttattctgaattttacttaatctcgtgatgtgttctaggtggtcccttccaatagtctttatttttaatccaaattttagttatttataaattgtattcctagttgaactcttatttttctttttctaattttgaaatttattttattttttattttgaattttagttaatctcaagttatgttctatatggactattcttttaatattccttattttttatagcttgccaggttttcttttatagctattagaaattccgtaaaacgtcgccacactgctcctttacgacccatccgttgccactctttttttattgtcgttaggatttgaaacattgaaattgatcattgttggggttccttttttaagtttctagatgccccatcaactgtcgccaccccactcctttactacctgacctgccatccctcctgtttattgctattgagattttaaaaatcaaagctaattgtcattggggttctattttatattttttaaatgcctgttcaatagccgccaccttactcctttacggtcagaacattgttactcctttttattatcattgggattttaaaaattaaacctgatcattgttggttttctcttttgtatagtttttaagtttcgctagccatcatttctctactcctttgtccttcttggcttggcttcttaataattttatataatttattttatttgctattttgaattttaattagtcccgagctatgttttatatggtctcttttttttaatattcctcatttttatttagaatttcagtaattttttctaaattatatttctacttgaactctcatttttattttgctgatttcgacatttactttacttttgatttggaattttaagtaatcttctgtggtgttctagatagactattctttcgaaatatatttttatctgattaagttattttgatgaa

SEQ ID NO: 15837 - DNA, 5014 bp, Oryza sativa
atatgagaattttcattctaaatgttcagttatttagaaattatattcctacttaaactctcaattttattttataatttctaaatttattttattttttactcgaaattttaattaatcgatctcatgtttcttttaagatggtctcttcttgcaacatttcttatttttaattatgaattttagcttttatcctacttaaactattacttttttctaatgttgaaatttattttattatttttgaattttaattaatcttgtgtcgttttctagatagaccgttcttttaatattctttttttgaattacaattatttttttcttctacccaaaagtgcacacatatatcaaattgcacttctgactgatgaaatatggtagttagagatgttttaggatagaattgatttgtgaggactccttctatatctgtaatccttccttatctccttcctatgtacttctatatatatcgccctcccctgaggctcaatacaatcaatccacgttacgcagtatttctctcatccctatactatccaacagaagctgccatgaaggtgaaggtcttatgacataaaattatttttcccgtgatgactcatcttttatgaaattaattaagtatattttgaattacgcgcatgcctttagccgctggcgttttgcatttagactacctaattaatcgtaagccagtgcagccatatgactatggcctttacttctataggcttgtgcatacaacatatggtatgtgctatatgtatgtattgttcagttgttcctattctcttagcaatgcatgggcgtatccgcgtatatatatatgtatatatgctctgccatttattagttcagtttatattgctttagatcacctttaaacgcttaacaaattatgttttattatatatttgtcaattgtcatggtgaatttgcatgactctagtcacagattacaggccctagcgccatatgcattcaaatatgtatgcccgagtcctaatccgattacgtcagaatcctactcctaattaatttatgtttccttagacagagccaaacattgatcggccgagtgctatgtagctttttagtttcctatctattgcatttaagttagttcccaaaacttatttgtagccttactaaatcttaaccgttataattcaggactatcacgatctaacggtgtagattttatctttttcttcgattaatgtggaaatttctagccttcgtagcaaacgtggtgactcgtttcaaaactgttttaataatataatagatagatagtgccttgtaatttttgtgctacagagaatttggttgatacggtctctgatatagtcctggtacaaatggctacaaggatacacttcactcttgatcatacacactaatatgtgcatgttataattaattatttgattatgagatgttttcagccaacatagtagctgactttagtaatgggctattagtcagcaacgagctatactattagcattgctcttaagcgctagcaggcatgagcaattcaaccaattgactgccatgcgctgccacttgtgtcaggagagcgtacggaacaaggaagaaaatactactactccctccgtcccagtacgtagcaacctaggatgggttccatactacgactatgaatctggacataaggtatatccagattcgtagtcctaggatgggattacccatcctagattgctacatattaagacagagggagtaatagtttaactaacaatacattgattaaacaatgacttttgctctaatacagtctactccagctagtatgaagcggccagcaagaaactcaagtctactccctttatcccataaaaagcgaatctaatattggatgcgacatattctactacgataaatctggacatatgtatgtccagattcatagtactaggatgcgtcatatccggtactaggttgtcacatttttaagaacggaggaagaatttgcatttctaccgcatcgaaacagcaagactgactccacgaagcggatatatacatatacacctatataatacacacaaatgcgaataatttccagctactagtcatcacatcaggtcgtattccctaagagataatccaagaaatgcaattgacaagcgtccaaatccaagaagtgtcatcgacaagagtgagttccaaaaaataccatcgtataaacgactttatcccaaaaataccatcgccgttagggttccgtccatcccgtgtcattaaatacactgttcatcctatagcacttaatggcgcggaatagacggaaccctaacgacgatggcatttttgagacaaaatcgtttgtacgatgtcatttcttagaacccacacttgttgatggcatttcttagatttggatacttgtcaatgttattttttggattatctcattccgtaaaccccaattggaagatgtgtgtacgtagtgggtacttgcctacttggcgtcagcttcccatgggatcctcacacctctgacgggatacctgtgacgggcaaatgaattggtcagtattgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagatgtgatgggccgccacctgtgacggctttcatttctggcccgtcacaggtgagcggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggatagtgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcaaaggacaacgacagagattatgagaagtttagtaagttggtggaagattgccagatgccgttgtatgatggatgcaagtcgaagcacagcaagttgtcatgcatgttggaaatgatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtgggggatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtgcagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacagaagatttctcccaaggtatcaccggtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaatacaaaagacaaaagagaggagcatgtgaaaaaagaagtcaatattctggagactgccatactggaaggatcttgaagttcgccactgcatagatttgatgcatgtcgagaagaatgtatgcgagagtttaatgggattactgcttaacccaggtgctacaaaggatggtctcaacgcccgacgagatctggaagatatgggtgttcggtcggagctacatcccataaccacggaatggggcagggtttaccttcctccagcctgctacactctct

SEQ ID NO: 15838 - DNA, 703 bp, Oryza sativa
tcaagcaacttatagcctacctcaaaagccatcaacctcaggtccctggcgaatcctaacaccttgatcaaatgtctcggtgaatggggcggcatctcaagaaacatagaggagaggaattaatgcatatttttttttaagttagctgcaccatttacacttaactgattcgaccaaagaggaagaaaaattgaagaaacgacacgtgctaagccattctataaatatatttttagcatttaactttttggacagagacaaataatattttttttgacaaatcactaaagtgaaactaaaatacttatgatctattattagctcggttcagtgttaccataaaaaggatgagtaggactagtgctactatgatcggatgaataccattatagatgtacagtgccgactaataaacgaaatttaatagagtgaatataagaaacattctgaaaagaacaactttttgcttttaaaagagcacaacatgaatcaaattaattttgcgcataagcatgcatgtgctgcccacttaatcaatgtatgggagaatcgaggagaaccgttgtctttttttcaaaatattttgaaggctacttaaaggttaccatctggcttatactaaaggcaaggtggctctgataccaacttgtcacgccaagaatttctatccacaaatgcaagcgcttacatgcgtggttaaccc

SEQ ID NO: 15839 - DNA, 1563 bp, Oryza sativa
  unsure (1)..(1563): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcgtgcttcacatcgtcaagcggtcaagcgaataatgaggtatttgaatcatacacttgagtttgaaatttggtattctacttcatcttatatatgcttaaatggatattcagatgctgattttggtggttgtagaattgataggaaaagtactagtggaacatgtcattttcttggtacatcattgattgcatggtcttctaggaaacaatctagtgttgctcaatcaagtgctgaatctgaatatgttgctgctgctagttgttgttcacagattctttgacttttatctactttgaaagattatggtcttacttttgagaaagtacctctcttttttgataatactagtgctatcaatattgctaagaatcctgttcaatactcacgcacaaagcatattgatattcgttttcactttttgagggatcatgttgagaagggagatgttgaattgcagtttttggacacaaagttacaacttgctgatatttttactaaacctttggattctaatcgctttgcttttcttcgtggtgaattgggcataattcatccttttggcatggtttgagggggagtttgtacctcgtggttttatcaagcaataatatgacaatgagaaaaattgataaaagagagctttgtttatgcatatggtattttcttgtgcatgctagcaataatttaaaggtttatttgtctatagcatagcttgtatgtattctagtcttttcatgagatttagatttcgcttttaaaggagatgatgcatgacacttaaattctatacttgaattaagcaaatatgcaatgttgatgctagcatatggtttgatttgtaaatgctatatatatatatatatatatatatatatatatatatgctttattgaattgttattcctcaaatagctttaattgctcattgtgaaaagagaataaaaatatgaaaaaaatgaataccgaatccttggaaacagtcttgacgacaaggacgtattcgatgtgagcaaaataatgggtgctgaatccctggaaacagtcttgacgacagggatgtacctggaataaaagagaaaaatatgagcaaaaaggctcaagaaaagaaaaaattcaaaaattctcttggttattttgtgctaaaggttatttgagaaagagtgataaatgcaataggtatatgtgtttagtgtttatttttcaacctatgtgcttgttaagatgttgcattataaattgtatgaaatcatgaattttgattgttgatttaagcttaattgtaaaatctttggttcatggttatactttaatgcatgcttgttctattatagatgggttcatcttcttttaattgcaacacatgacttgatatgctatatgtatgctaagctcttatacattaatgaacataaatcctatgcttgatgaa

SEQ ID NO: 15840 - DNA, 3067 bp, Oryza sativa
catggttatgacttctagatggatactatacgtatgtaatactgttgtttgctactaatgagtcaagttagagatagcttggtcttggaatatggtttctttgtttatttcatgtgtaggtgactcgatgtctcgagagagtatttgcggtgatggaccgggagtcgacttggggataagacaacgtccgtggtggtcagagatcatgcgggatacttaggctagagttgatgcacgtggttgatagggattccatatggcatacgatggaggtattgtgtgcgtatgggatgcagagtcgaatttggaaggagtccaaatttgatacgattggttatgtaaagtttctttcttatactatagggtttcctaatgtgtttaggactcttagtatgagttttgttcgtggttttaggctacctacctcatgtataaatagagggggagcgtgaggcttcccggtatcgcttttgagagcaattgagttgagttttgagttaggatttcgcgtttagtcaaaatttttgtaaggagtgctgttggtgcactttgtaaacatagagataatcaataaagtcatctactttaagagttcttcgatttgtgtttcaccgggtttcggcggtttaaccggtaagtcaccggcggtcagaccggtggcattgcggcggtcagaccggcgggagcacggcggtcagaccggcggcggtgacaggcgcagcaagcgatctcggtggtcagaccggagattcaactcggtcagaccggcagaacatcttcggtcagaccgacttccgtcgatttcgagggtaacttttatttctgctaaaagttttcggttttagggtataccaaccattcaccccctctcttgttggcttagttcttgtgatttgatcctacataggtgtgtgcctgcacatatcctcgagcaaagcgaaaggcgccggtgccttcgacgatcggcatctcacggacatcgtccactatgtggttgctgccgagcacggtaatcacgctgccgttgtacggcccggtggtgttaggcccagaaattcccgaatagaattccaagcagaatgtgcattaaaatccccgtccaggaccggccggggtacacaaacgacaatgttgacattcagatccacgtcttacaaacatcttaaaagtcttacataaatgcagcggaaaaacgaaagacaacaggagctaagccttgactagatctgcagcgggaacaccactccacaggcatcctcgacggcacggacaaagcctactcctcggagaaaccttcatctgacacatactcgtactctggggttggggaaaatagagcaagactgagtactacccactgtactcagcaagtcataccggaatagaggcatgatgcagggaattatcaaagaagagctaaagtggttctttgcataaagcgagtatttaaaaacagaagttgaaagatttaaacagttgtaataattaattaacattaactatccactgtccaacgctatcccacgttgcaacaggcccaaccatccacctaaactatccaaaatcaaaagattacactagggtgagactaatcacggtgaatctggttgaccgcccataaccgtgggcacggctattcgaatagttttactctgatcagaggtgtacaactgtacccacaagacacagccccacgacacgttacagtgcgccgacatgtcaccacgacataccggaaagaggccgtgacaggacccttcgcataaccccctctaaccaagcacaccacacctcaggtttcacccccactccgcgcaaggcagtgggcagtcccctctcgtgcctaggtgaatccggaagcgacagaggccgtcgcagggcctgccccgctccatcacgcccacccttgcctagatgcgttgactagaggaaagctacactacaagcccagccgttgcccacgctggcttgtggtaagtacgataagttcttccagggcatcccgcgaaccggtccttaactgccatgggtgcgaccagcaaaaccattcatccacagcccaccatgtgatttattttaattaaccaacaccaaagcggtggcactaatccaacaagaccattagaaccaacagtctaaacattaaaaggattctccccattgtgcactagttgaactaagcatggctaagcaatccctagtccaatctctagtcatgttataaccccaagctgacaaagaaacatggtacaacaatagcatggctatgacaacaggtaaacaccccatagaaacattataaaacaatgcaatatttgaaagaaaacaatagagcatttgcaatataggatcaacatgttcaagtgacaagcatgacttgccttgctctgctgctggaggaacctcggcgactatttcgaaatacaccggagcgtcggaggaaccggaatctagcgacatacaaagcaaacattgcaaacaggctataagactactgaaacagggaacaaaaccatttttaatggattctacacatttttcttgatttactgagacttgaatgggcttaaacggagctcggatgaattagttatgagttttagaagattcactgtgtttattactataaaagaaaaaccttaaatcatttattgtgcaataaatcccagggctgacgtcagcacggagggggggggggggcggcgccgacatgcggggcccaccggtcagcggctcgggagagggaggaaggggcgccggcacgcggggcccaccggtcagcggctcagggggggaggaaggggcggcggcgacccggctcggcttggctcaaggccgaccgaccggccgcggcgacggcgatggcacgcgcacacgcgaacgcgttaccggcgacggcaaccggcggacaggctttggggtgccctaaggaaggaagagagagagattagagagagggagatgaaccacggcgaccggtattcatggccgaaagcggcggtagcggttgaactcaccggaacgcgaggggatgcgaattccggcgacgaaactcgacggggaaggg

SEQ ID NO: 15841 - DNA, 9573 bp, Oryza sativa
cgaaaaagggagggaaaaagaaaaagaaaaaggggaaaaggatttcctggaattaaaatattgcttgctcaattttaattggttaaaattatttctagggctctgaaaattccactaaaaatcctgttagtgaagttcgacatgtagaactcaagaaaaattccacatgccaattccgattattatttgcattgatttaaaagggtttactcttgctttgcactggtattttcttagggtcgcttataaattaaatttttggcttgggaggagaacttcggggtgtgacaaacctaccccccttaaacggaatctcggccccgagattcggaggagctggcgaagaggtgcggatgggcggctttcaactcatcctccctttcccaggttgcttcctcttctgaatgatgactccactgaactcggcaaaacctggtgaccttgtttctggttcctctttcgctggtatcaagtatacgaaccggcttctccacataggttaggtcctcctggatatcaatgtgttccgaatcagcttgttcttcaggtacccttaagcacttctttaattgggacacgtggaacacgtcatggatgccgatcatattggatggaagttctaactgataagcaacttctccccttcgttccaagattttgtagggtcccacgaagcgtggtgccaacttgcctttcgtctgaaaacggtgtactccccagagcggagtgacacgaagatacacgtaatctcctgcctcaaaagtgagctcccttcggcggttatccgcgtagctcttctgtcgagactgggcaatcctcaacctttccctgatgattctgactttctcttccgcttctgttaatacctctgtcccgaacagttgacgctcgcctgtctgatcccagaagagaggtgtgcggcacttccggccgtataaagcttcaaacggtgccatctgtagactggcctggtagctgttgttgtacgagaattccgcatatggcaagtttttgtcccaagctccaccaaaatcaagagcgcaagctctcaacatatcttccaggatttgattgactcgctcggtctgaccatcagtttgcgggtgataggccgtgctaaaatttaaacgggtccccaattcttcctgcagcttctgccagaattttgaggtgaactgactccctcgatcagatacaatctttttgggtactccatgtagacatatgattctcgagaggtaaagctccgccaaccttttgcccgtatacgtggtatgtactggtatgaagtgagcaaccttagtgagtcgatccacgactacccagatggaatcatgacccgatgatgtccggggcagtcctgttataaagtccattccaatctcctcccatttccattccgggatttgaagaggttggagtagacctgctggtctttggtgctctgccttcactcgttggcaaacatcgcagagtgcgacgaattcagctatttctctcctcatgctgacccaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccgtgttcatcttcatggaaatcccgggcttttccgactctcatgttctttttcagctctgctatttcagaatcatttacttgagctgctctgacttgatccacgagcgtaggccgtgcctccagagcagctacgaacctgtgttcaacaattcccacgttgagatgctcaaactcctaccgcaattcctcacacatgccctcgatgcatagggcagtgcagtaacttttcctgcttaatgcgtctgccaccacattggctttacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagtcggataattcccttcgtgtggacgcaactgccgcgaggcatacgcaaccactctgccctcttgcattaggacacacccaagtccgtggcgggatgcatcgcaatagacttggaagtctttcatctggtcgggcagaatcaaaactggtgcggatactaacttctttttgagctcctcaaaactcttatcgcactcagctgtccatttaaacttctcatctttcttaagcaaccgagtcatgggtcgggcgatcctggagaagttttcgatgaatcggcggtaatatcccgcaagtccaagaaaacttcgaatctgtgacacggtcttcggtggggtccatttggtaactgactctacgttcgatgggtcaactgccacaccctgagctgtaatgacatgtcctagaaatttgacttccgtcaaccagaagtcacacttgctgaacttggcgtatagctggtgctccttcaacttctcgagtaccagacggagatgttgctcatgttcttcttcggtctttgaatagataagaatgtcgtcgatgaataccacaacaaacttgtccagaaattccatgaacactttattcatcagattcatgaagaatgcgggtgcgttggtaagtctgaaagacataaccgtgcactcatatagcccgtaccgagtggtgaaggccgtctttggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgcggtaatcaacgcacatcctcttcgtcttatcctttttctccacaaaaatgaccggagcaccccaaggtgaagtacttggtcgaatgtaccctttctgcagctgctcatcaacctgcttcttgacctctgctagttcgttggccgccattctgtatggtctcttgtaaattggagcgattcccggtgccaagtcaatccggaattcaatctctctcttgggtggcatggtagtaaggtcttcggggaacacttctggatactcgcagactatgggtatatcttccaatttcctcaacttcttctccacggtgtccactgggatttccgcctcaatctgattcaaagagaccccttgctttggtgagtctggtgatttgtacactactgtttctcccttctcgttggtcaaggtgactgtgcgattcgcacaatcgatgactcccttaaacttggtcagccaatccatcccaagaatgacatctaggtctttggattcgagaagaataaggttggctagaaatggtgatctttgaatttctattgttatagaagggctgaattgaaccgaagtggagctattccctggggtatgaacccgcatcagtgtgctaagttcctctcttattaacccatgcatcccgacaaacttctttgaaatgaacgaatgcgttgcaccagaatcaaaaagtactgttgcagggattgagttaacaggaaacgtacccagtacaacctctggtgctgtttgtgcctcctccgcagatacgtggttgacacgagcttggataaaccttggcccggcacgcctaggcttcgggcatttgtcagcgaaatggccaagctcgccacagttgaagcaggaccctggttttgctccagtctccttggcttgcgcggacgggcctgactgtgccggtgtcattggtgggcgtggagatacaccgcggttgggctgacctccatggtggttctgactgccactggcgccctgggaaaattgctagggttgaacgggcggtactggcggacgatcatggtggtaggtccaccctgctgtccaggagtgaagtgcggcctctggtgacttccctgatgtgccctgaactgagcggccttcctcttcctgtccatcttgttgcgttgatcctcctgacggattgccttgtcaaccagcctctcaaagtcgacgtagtccccagatattagttggttggtcagctcgtcatccagacctgccatgaacttttcctgcttctcggcgtcggtgcggacatcctctggtgcatatcgcgtgaggcgattgaactcatggagatactccgtcacagtcctgttgccctgatggagtgcccgaaattccctcttcttttgtgccacgaccccgtctggcacctgcgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagctttttctctatggcatggagccagtcattcgcctccatagggttggtggtgttggagaaggtgggtggcctgacacgtagaaactctggcaacttggactgagggggagggggaccaaactgctgatgctgctgttcggcgtgctgcagcatccgctggtgcatctgctggtgctgctgctgcatctgctgcatcatggatgccatcatctgagtctgatgtgccatcacttggggtagcgtcggattctcgggaagtggtggcggaccattgccggaatcgctgtggggatgcaccccattagtgcgctcttcgccgttgctgccctcgcctgttgcgcggctaccattcttggtgtaaaccatctggagggaaaatcagacgggggaaaagaaggaaaacagatgctcaggaactaagctttattatataggaatttaaactgcaattgttcggatctgaattaaaacacttaaaaagcaagcaaaaatccttattaagacagccatatcataggcgcatgatatcgaccgtcgactgaccccaagcaagcaacctaaacacacaaactaacaagcagaaactagacagtcgataaactaatggaaagcgagcctaatgctcggaacggctcctgcggtcggtggagtcgaaggcgtcctcctgctcgtcaccaggtccctctgagcgactcctggagcctggcagataagtctcgccgccgcccggctctgagccactggagctactgctgctgagatcgcggctgccactgggagtagcagacaaccaacctccgttgccactggctggacccctggcggctgatgctggagcgaaggagagagcggacgcgggagctgacacgtgaacgggagctggagctggtactggagctgcaggaactaccggagctgcgggcggaactggaggtgctgcgggagctgctgatggaggtgggttcctgggcgcaagctggatgcgcacgggtgcagtcgtcgtcttgcggggcgtagtgcggatccggactcctcctggcgcgggaagaccctttaactgagcattctccttcttcaggcgcgctatctcgtccttcagagcgacgatcctcatgagcttcccatcattcaaggccttggacgccttgtgcaggtccgagtgcatcctatccaatcccctcatcatagcacacatgtgaccaaaggtggtgtcgttctcgccggctgtcgaacggaaagtactgacatcatcaccgctggctcgacaagggtgaaatcggtacgccgtgtcgtggaagataaagttgtggcgctcccgtagtctggccatcatcaggtatgctgcctcctgacaggcgtgatctgctgtgcctccggatgcctcaaccaccatattagctaggcaggtacccacgtagccgtggacctccaggcgaacacggtgaggaagcttgccactgagtggtggaacagtcgtgtactctggcgcgttggggtagcccaccaccagcgtcatacgtgccaactctgccacaaagtcaatcatgccttctccgcggtggttgggtgggtggccggccatctagagaagacaaaggagtaggatcaatgcatgctcaaatccaaatttaaataaagcaataaaagactcaaataagagaatcgaataagagcgaaattttatgcatagatcattttgcatgagagcgaataaataagacagactcacataacgataaaataatggggaaattagatacatactaataataacactaagagcataaataccttgcaacccattgtcacgccccgaactagtaccgaccggaactagcccgtgacgctccaaattaacctgttaatcgataccagtcccaggaaacagtgctggtatcacaggaagacagattatcacagcaatagaggtctctttattatagagtagaggtacagtcatgttgggctgcggacaggccccgagctcacaactgcattacaaaaggaaagcggaagccaggactaggaccaaacaacacaggcgcgacttgggaactaggccgaaaccctaaaactcatcgtagccggcttgctcctagaagaactcctcatcagcaggatccgcttcatcttcttcagcaactggggggggggattatttatatagagcaagggtgagtacgggagtactcagcaagccaggggaaataagtgtttaatgcaggcttcaaggagaggctgttgtttttgcaattgattttatttgaactcttttctaaaaacaactaagtgagtgcttctcaaacgacacggatgagacagtgcgtctcgtccggtcagagtatgtgtaatgtatcagtctttagaattgaaacaaggttggcacccggccaacagcttttcaaacggccacccgggccaacaactttcaaacggccacccaggcctagctgattctatcagctacagatttttcaaacatcgaacccctttccacaacagcaatttcacaagcagtagttaaacaaaactacgctaggaatcacctcacatccgcccatgaccgtgggcacggctgttcgaacagtttgttaacctctgcagagggggtacactttacccacatgacattactaacccggatcacccagcccgtggggatcagccacgtcgggagacctccaagctttcatgacaaggcatttccaaagccgtcataggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcggaaaaccgtacacccggtacgttccccggtccgcggttttggaaattcatttagttcgcaagcaccgacccaggtgtcaggttttccaagtcttttgtaaaacccaagttttacccaagttgttactcaaaattttaagtttgaaggcgtccgtcgatactcgtgcagggtgcacgaatatcgagacgcaactagatggttacaagggggacatggtatcacaattaacaaaggaaggatcaaatgcaacaaattgggtaggtccgccaatctgccttgcagatgggacaagcagcttaagtgcagtcctatcaatgcataatatttttcaagcaacataattaaatttcaaatataggctcaagatgttcaaaggtggcttgccttgctcgagatctggagcttgatcctcgaaatcagcgcactgcgggtcttcgggctccgaaactacacgcgaaacgggacaactcaacaaacggcgaaaataaagccctattaaagacctctaagcgtgccattagatagatctcgagatttgaggaattttggaagttgaacggagtcaaacggatttacggttgggaagatattgagtttctaagattattggatttttggtctaaaggaaaaggatttaattaaatcctttttgaaaaagaaaagaaaagaaaaggaaagagggagggaaaatagacttccctcgggcggctagggcgcggcctgagagaaagggtggctcggccgagcttaacgagccggccggcccaagaaggcggcccagagcggcccaagacgcgcgcgcgcgggagggaggagagagagagcctgtggaccgggctcaccacgcgcggtcccgggtgggacccgcttgtcagcggctcggctcaccgtgcggagggagcacgcggcacggcactagggtgggggagggacgcggtgcacgcgcgcggttcgcggtggacgcggatgcggcgggcccacgcgcagcctcacggctcgcggtggaatgcgcacacggggagggactgactggggtcggctcgacctggtcttggctgagctggcgccgatgtggcgcctacgtggctgccacgcgggccggcgggaggtagacgacgacgccggccggaacggacggcggacgacagcggcgagcggcggagcgaaccacggcgatacaggcaaaagcgagcacactgggtagttgcacgagacgaggggagacgagccaacggctcggattcgccggagggagtccgtcggcggcggattgcggcggcggattacggcggcggcaaccggcggagagaaaaggggaaaacggcgacgaggtcacgaggggccaattcccggcggagagagcatctacgcggctacgggaatccgttgctagcgtcggattgggcggagctacgccgagcgaggccggcgacgagcgggtgctacggagctcgggcggcgacggcggcgagcacacggcgagcgacggcaatggtcggggcggcgccggctagctacggggaggctactcgcgctaccaccgaaaactaagggggggaggtggagcgaggaggaagaacggagggaggcactaccgtgcgggcggggcgcagtgacgagaggccgacggcgcgggagtaatctctccggcctcgggccgaggaagaggaagaagagggtgcgcccggagtcctcttccgcgtccttgctcgtgccggctcctccgacatgcgcaacgacgaacggcgacggcgaacagagcacgggggcggcgacaatggcgtggaggcgaatgggagaggaagggaagggggaggcttgggtttatgggatggcaatgtcggtttgagaaccgacttagggtggtcaagacgcgagctagcgctccggctagcggccaaaacggcgacagaggtgacgccggcgagagggaaaaaggggaaaagagggagagaaaaggggagctcgccccttgcctctctgggaaaaggaggaggggagcgggggcgtcgcggcagtgggaggaggggctctgcctccgtcccttggcggcttgcgcgcggagaggcggggccgaggcgatgacgacggggatgacggcggggcggtttgg

SEQ ID NO: 15842 - DNA, 1258 bp, Oryza sativa
gagcgggaggggaagaggccgacacagggagagagcgccccgacgccgggggagatgggccgagagaaattcggcccatcgaccccgggggaggtaaaatagacttttgcggagggatttgatttggaaggatttggattcggaattgaactcgacgatagatcggggatttgagatcttgagatggcacggacactagacaacaagcaaagaaacaaatttcgcaattagggtttttaagagataattttcccgctaggtgccacgacggaacgggcgctacacccatgttcctgagctaggacctaatgcatttcacccatcaaatcccaactgactgacgaataaatctcaatagttttactaaaaccctagactgactcgttttgacaaatctcacttaaacgagcgaccaagatttttccccttgaaccacaagaacagatcccaattttcccgtaacaaatccaattgcaaagaacatatgcaatgaaaaggattcagagggctcttaggtttttccatttggcttgtcctacggtcaaggtcggctctgataccaacttgtcaggcccagaaattcccgaatagaattccaagcagaatgtgcattaaaatccccgtccaggaccggccgggtacacaaacgacaatgttgacattcagatccacgtcacagggcccgccccgctcctaaactatccaaaatcaaaagattacactagggtgagactaatcacggtgaatctggttgaccgcccataaccgcgggcacggctattcgaatagttttactctgatcagaggtgtacaactgtacccacaagacacagccccacgacacgttaccgtgcaccgacatgtcaccacgacataccggaaagaggccgtgacaggacccttcgcataaccccctctaaccaagcataccacacctcaggtttcacccccactcctcgcaaggcagcgggcagtcccctctcgtgcctaggtgaatccggaagcgacagaggccgtcacagggcccgccccgctccatcacgcccacccttgcctggatgagttgactagaggaaagctacactacaagcccagccgttgcccacgctggcttgtggtaagtatgataagttcttccagggcatcctgcgaaccggtccttaactgccatgggtgcgaccagcaaaaccatgcacccacagcccaccatgtgatttatttcaattaaccaacaccaaagcggtggcactaatccaac

SEQ ID NO: 15843 - DNA, 37953 bp, Oryza sativa
  unsure (1)..(37953): unsure at all n locations
cagcgcacgcgcggacgtggctgacgtggcccggagaaggcggaggcgtgggcgcggcggcggttgcgggcgcggcagcgccggctggaggaaggtgacgggtccgacaggtggggcccacctatcggcgtcccggggagagagggaggggcggcttggctgggcctcggcctgcggccggcccagcagggaggagggagagaaaaggagagaatgggccagcggcccattcgaaaaagggagggaaaaataaaaagaaaaaggagaaaaggatttcctggaattaaaatattgcttgctcaattttaattggttaaaattatttctagggctctgaaaattccactaaaaatcctgttagtgaatttcgacatgtagaactcaagaaaaattccacatgccaattccgattattatttgcattgatttaaaagggtttactcttactttgcactggtattttcttagggtcgcttataaattaaatttttggcttgggaggagaacttcggggtgtgacaggtggtgagcatgatgttcgttgccatcaggagcccgatccaggtttggtctgacgagacgtacatgccctgggctcggcccacgggcttggatctcgaattgggccccacagttagtaggtcgtcgaggaccacaaccatcccgaacaaggtatttgacgtgttgtccggcgggttcaccatcgtgaccgccgatggggaagggcagctgaccttctcgtagaagtagaagtgtaggtgtgtcggctcggagccatggcctgaggggctaggcccaggcccaccatgtgtgtggcccttacaactggctcccagcacaaggaagatcataagcattagtgctaatctctttgccatttttgatcttagagtggttgtgctgagtgatataactcgaccatgagctatttatagaggcatggggagctctaagagctagagggttggacgatgatagatggaagttttctagttgacttgtaactattgtagatcgatcgagtgatatttaaatataaacctacaattagattgtatatacatgtggacagtattgaggcacatcgatccatacagtgttgactataggtaaaatactccgatacacttggtttggttacttaagtataggagtaatagtatgccgtctggcttttaatagttaacactattgacttttatacatatatttggagactcgacctattaaaaaaatataattaatcttattttgttacggtttattttattgttattgtactttaggtatgacttatacttttatatttttatatttgtacaaaattttttaaataagacgattaggtagtcaaaagtaagttaaaaaataagcgacgtcaaacattgaaaacagggagtatttgttttcctcgtcaaatattacatggacatggaaagcctctaagcaagttgctaatgagctgttaaccacacccaaagttaaatgcacgctgagccacagagagtctcagagagtataaaagaacttgcatacatcatacatgcatgtattagttagaacacaagattgatgcacaagataaagctagcaattgtcccagtactattaagaaaatcatatactataaaagaaatatttaagcaattacaagaaggaattattttatttaccgtgaattaaaatttggagatttgaccgcaagcattaattcagagtctttatctattggcaagttgctagtggctatggccacttataaattcctcataatatctattttttctcagattttgtttcattaatggtttttctttgcatatatatttgaacatgaaaaagaaacaaacacaagggtattacatcagacaccctatactgtcgatctgtcaaagactgagacctaagattgtaacagggtcaacctgtaaactcacttatagactaaatccagggttactacttatttagcctataagtggattcacgagttgacccacttataacctaactattgagatagaagctagtctagtagtacttctgtaccatatatgtggttcaatttgaaacaaaagttgtaccagtccatagaaaaggaaccaaatgtatatcctactatacacatcaaaccttggagaatagcaattaaatccaaccttgcatgaattctcccttattacacaagatatgtggtagaattaaataaagcttctctcttgacaccatcagtaattaactaagacaaacttaagcgtgcatcaagatcaatggaagacatagacgttgtactccacgatggcgtcaagtccatttgagtcaagaaagtaggtgcgggcttgggcatagccacgagcgaagcggaaagcactggtgccaccgacaaccggcatctcacggatactgtcggatatgtggttgctgccgagcacggttatcacgctgccattgtacggcccagcagtgagcacgatgttcatagcctgtaggaagcctatccggacttggtctgatgagaggtacatgccctgggctcgacccacgggcttggaccttgggtcaggcccctcggtcaatgggtcatccatgacatacaccgtcccgaaagaggttggtgatgttttgttcggtgggctgaccacctgcacagcggatggcgaggggccggtaatcttgtcatggaagtagaagtgtatgtgtgtcggcgctgaactattgcataaggagctacacccatgcccatacccgctttgcgtgtcggccttagtagtggcggccagcacaaaaaggagcacactcatcactactatttcctttgccattttttgatcttagagtttgtgttgagtgaataacactcgcatcctatttatagaggcatgggagctctagggctctatatatgagttggaggagggacacgtggcgagcagcgattggaggaattatggctatctattaattgttgctcatgaccaattggaagtacattttagttgacatgtccttgtagatcgactgaaccgaaagactagaataaaagattgtaatgcttacttaatttgcatttagattgtgtatgattaagtgtggttaacattgaggcacatataagaaatatatgtgttactttcagtaaagtaccccgaatctccaaactagttggttaattaatttttagttctccaaaccgaaggacgatgccttgtagtttgctgaaagcaagggcccaaccacgcccaaagtccacggtgcaatatcacttgtgcacaacaatgtgctcctagagaaaactaaattactccctccgatttgataatacttgtcgttttgaacaaggacacggtctctaaaaagtaactttgacaactattttctattataatataaatatatggttttattgaagtactttttaagactaatctacacatatggtttttatatttttaagataaatattttagaaattatttgtagtcaaagattttaaagtttgactttattcttgtccaaaacgactaatattatcaacccggagagagtaaacgaagtcctagaaaaaaatttcgaattgcgtgatgaattaagcttttaagcgccagcatcggacgctagaacagaatgtacatttctgatttctggagcataatatactcaagagcaagcaaaggtaaggagctaagcgcaaaaatatcatactgtaaaaaaaatgaagctcttgacaatcttgatgatatttgccataattagatactccctcctatcactttaatttgatgcggggaaagctaagcttaactctcccaacatgaagtaaaaatgactagagggagtaataacaaattaagatacacatgcattaaaacataccatcgacagtgagacatatgtcatatgactttatcgattttaagatatactaacccagtctttaaatgtgcttacagagatagaatatgtgcatgtgcatttattgaaatgagagtatgtgcgtgttataagcacctacatatatattgtgttaaaagaaaaaagaaatggcacatttgaggagtcttgaaggatctccaatgcctctcaatcgatctctttgccagcatttctgaagcagctcagccagcttggagtggatatctttcagcaactcaaccaatttgttctaattcatcttgttttcatgagaaagatggactaactaacttgcacctctaaacaggaaaacaaataattaagttgcacacgaaggaagggaaccaaatatataaaagatgattcggtgaaagaggaaggatggcatcaattttcgaagacactgaaacaaattgtatcaattccctcttcaaataattgttttctaaaaacacattaggcgctcacatacacacacttagccttataaaggcacatacacactctatcccttgaaggacctctgagagatttgactggtatatcttgaggttgatgaagtcgtcgtagacgcatcgctgtcatcgtctatcattcaaatctagaacttgaaaaaaaaccaaaccctcctctactctgatgacccaatgaatgttgctggttgtttttatatctgaaagaattaattaaggggatcctttgcttgtgaatgctctgtttttttaaagaattctgaatgctctattaatgttttcttttggagaatcgatggggatatggtataacgaacgccaatcatccgatttcacaaaacacacgatacgatctgaatagtgaatactggatgctcgtgaatatttcaaatattggagctgaagctgagctaagaaatactcctacacgatagttaagcatatcaattaaccctatttaatacggcaaactcgtaatcacatggatccaattaacccttttaaaaaatatttgttagacttaattcgatagattttttagaggaatctttgcagattctctgctgtcccattcgccacaagattcatgccggggtcttctcctcttactcaagaaattagcgacagcccaaccgatttaggtttagggttcgaagttggggtggaaggggacggggggggggggggacgggggacgggggaagttcacagggcttagcgagacggccgtgggtggcagaacatgtgggtggagctaaagccacgggatcgttagcaggtggttggccaacattggtagcgggggtgtgggttcctgaccagttaggaggtgtggaaaacaatggggtggggcaccttaccaccgcatgatgggaaggagagggagagagggggagatggggtgcatgatggctgacatggcctcactggcaccattggcgccttctgatgagggcaaggccggggaaggcgcaatcggcgagggaggcaacattatcgtcgagattaggcgcgatttgaagcattgtgtaaaggagaacgacagagaagatgataaagtagaagaactgtaatagtacgaatcttaaagcaatccagggcatccaaaagtgactgaaatgaggaagcattttcttgtgaatgttacatagtcagtccctttgcctcaagatcttgcatgtcgattaaagttgggaatttttttcttctaccacttattgaaaccgtatttttcgtcccgccatcaaaattttgcatttctctcttttaccactactccattagtgccccatcctcttttgccattctggtggtcaatgtcagttgaccatcatattgtccacaaaaaccaatatatgcccctgtgtagctaaaagttactataagagaaccaatgaaaatgtgatttatcttttaattttcagaagttgtataaaacaattgtaggaaaaatatttatgctgtaaaaaaattgttggaaaaaaattcaattcgtttggaaggtttatataactttgtaatatatttagagaaaaatcatttttcacagccacatataaataccttatagcttccaatatttcaaaattcctagtatagactattgttgggaaaaatatttttccgatggctgaagagagagaatacagcagtcgagtcccctccgatttgctgagtggcggagagctgccccaggagttgtgattgtgaacgagagcgacaaaagattttacccctccatgccgttatttgttaaaacgatttttccgttgataatttctgctaccgttaacgacttaatggaggtgttagtataataaaagtatctaaccttttcatatagaaaataaattaacggtttggatgaagttttactatcgatagagagcaccataaagaaaataagtttcgccaaataatcttataaatccctttttctaagtatattgcacatgttccttatttagaaaaaatatataaaattataacttaagaaatcaagatcaaatattgtagtttaatgggtttccttggaaacaatttactgtgagctaacttaagaacatgtacaatagcaggctataagccagttacaaacatattttaaagagatataaaagcgaagaaagaagagcagcggactacagatttgtagccagctgcagcgcggactccaagacataatgtgtgtatgacaggtgagactaagtattaatagtatagtaagcaacaattgtataaattggctatagataatttgaagctagtatttggctatactattagccttgctctaagaatataagaagagatgccacagttgcttcgcttgcttactacaatcgattttgctatatctcactcgaaagattttttcttatctctcactcgaaagattttttcttatctctcactcgattttctcactcaaatttacagtgtgttttcttgtaagttacaatgtaatttatgaaatttacactgtaacttttgtaatttacagtgtaatttttgaatcttcgcatataagttttgaaatttatattggatttggtcttttttttctgaagatatggaaatatagtgtccattatggtgtttcttagttgttttttgcattttactgtgtctattggattttaatccaaggattaaaaatctgtgtgatatgattataaaaatctttcgaaagatgcataggtactccctactacaattgctgcagcttggggccggcatggctaacccacatcagatgccacacattttgggctacgcatgcggcccaatcaaatatattccactttggcataagttcacattggcttcctcaaatatatatagttttaatctaattcttatctctcaatcgctcctctaattattaaaatcgatgcaaaatgacccccttgatggttttgagagcggtttttttgctaatgtagctcattgacttagtttgaccggctgattcagtgtgagacccatatgtcagtgcatcctcctcttctttctatttttctctctctcctccctcctcttctcttcttggtcttcttggaggcaggggacgatattgtacatgcatgggtggcagccgagcttagcgcctacggcgaggccgtgtgggtcctcgacgccaagcaagaggtgttgagcctgttggcaccggtgacaccatgtgcgtggtgcgatgtcatcggaagtgaggagccaaggagctcaatcacccgctccacggtggtgaagggaggcgaggagccaaggcgcatgggcggtgcccgagctctgcgtctatggcgaggccgcacgggtcgttctcgacgccaaacaagaggtgttgagctggtcggcgctagccacgccatatgtgcggcgtgatgtcatcggtaactaatataaatgaattaattactaatgatatcaatttttttttcagaacagatatcaattagagtagttaattgatggaaacccacctgagttcgtcgccgcggtatcgcagtgcgcgcgacgacaagcggcggtgtcgcggggctagcattaatttggtcccttttctatagtgtacaattcttgttccaaattaatctatacgctctagaaggatgattaaatttggaaatatattaggatgtaattttttttggcacaaatataccattgatatcgctaaatctttgcacgaatataacgatggcgtgacgagtcgacgaagagcgccacggtctcgtgggacgcgagatgggcggtgtcacagtgcgttggcccgaaatggacaacgttgtcgtagaccaatcttcaaactttgaagattagtaattaaagcaaaccttgcatgaattaagtcttccttattacacggggcacatatgtggtagaaatttagtactcccgacattccatatggcttgcactagtcaacacagtgcatgttaaactgttaagccatatggaatgtcgggactggtactttgataatagaatatttatacctttttttttcataaagatgagtggtccaagtttatacatgaatagtatcttatatcaagtaagagggaacggagggaataatagcatcaacaattaagccaacctagcatgaagatcaatggaagacataaacgttgtactcgacaatggcatcaagtccgtttgggtcgagaaagtaggtgcgggcttgggcatagccacgagcgaagcgaaagtggccggttccgcccaaaatcggcatctcatggataatgtcggatatgtggttgctgccaagcactatgaccacgcttccattatacgacccagcggtgagcacgatattcatggcctgcaagaagcctatccgggcttggtcagacgagacatacatgccctgggcatggcccacgagctttgatgcgggatcgggccgttcggtcaatgggtcatccatgacaaccaccatccccaagaaggtcaacgatgtgttgtttggcgggtttactaccctcaccgctgacggtgacggactggtcaccttgtcatggaagtagaagtgtaggtgtgtcggcactaaactgttgcctaaggcgttgggcctagacctgccttccatgtcagccttagtagtagtggccaacacaaataagagtacactcatcaccgccaatcctcttgccattttgatcttagaattgaatttgtgttaatttgtgttgagtggatgatatactcatgacctatttatggaggcaagggataggacaagtgtgaagcagtgattgagggaatcatggatatctattgtctcctcatgagcaatggatatttcattgacctgtccttgtagaccgagtgaacaaccgaaagagaataagagattgtaatgttttgcatttaaattgtgtatatgtgtggacagtattgaggtacatatatgaaaaatgttactatcactaaaataccccaaactagttggctatttttagttctccaaactgaaggatgcgttaagttaatttggcacattatacgtacaaggaaagactgaaagcaaggtcctaaccagcagcatcatagctagtcaatcaatgcccaaagtccacacggtgcaatatcagttgtgcacaaaaatatgctcctagagggaaaaaatatatgtttgaaccaaatcctagaaaaaaaaaatgaattgcgtgatgcattaagattttcagcgccaacaatgtagtataaatgaacaggaagcaatggtaaagaaattaagcacaaaaaaaacatgctgtaaaaaaatggaaacattgacaattgtgaagatattatttatgtggaatgtactacgttacacttctcacatagtattacctccatcccataataattacatttctagaaattagagatagattaacatcaaacacaatttatcacaataaccatatatatttaataactacactgcatgcgcatattctatatgtctatacttgattaaaaggaaagttgagcaacacattcgatatgtaaacttaattaaaatgaaggttgggggtacacattccatttgttgttgtgtcccatcttaccagaaatacaattttttaagataaaatttgaatggtagaaatacaattattatgggacggagataattcttctataaaaatcaagcaatataattatacttgcgtgtagtagtatgcagaggaaatagttaacatttggcaacaaacatccatgaaattgctgtataaggcccttaacaaacttgttgcctctgtagaaaaaaaaaaacttgtgttttcagactactcgagacaatcacaaaaacttctgtaatatggcatggttggcattatcgttctaaaaaaaacagtttgttcacattcaggtttcataattgtttacatatgcattttgtacccgtttctacaacgaggctttgatgaagtggcttaacaaaagtttgttctaatttatctcgttttcttgagaaagataaattaacttgcacatctaaccggggaaaaaattagcaggatggacataaattaacttgcacatataaaagatgattaaaaaaaatcaaaatctcttatactgtgaaacggaggcagtaccttaacattacaacttaattaaaatccaatggcaacatgatatagtttgaaaggttcgctcaagaaaagaattattgtgagttcacttacgaatttaagcatctattgcagctggttgcagtgactgcggcacatcacatggatctatcgagcttaattcagttggaaaccacctggcccgggtgaccgtctccaagaaactgtgaagcgacaaaagaaaatctcacaagaaaacagttcatcataagatgcaaacaaattttaaagtgtttgcttgcttggatttttttttcttgtattcatgcccccatctccggcggccgccagcgccacagccaccgacactagcatggccctcttccgcacggtctgtcttgctcgtcggtgcagaagaggccgtaaataggcccatcgagatatgggccgtttcatcggtactctctctgtttcacaatgtaagtcattttagcatttcctacattcatattgatgttaatgaatctaaatagatatatatatatgtttagattcattaacatcaatacgaatgtaaaaaatgctagaatgacttacattgtgaaacggaggaagtacgttttatatttgatctttaccttacccatgaattaagactcaaattaatttagagtaaatttcaactaaccccatgtactattatggtctaaattgtacagaaccacgtgggttttgacacgtaacacataaccttgattattatggccatgaagttttacaaaaccacactattgatcattttgaattataagctatttattccttatataagtgttacatacatgtaaacatacaattttgaattttgatataggagtatgtcgatttggttaacgccatgtgttgatggactatggtgcccacctacgatatttgtagagtatgaaaaacgttgagatcatatctagctagcagacaagggacaagtgtttatattggttcggggccttaagatgactaataaccctacttccatttatatgtatatcagggaaaaagtagattacaatcaacgactagggctttggcttcctccgaattgtatctcgatattgctcttgttatggcttgtaattcaatatcctccccttattgggaccctgtatttatagggatgatcatctttttctcaaagtagaaatcagagaacctgaattagatatggtccaagaagaccttattttctctgaatatgactttgacatcttctatccctagaaaacaatttcctttcggatcaccgtattaccttaattgactatatattcctgtatattattaggtatgtggtactttcatatagcacaaacccaaatataagaggtatgtcttatccttaacagttaacactaatagtgtggttttagaaaacttttggaccataattatgtgtcacatgctaaaatctatggttttatgtaaattggctcatgataagtggggttttataaaatttagataattttttacctagcttaatattactgttacaggaagatctgtgatcgagacaagagttgttggctggaatagacacaccacataataatctctatttggcaagcattacaacggcagcttaattttaaaccaaacaaaatcttgatctttttaaaaaaacaaaaaaaaagaagtaacgacagcacgtacgatgcatgagaaggtgagttgttataatcaagcccacagatatatcatatatagcggtatacccctgccgatcaatggaggcacgtgtagaagaggcatcaaaatttaaataactaaagcatgcatttccaccaagtatctccatccatcctaaaatataaggcagaagattttggtgaataaaacatatcctaataccatgaatatgaatagagagttgtccagattcataaggcttgtttgggggagcttaaaattttgagaagcagcaactgagaaactagctagtgagaatctggagaagctgggaaacccagcttctgtcttctagttcattttccagattctacaaccacaaattcttagaatttggataaaaagctggactgttttggtgagcttctggcaagtggtaagtactggagattctaggagaagctacagctgctaaaagctccccaaacagacccatagtagcagaatgtgtctcatcgaatatcatagtcctttttatattttgggatggagaaaataagtgttaaacaagattgaagaaatctaaaccaagccagctgatcttcacctactgcatctactacttctgtcagcttcctcagagtccatatatatcccaacttgcagcgtgtatgccgtaaaagtatctagtatggactatggattacttcattacaaattaacccattacccatcatatgcaagatcagtgtaatcatgtaatgtaaaggcacaatctcgtgctgttttcccttaaaagaattgtaatgtaaagtgaatactaaactgatgaacacacaagatcagctaaaatcaattaactaatcctccattgctagctagatgtattgcatgccgcatgtgcagatgtgctagcttgcagagctagttgtcttcgtcttcgtcttcgtctttgtctagagatttgtctagggagtagagacgacgatgacgacgacgaaatcatcgaactaaacacaaccaccaccacccccttgcctttttatgtagatcaccctatagctacctagctttaattatatcgataaattaactgtggagaatatggatattccatatctacatgacagttataatttaatcggatatacggtaccaaatatagatagaatatctttatgaagactcgggttagttttttacttgtatgtcaaggaaatacccgagatcttagtcggttacaattgtattttatctataatcccatattccgttacgataagagttgtattttgtaaagcggactccttcccctatataaggatggtccgtgtgtctctcggggcgcgattcttttttccaatttatacaatcaataacgtactcggcggaatcatccccggacatgagtagggtattacttcatgaatatgaaggcctgaacctgtataaaattcattgtctccaaaaccatcaactttcctagcttgatagccacccccttttattattgccgaaatcttgtttcgacagttggcgcgccaggtaggggcagcgtcaagtttttgccgactaagtgcgatgggttccgtttctggcatcgacaacttcgccttccctcccgggcaggcgttctggttcggcagcctcaacttcatcaccaacgacttcggcaagatctctctccttgactcggattcgaaccagtcggggagagaccaggtccccgtgccgtttggtattccgaactcggccgaggcctactccaagatcatatcttccgagtcggcttcaaaccactcggacgagatccaatctactcctccgcgaccagatcaagacgacgggtcctatccttcaatcttgatgaaacttcctgatgacttggctgccgtcttcacagccaaaacatctcccactcggagatctaggcgagctccggcatcggccccgatctagtctagatccagggaggttggcgttatactccaacctcttgggacagtctcgacggaagagatggatggctacctcagctcccccggcgtcagttcttgaccaaccaagatcctcgactacgacgacttcggctaccactatgaccacggcgacctcgacaacttcgacgacagctatgaggataactacacgcccctcttcttcggcgtattcatggctgccaacgaaacggaggaacagcgccgagcccgagaagcggaccaagatcgcgcacggcaagaagctgaacgtcgccgactggaggaagagcgacagcgacaggagcgagaacgactacagcgtgagcaacaagatcacgaaaggattgcaaaggaggctgaagatcgacggcaacgcgccttggaatccgggcggcgagcgagatagctcattgggcaacaagacgtcgacggaacagcggtctttcgcatcccccagcagaacgcggttgcagcaatcactctcctcgacaccctcctcaaggaagacgcactcaactaagctgatcatgttgtcaacatcttgaaccagacgaagaccatgatcgctgcctcggttccagccaactctgcaagcacccgcaccccgactagtagccaagtccctcatcttcgatctcaagactatcaccagccaagcctcagcattgccggcgccggatctagtcgcaggagcagaggacatgatgaacggtctgttcgttcgcctcccgaacgatatagggagcgtcgagttgaacgaccacactccccacatcgaaggcgccccatcgatcttcgcgacaccatcaaccagcgccgcgcagcaagaggccaccattcaccagatcgttatgacgatgatgtggacggcgttgctgccttcacaagcgatctgcgtcgagtggattggccagccggctttaagccgactgaaatcgagaaatatgacggcaccaccaaccctgagtcttggctcaccgtctatggtctcgcaatccacgcagcaggaggagatagcaaggccatggcaaactatctgcctgtggctctagcggattccgcccgatcctagctccacggactaccccgtggcatgatcggatcatgggcagaacttcgtgatcacttcatcgccaacttccagggcacctttgaacgccccggcacacagtttgatctctacaacgtcgttcagaagtctggagaatcccttcgagattacatccggcgcttctccgagcaacgcaacaagatctccgacatcaccgacgacgtcatcattgccgcctttactaaaggcattcgccacgaggacctagtcggcaagttcggacgcaaacctcccaagacggtcaagcagatgtttgaaaaagccaacgagtatgccaaagccgaagatgctattacggcgtccaagcagtcaggcaccacttggaagccaaagaaggacacgccgaccgcaggagggagtggaagtaacaaccgcaaggatcgcaagtgtaagcccgaagaacttgtggcaacaacctctccatcttcccgacaacgtccccgcgtcaacacattcgacaagataatgaactcccaatgtccgcatcatcctaactccaaccacgtggccaaagactgcttcgtctacaaacaatttgcggagcaatacgtcaagaatgcacttaagccttcaaacggagagcaaggcacatcaaagaagaaagacgatgaagacgatgccccgactggttttcaagatcatcgcaaagaactcaatcacatcttcggtggacctctggcttatgaatctaagagaaagcagaagctaacagaacgggagatcaatgtgattcagcccaacatgccccaataccttcggtggtcagaaatagcaatcaagtttgaccgctcggatcatcccgaccgagtggtccacccggggcggtaccccctggtactagacccagtggttcgcaatgtcaagctccgaagaactctcatcgatggtggcagtgcactcaacatccttttcgctaagaccctggacgatatgcagattcctcgcacggaattaaagccgagtaatgcatccttccacggtgttatcccaggattatcagctacaccactcggccagatcactcttccggtcactttcggcactcgggagaattttcgcatagaaaatgtttgtttcgaagtcgctgatttcgagacagcgtaccatgctatacttggatgaccggccctagccaaactcatggccgtcccacactacacctacatgatgatgaagatgcctggtcctcgaggagtcatatcactacgaagcgacatcaagcaagccgtcacatgtgacaaagaacgttgcgagatggcccagacccgcgagattacactcgaccgagaagagatccgactggctacgaccatggcaagcgaaggagaagtgcccgcaaccaagatgctcaaaagcggagaaagcaatgctaagacgaaaaagattcccttagatccctctaatcctgataagactgctgtaataggcgctgagttagattgtaaataggaatgcgcgctcatcacctttcttcaaaataataaagatatctttgcatggaaaccatccgatatgcctggtattcctagagaggtgattgagcactctttacatgttaaggaagacgccaaacccatcaagcaacgactccgccattttgcacaggacaggaaggatgcgatcaaggaggaattaaccaagctgttagcagcgggcttcatcaaggaagtccttcatccagactggctggctaacccagtcctggttcggaaaaagacggggcaatggcgcatgtgtgttgattacaccgacctcaacaagtcttgccccaaagacccttttgggttacctcgcattgactaggtggttgactcaacggcaggctgcgagttactcagtttcttggactgctactcgggatatcatcagattcgactgaaagaatccgactgcttgaagtcctcgtttattacacccttcggggcctactgctacatcaccatgccctttggattgaagaacgcaggagcaacctatcaacgcatgattcagagatatttctcgactcagatcggccgcaatgttgaagcttatgttgatgatgtagtcgtcaagaccaagcagaaggatgacctgatcacagatttagaggaaacttttacaagcattcatgctttcaggatgaaactaaaccctgaaaagtgcatcttcagagtaccgtcagggaagttgctcgaatttatgatatctcaaagaggcatacaggccaacccggagaaaatcaacgccatccttaacatgaaaccgccaagctcccaaaaagacgtccaaaagctgactggttgcatggcggcactcagccggttcgtctcacgactcggcgagcgggggatgccctttttcaagctgctgaagaagactgacaattttcagtggggacccgaagcacaaaaagcctttaaagacttcaagagacttctcaccactccaccagttttggcctcgccgcatccacaagagccgctactgttatatgtgttggcgacctcccaggttgtgagcacgatcctggttgttgagcatgaagaggaaggccatattcaaaaagtccaacgaccaatttattttgtcagcgaggttttagccgactccaagacaaggtatcctcaggttcaaaagttattatatggtgtcttaattaccgtcaggaaattatctcactactttcaaagtcactcggtcacggtggtcacatcgtttccactcggggatatacttcataatcgcgaagcaaacggacggattgcgaagttggccttagaattgatgtctttggacatatcgttcaaaccacgaacttcgaccaagtcacaagctttagctgatttccttgccgagtggaccgagtgccaagaagacatgccagaggaaaagatggaatattggactatgcattttgatgggtcgaagaggcttacaggcactggagctggggttgttttaatctccccgattggagaaagattgagctacgtattgtggatacatttttctgcgtcccataacgtggcggaatacgaggcgctactccatggattaaggattgccatctctctaggcattcgccgattaattgtccgaggggactctcagttggttgttaatcaagtcatgaaagagtggtcctgtctagatgatactatgaccgcttatcgacaagaggtacgcaagttggaagacaaattcgatggactcgagctcacccatgtccttcgacataacaatgaggcagccgacaggctggccaattttggttcaaaacgggaagcagctccttcagatcagatgtgttcgttgaacatctttacgaaccaaccgtgcccagaaaagagacaattgaagccatggatactcaaggcgtgagcatgatcgaagccgactggaaagaaccgttcataaaatttttgagcaaacaagaacttcctcaagacaaaaatgaagccgagcggatttctcggcgcagcagactttacattattcatgaaacttatctgtacaagaaaagtccatcaggaatactgcaacgatgtgtgtctttggaagaagaagacaattgttgaaggatatacattctggtatttgtggtaaccatgccgctgcacggactattgtcggcaaagcttaccggcaaggttttttctggcctatagctgtatctgatgctgacaagattgtgcggacgtgcgagggttgtcaattttttgccagacaaattcacctaccagcccaagagttgcaaaccatcccgttgtcctggccgtttgcggtctgggggcttgacatggtcggcccgtttaaaagggcagtcgggggttacatgcatctctttgtggctattgacaaattctccaaatggattgaggctaaaccggtcatcacgattacggcagataaagctagatattttttcattaacattgtgcatcggtttggggtacctaatcggatcatcactgataatggcactcaattcactggcggagcatttaaagacttttgtgaagacttcggtataaaaatttgctatgccaccgtggcacacaccatgagtaacggacaagtcgagcgtgctaatggcatgatacttcaagggataaaagcacgagttttcgaccgactacgtccctatgctggcaagtgggtcaatcagctgtcgtccgtactttggtctttacgcactactcccagtcgggctaccggccagtcgccgttctttttggtttatggtgcagaagcaatgttgccaagtgaagtggaatttgaatcactacgattttggaacttcaacgaggagcgttatgaagagggccgagtagacgacatcaatcgattagaagaagcccgtgaagcagctttaattcagtcgactcggtatttgcaagggttgcgccgttatcataatcggaatgttcgatcgcgagcctttttagtcggcgacctggttctgaggaaaattcaaaccacacaggatcggcataaattatctcccttatgggaaggaccgtttataattgctgaagttactcggccagtgtcacatcctgattttcgtttcaggatttataaattatttaataaattaataatagaatttatattaaatgttcattaatttacaagtgaagttaaatgtgggaaataaaatttcctaaatataaagcatggttggatttaatttttattaaattctccatggttaattatactctctggaattttctcggattcttcggagctcaattcttaattttaatcatacaaagagcatttcagtaattacccacatattaaattaatcattaaatggtctaattataatttttttaagtactttgagtgtccaagtattttcagaatttttcttgaaattatttgagcattggaagtatttttaacaattgaaagatcatttaagtgattattttaattggaaaaagtttttaaatccttccctaagtcgttgggccgatttcggcccaactctttctctctccgcgcggccgaatcggcccaatcggcccagctgccgccgcccgccccctcctctctctctctgtcaaagtctgttttgcctccctccttcaatcgggccgaggaaaatgaagcccgtcaaaagtctactttgcctccctgctacagtgtcgtccctaaccttcagccggctgcagccaggccgagcccgagccgccaccttgcgccgccttccgcctccaaatccgctccaatccgaccccgtttcttccggatttttgaggggttttgatcctctcatcctcctctatcttttcccccaagaatcggagcaaatcgttgggtattttatccgaatcaaactcgttttcgagtttatctccaaaaccgagttttgattttcccggatcgatttcttgcgggaggagtccgatctcttcaatccaaggctataaataggaccccctagtcctcctctttcgtttgccccctctcccgtcctctcccgtgacccgtagagccgtcgccaccgtgcaagccgagtcgccggccgtcgtcgttcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcgtttttctttttcctgtttttctaatagattaaatcttcggaaattcataactaaatcatggtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttacattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcatatggttttgatggttgtgctcatgacaattaaggaccggttcgcgagctactgttgtgaaacatttaccgtgccaaccacaagccagcatgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacgataattatggatgctataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagccggagcttcgctagattttatttttccgctgcagttttcttcatggtgaggactaagtgcctcttaagtaagtatttatcgttttagttaatgtgataaatctatatattaaattgtcagtttgtgtacctcggctgattcctggacgagggtttaatgcacaaataagttcggaaattactagtgaatttccgggcgtgacagccaggttcttatcgactcaagcgcgaagatggtactcccatcaacaattcttagaatattgaacaccttcatcaattttatgcttaggcattacgtttgtatctttcctctttgactgctaacctcaagtttttccttgaagttttcagtcggggggctactatgataataattgagtgtgatttttatcaattcaatttgcttacttgatttatcattgccctgtttggtctttcgacttagtcaatgaggactgaaggtttttaatagcttttgcgggttttaggctcaataaggctagataaaggcttttaagaaatcaaaagctaagtatggaacaccaagcatagcataaattcatcagtattgtacaaattgagcctccatcatcattaattatcaaaatcattgttatatcaatcagtatcagttttttcatcatcagacttatcagatccagtcggccgaaggtcgacttcttggaatctttcaaccacatcagcagcaatcttgtcagcggctttctgtgcatcgttaatgaggtcaagagcagcttcttcgctcgtcccgtctgcaaagccatcaatggcatccatatcaacccttggataaagggatttggtcatcgccaatgccagacttgctcccatacttccagcttctttgatattcttgaaataagtatctggagcgactctcagcttgtcgaagatttcggcagtatcaagtgtactcgaaccggcgttattgaagaacattgcctggatgagtggagtagcggcattagcgactttatccctggctccttcaagcttgttgatcttgtcaactaagacatcaaactgtgcttgagacttgatcttgcggtctgcatcaacagattcacattaatgaatcagcatatagaagataatggcttttgaggtattgattattggtaccttcaacctcctttaaagccgaatcccactgtcttgccagctctgccttgtcattttccagagtttggatctgcttctctagttgagatatcttggcagcttgcactacattaacttcggttaatcaagattacagagataacagcacaaatcagttgggcagagtttgcgcgaacctttggatgagccactcagttcaaaattggattcctggagcttagcaatccgatccctcagatcgtgttcattctttctggcaagttctctggcctcgtgcagttgactcctggtggtttcaagggttccaagatgaggaactagtttctcaagggttgcggttttcgcctcgtttctaagatgaatcctctgcagagcagtttaatcagcgctcgagccagacggcaaacatgatggctgaggtcaggtgtcaaggaacttacatttacaatgcaagtcgcttggttgagtgccttcttcagtaggcagacttcttcatcttctttttgccggtttattacaattccttgaggttgcaagttgtcatcccaccacttgaccagaatgggagagcacgaatcttcggcaaagtgtatccacttgaccacggtgaatttcttcttcatcaccaatcattggtcctaatgtatccactgacaaaggttagacaattgatcagagttatttgggtcaacatggtttcagacaaagtgtttacccgtaatgatttctggacgaggacgagtggattcggatgcccttaaaggagatccagatctccagtcattgctggcgtcttgtccgcgagggttgtctgcttgggtttcaacttctagaatctcttggcttggccctgcgtccgactggtttccagtcgggggctcctgattaactccggcttcggcttcggccgactggtttccagtcgggggttcgtcgctgggttctacattgttgctggcctacagattatcactcgggagatcttttgcagtcggcccggtttcttttgaggaactcgcctccatgttggtcgggtcagagtcttttccagatgggtctatatcagatggtttcctgcaagtttgattgtcagtactattatcgcaatgggtacgcatcaatgcaatgaagatcgtaatatgagttgcacctagaagacttcctgatctttggcacaagacgactggatgttttcttccttggagtagcctgcttcggcagtttattggttgcctctcggtctccaagctttctagcagtgtcgccttcgtcgtcacttagaaccagcttcctcttgcgagaatttggctggccgactggatcaggagcacttggttgagtttcagaccggattcttggtcctccgcttccctgaccagtttggcggtgaggtgattggcgttgagcgattggcggatccgatttcatcagagcaaattcctgggcgtgacatcctttattgttaactgattcaacaaacagataagaccgtattctgtgaaaagttgaagtgttcggttacataccggtggaggaggattaaaggcattgaatggcacgactggcagcaagtgtgaatagctgacaacgatagcattagagaagatcttatacatcctttccttcatgaccttgaagtcaagagaatctggatcttcacgatttgggtcgtgcttgccgtcaaattcgaaggctgtgcgagatctctctttgattggagctaaccgacacttgataaagtgccgtgtgatctgttctccctgaaggccttgttctttcagctttatcatgcgctccatcagttccactgcttgtgcagcttcgtctcccattggcagtgagttccaagtatcccgataaactggaggaagacaggagtactcggggagagcaggctcagggttttgaacataaaaccaatttgcatgccagcctttgtttgaggtcttgaagggcatggagaagtatttttggcttagcgttccccggagttggaaaccagcacccccaacaacacatggtttgcttttgtttggctggggcttgaggaagaagatgcggcagaacaaggcgaaatgaggcctaatgcccagaaaagcttcgcaggcatgaataaaattggcgatatgcactatagagtttggattcagatgatgcaagctaatcctgtagaagttcataattccccggaagaaccttgaggttggaagagaaaatccgccatagaagaaatgagcaaataccacgatttcgtgtgtatcgggggtcgggaatgcttcgccgaatgctggtcgccatccgatgatctcctttgctggaagaacgccgtgcgccaccatctcctttagattatcttccgtcacatcggaggacgcccactggctctcgaagctttctctctcttccgccatgaatgtggactggatggtttgatttggtccgagatacggctggaaagggatggggaattggagcggtggatgcgggtagaaattttgtggagtgtttgaggatggattggagcggattgctgaaccctagcttggccggcgcagtttgtactgtagcaggaaatggggaaaatggtgagagtctcggcggggaagacgaagagacatttttcacttcggtgatattagagtatcgggagcgctagcaggcctgggccggcacagtacttcagcccaattttatttccagcgtggcccattgtgatccttagggacttaggcactttttgctttggcaatttgtgctcacaatgatgtggtccaatgctgttaaaaccctttttaatgcggtttgataattctttggaattaacacgatgcaaacaaaaggtgcccgacagaaaggtgttataccatttttgtaagctttattaggctgcaaaagctgtttgggttgatttgagatgactggtttactaatagttattcttttagcatgttatatgcttattttggttattgtaagggtcacagcctaggctattagactcattaattaccgtgattttttatcatgtttggtgaatcattttaagagtttcttactcggattcctatcaaatatgtctatttttggaccttttgagtgtttatcactcggccctttcatatttttttatccttgatatgttcaaggagtgttgataaaaccactcggttcttgactacgtgtttagtttttcaactaattacatagtcgggggctatacctaattaggtgcatctactcgatgcaccatgttttattttcgcccttcgcagtctttgattttagcactcggcaaactggagcaagttgaattgaagcactcggattgctgttttttgtttcgagaaggttgttttgtcaactgcgaaggtctcgggggctactgtggagaatatggatatcccatttctacatgacagttataatttagtcggatatacggtaccaaatatagatagaatatctttatgaagactcgggttagttttttacttgtatgtcaaggaaatacccgagatcttagtcggttacgattgtattttatctataatcccatattccgttaggatatgggctgtattttgtaaagcggactccttcccctatataaggagggtccgtgtgcctctcggggcgcgattcttttttccaatttatacaatcaataacgtactcggcggaatcatctccggacaggagtaggatattacttgttgaataagaaggcctgaacctatataaaattccttgtctccaaactcatccactttcctagcttgatagccaccccttttattattgccgaaatcttgtttcgacattaatctagctaattaagcaatggcagcctcgtcgtccttcgtgctcgcggcggcggcgctactcctccaggccgtgacggcggcggcggaggcggcggggcagcagaaggagatgcggatgcgtgtgtactggcacgatgtggtgaccgggccgaactcgacggtggcgaaggtggcggaggcgccgacgtcgagggcctccgcgacggtgttcggcactgtgtacgtcatcgacgacccgctcaccgacgggcccagcctgacggcgccgtcgaggctggtcggccatgcgcaggggatgtacgtgagcgccgggaaggagacgatgtcgctgctgatggcgatgagcttcgtgttcgccgccgatgagccgtacaacggcagcagcgttgccatcttcgggcccaacccggcgaggccggtgagtgagatccccgtggtcggcggcaccggcgcgttccgcttcgcccgcggctactgccgcgccaccacgtactggtacaacgccgccggcgacgccaccgtcccgtacgatatccatatccgccacgattaactgattcattattattcctttgtgtcaaaatataagaacctaattaatatcggataggacgtatgaaatatctaatccgatcatagaagtttatattttaaaacggagggagtaattagttagccaggtagcgatacgttgtgtgtcaattactactgtatcatgtactacctctccatcccgtaataaagttcattttaattagcaccttctatttagcataaaataaatttatttttagagtaattattaaattagaatttattataataaaaattattattttaaaataaggtgaaaaatagttacattgcgatttgataaattaagagtaatttagctttcttggttttatattggtatacatgagatggatgaaaaatgaaattattttaggatgagaatagtattaggtacatggggaaaatgattttatctctcgagggatatccctagtttcgtgcataccacctaatagtcataaaaaatatgaaaagaaaattagcaacatagattaatataaaatatatcactccacaaacataagcaagttaaaatttaacttctacaagttataacaaaaataacaaatatagttgcgaatatacgataactatttttagtttaatttgttatttttgttacaacttgtagaagttgaatttggtcttgcatgtttgtggagtgatatattttgtattaatctatattataaatttttttaaaaaattttataaatatttagatggtatataaataacgaaggatgttccgtcgaggaatgaaaatccgtatcctagctacatgttgcatgcgggcatggaacccaaaacaaccatcaacattttaacaaaacaaattaagataatatgttacgttgtaatgagtactccttattaacatagacgtcacgtcagtcatacttcgagcttgatattattttgacattttatttaatgagaaaatatattatagttgactttaccgttgagtatcgtgattaaaactctggcctcaaataagatacgtcaagcgatatgggcggctgttaacagtgaaatttgataatcggtaaagacgccatccgcttagaatcattatcggctgcagcatctcggaatcagccgatgggagttatcaagtcgccaatagtcggattcctgctatattcggttaaggaaatcaatctattaaagggagcttatccctaagtgaccgagtttaaagaggatacggcatggcagtttatctattaattaggaatagtttgttagtttccttttatctttaggaaagtgtgtttagtgtccgataaggactttatattttccttttatatttaggttagtttctttcttatctttaggttagtttctttcttgtccgacaaggacttgtatcaacccctgggtataaatatgtacacccggggtctatgtaatctatctccacgatcaatacaattcggagcatcgccaccctttttatttctacttttgtttttacgtttcggcggaacttggcacccgacgcggggctgcatcgtcttcgatctccggtgaagggataagtccaatattccatcggcccaggcaattgtatcgtttacgtcggcgtcgttgaaggctgcatcagtacattcgacctcttggattgctctggtttggatgatatacttgcctatctatttatcatatatctctgttaatctagtcttagcatatcaatttagttctatcggctgcttctcattttagggtttctgccggtatcggctaaatcgcgttgctagattagattagcttagacatctaccaccctgaaaactcagtcaacggcttgattgtctagatattatatttcttttcatacttagtgctgcatcagttaagtttgatctactaagtcgtgcttagaactataatctctagcctgcttcttgattgccaataagtgtttcatcggggtttcagccggtgagttatctggacgttgcatcggctcataaggattgcatatacatataagttggatttagccgatgacaacaaaggcttcattgtttaagctaatcttgtggatttcatgacatcggacctccagccgatgtgtgctttgaccttcggatcgatgcttatttatcatatcattatttgctgattggtttatacttgattacattgttattttattacatcatcgtcagccgattgcctttatatcattatctacattggacatatagtcgattgcttaaaccctatcgctatcggctggtatcggcatcggctattatcggcatcggctggaactactccatcggcttgtcggccgatcggctgttttaatctactatttgcatatcttgtcagttgcaggatcaaactgactggcacgctcgcatctcaccaatctttggacctgcactggagttaagcagatctcccaggccgatgtgttcgattttttcgtcaacagctttagcagtccctgactccccctctcattttccacacgtatgtttttcaaactataaaacattacgttcttttttaaaaaaaattctatacgaaaattgattaaaaaatcatacttattcatttattttaaaaaatagctagtagtgcttaattaattacgtgctaacgaccgcccgttttcaccaacgaaggcagcccatggtgtctcacgttttatgtgggccaattaggcccatcaagtagccgtcatggtcaaagactcaaagttgaccacagccagccgttagatctaatctgaacggttcgcgttgtctcggaatcatcgcctgcatcacacttgacctgtggacctatggtgcgcgcggcggctagcgaaaccgccatggccgcggcgacgatcgagatcccgcgctcgccggcgttccggctgcttctcgtcaccgcggcgaggaagaatctccttccgggcggcgatcctcgcgctcgccgactcgattgccggccgacgtggggagcaacgcatcgctcgattacacttacacaatccgagtaggaatcgaagtaaacctctctgtatttaatttgcaaggtaaatttgcaaccgacccatcgagcgatcgatctccgaacgaattcgatggcttccacgtcgaggaaacgttcggcgcgtagcctgcaagaagatgagcagacctcatcggcggcagaggcgccggcggcggtgcgagaggacgaggagcgggttgcggtggcgggcatggaggcgtggaggttcgggttctcgagattctcctggtttcccgcgttcaagttcgaccccaccgacgccgacatcgtcgcctcctacctcctcccgcgcgcgctctacggccgcggccacgccgccgttatccaggacgacgtgtcgaggtgcgagccgtggacgctgatgcgggagcacggccacgccaccagcgcgcacgccttcttcgtccacgaccacgagagcgtcggcggcggcggcggcggcggcaggcgcaaggtgcagcgcgcagtcaagaacggcggcggcgtgtggcggatccagaagggcgaggtggcgatcctcaccatcgtccgcggcggcggcggaggcggaggcgagctcgacgtggtgtacaagcggcgcaacctgagcttccaccgccgcggcgagagctcctcctccggatgggtcatgcacgagtacgagatcacctcgccgccgctccccgccaccgtgctctcccggatcagggccacccccagggccaaggacaagaagctgtgcatcaaggaggagccctcctgctccacctccgccgccggcgagcgctctggccctaacccagaccacaccgccgccggcgccggtgacagcgccactgccaaccacaacaatacaacgtcggcggcgacaacaactatggcagcggcggtgtagtctaatattatccagaccagccgggtccgagccaccaatatggttacggcgagcaggtcgccggcaatggctttgtggccggcgacgggtggcggcggcgagccattgcacttgtgtgaggactgtgacggcaataacgtttatggctacggctctttgacagggaagagccgctgccgcgagctgactggacaatgtcgctggcctcgagagcagtcgatccacctccaatggcctcaggagtgacggatccaccgtcggcggcacaggaatggtgacctccatcgcctctccccgtccctcgcttcccacggttgagctttgggtagtggcagcacgcttcaggctcgttggatctggtggagctcgacgtgggggacaatgatgacagcttcatcgcctcttctcatacctcgctttgggcagctacgacgctagccttcaagcttacccgatttgacggtggctaggggtataaattatcttggagattttatggctaaaattcttttgcaggagaacatcttcacatgtccgcttacgaaaataagattttgcatgtggttacggtgccagcccataacaatcagtatttttatacatgtttggcgtctgtttgaaaaagctgaatatatatgatcgtttgagaaaaagctttctgtaggagtgcctttctctttagagtgttgtctgttgtagacattggctttaacgagctgtaaataagtattgtacagttacaatttctgtacgatttaattgccaatacttggactatagacaaaatatttttggactgaactataaactgatttgtttttctgttgacccgacttgacccggaataagcctagcacaaacgaagttaaactagaggccttgtcagcaagaacttctaagcgttcaaaaaaaaatctgttgatttttgaacatacagaagcaacataactttgctataattctgttatcacaatttggatagacacgtacagacgttccaaagaccaaaggtgatgatcggagcatatttaattacatcaatagatttctagaacatatataccgaagaagcttggaaattaattaaaccaagcatgccttcatctcaccaaatacctatatacgcggctacgcgtgctaatttcaccttaaaaaagaaaagaagaagaaaaccccagagatcgatgcgagtagttcatacgtaccaattcacagtcagcacttcacctactgcatctgttgccagcttcttcaaaagtccgatcaccgacccagtccattcctaccctctcacacgccaaaagaatttaaaataaattaacatatccaacttgcatgcatgcacgcaagaatgccataagaatttctacatgtagttaatccaagcatgcaagaattattgaagaatgcaatgtaaattaatcaaagtctaaattgaacacacgatcagctagagctaaccttaagaaggtgtcagaagataatatattttttcatcttttagagaaggtattatgagatatcgtattttttatgtaaaatttggtatatcttcaactactagatattccatgataccaaaatttttatgtgtaaataatttagatatctcaagatgggccaaaagtgatcatttttgcatgcggaactctggcccgtctaccaggaaagttatgaaaaaatctctctttttctatgctagtggagcacccgcatacgaaaattcaacttttgcatgcgggtgcttatatcgtccgcacttaaaaataaaaatctgaaaaaattaaaaatcgcaaaaaaattctagccaccgccgccgggctcctccctctgccagcagatccgggcggtgcccgccgcccgctggatccgcgtgggagccgctttcgccacattcgacgtgtgacggagcctgccgccgtgctccatcgctgccgctcgccgcccgactgttccgtgcaaggaagctgtcgttgcctccttcaacgtgcgggggagcccgccaccgtggtccgttgctaccacccactgcccgctgtcagccacgccatccgccgcccattacgaggccggcggaggcggatccgctcgccgcttgccgtcaaccacacagcccgctgctcgttgtcagccgcgtcgcccgccacaaaaatatatttaagaggcccgcctgcgaaacgggcgtctctttgagaggttcgcctgtaaaaataagcttattttagcgtgcgaatccttaagaggaccacttgtgaaaatcgatttttgcgtgcggtcctattaaggagctgtatgcgaaaatggagtacgattttttacatactggactagttacggtctgtctgcaatctaaagaggatcttgtctagaaaaattatttctgtagtagtgcataccgccatggcaaggaatggctcgctctttcatctactcgctggattggagacgtattgtttggcggcggccggtggcggtggcccgtgcggtggccgggcgcaaggaggccagcagcccacggccgggcggcgacaacagcgactggattttttttattttgtgaatttttgtagtgaatgatgaatggtttgtatattttattggatattttttttgttgatttggggatgatctcacaagatttgtagattgtggatgtgtatgtattgtggatgatttttgttgtgcttgatttgtggaaatttttattgtgcatgattgatgatttgtgtggatttggctgggggaatagatacaagcagcaaaaagaaacaataaataaaagaaaaaaaacagttgggatgtggcccctatccatctttaaagatggatttttaagcccggttatttcacccgagactaaagatacctatctttagtcctggattcgtccttcctgttgtaaaaccgggagtacaggggttccgaagagggagtaaaacccctttctccactagtgttaactaatttatcctccattatatttctaacctgactgtttgcatatatccgaccatttttgcagtcgccttcctcgccgtgtagacgacgatcgaagaaccttcgaatccagcacacaccaaccacgtccccgacctccccctttaaattcacccatgcacacgtcgtcgcaaatcacatcacacagctaaagctagcttaatccgaaccaagcaatggctgcctcctcctcctccttcgtgttcgcggcggcgctcctcgtcctggcggcggcgacggcggcgcaggcgcagagggagacgaagctgcgggtgttctggcacgacgtggtgagcggcgggcccaactccacggtggcgcaggtggcggaggcgccgacgacgaacgcctcggcgacggggttcggcgcggtggtggtgatcgacgacccgctcaccgacgggcccaacctgacggcctcgcggctggtcggccgcgcgcaggggatgtacgtcgccgccggcaaggacgcgctgtcgctgatgatggcgatgaacttcgtgttcgccggcgacggcccgtacaacggcagcagcctcgcgatcctcggcgccaacccggcggagcgcgccgtgcgggagatgccggtggtgggcggcaccggcgtgttccggttcgcgcgcggctactgccaggcgacgacgtggtggttcaacgccaccaccggcgacgccaccgtcgagtacaacatccatctccgcctcgattaattcattcattcattctcattacttgagacgatgatattgaagatgatgatcgtgttgatcagttcattttactgccggtttttgctgtgtgttgaccagttgattactagaatatataagctgggtgtggtgtcatatgctttttttttccctgtaaaaaaacgctagctatgatttttgttgttgttgttgttggtaggggtgtattcttgaggatgattattgtttataagttcttaatgtgttttagaataatgagagcttcattagcttacctttgttacaattttttattttgatggatggtaatattcctccaagatttttgtgcacgccttggttcacctaacactgaccatcccgtcaagataacatatactcaaaataatcatggaaaattttccccactaaccgagcgtcgtatccacacaagtgttgccgtttccgactctaacaatatataaattttagttttttctaatttattcgatcttcttgttgacactaaatagttggtcaattccagattaatcgataatatttttcgaacagatgctaccaattctatccgtttctatccttagggagcgttcgttctgataagttagggtgagaaaatacatcatagtccacgcacacgcttcccaaactactaaacggtgtgtttttggcaaaaaatttctataggaaagttgctttaaaaaatcatattaatctatttttaaaatttaaaatagtttatactcaattaataatgcgctaatggctcacctcgttttgcgtatcttcccaatcttctcaatcccctatccctcaaactcacccttagagcaagtttaatagtatagcccactactagctccaattcatctacaactaatctaatagccaattcatacaatagttgcttactatactattaatatatggtcccacatgtcatgcacacattgcgtcttggaatccgcgctgcagctggctacagatctgtagcccactgctcttctctctcatcttttatctcattaaaatatgtttacagctagctaatagcctgctattgtacctgctcttaggcttcgttcgttcccaggtgatctgggagattgagagagaaaacatctcgttttccgcgcgcacgcttcccaaactactaaacggtgtgctttttgcaaaaaaattctataggaaagttgctttaaaaaatcatattaatccatttttaaaatttaaaatagttaatactcaactaatcatacgctaatggctcacctcgttttgcgtatcttcccaatctcctcaatccccttcttctcaaacacacccttaggctgcgttcgttcacaggagacaggggagattgcgactccttttccatgcgcacgcttttaaaactactaaacggtgcatttttttttgcaaaaatcttctatagaaaagttgctttaaaaaatcatattaatctatttttgaagtttaaaatagttaatacttaattaatcatatgctaatggctcacctcgttttacgtatcttcccaatcttctcaatcctctcttcctcaaacacagcctatctttaaaaatgtttatgttttgaaatgaggtagtagaaaggtcagcagcagtgcacccggaagaggaagcttccatggcggatgtagtatagtgtgaaaaaacgtaagcatggccacgtgatgggtaagtagaaacgcggcatgcggcagctggtcaatgcattccacgtctttcagggtcaaattcaaataatccatttttttaaaaattaccccctttcgaacatgaacgatcaactccaaattagatccaaattaattaacacataaacgtacgccatcaggtagaagaattaatctcgctccaaattataagcatccgtacgcagttattttccatatctcctgctccatgaaaatcgaccggccaataactttgttcatacgcacatgtcattctggtttctggagtctggacatgcttgcgttcatttttttttaaaaaaaaagattaatgtattggagtatttcatctatctagcacttgtcaaaatgactgggccgcatgcagtttggaccatcgcccttcaggcctccaaagtaaagaagcagccataatctgaaggcccatctgtgaagtgggtcgggcccaacgcggtgcaatttgccgaattgtgaagctgcggcccactacgcagtgcgtacggagtttaattctccgaccctctctttctccttcagtcttcagaggctcagtggcaccacagctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15844 - DNA, 696 bp, Oryza sativa
attactataaaagaaaaaccttaaatcatttattgtgcaataaatcccagggctgacgtcagcacggaggggggggcggcgccgacatgcggggcccaccggtcagcggctcgggagagggaggaaggggcgccggcacgcggggcccaccggtcagcggctcagggggggaggaaggggcggcggcgacccggctcggcttggctcaaggccgaccgaccggccgcggcgacggcgacggcacgcgcacacgcgaacgcgttaccggcgacggcaaccggcggacaggctttggggtgccctaaggaaggaagagagagagattagagagagggagatgaaccacggcgaccggtattcatggccgaaagcggcgatagcggttgaactcaccggagcgcgaggggatgcgaattccggcgacgaaactcgacggggaaggggcggccggggtagagcttagcctcgcgaacccgacggcggggacggcgcggtgcggcggcaaccctagcggcggctagcggcggccggagtagtggaaacggcggcggtgggtggttgcacggcgcgggagcgatggggagctcgggagagttcggcgaaatggggaaaaagcgagagggggcgacggggaagcctaaataggggaggggagccccggacgtggccggtaggggagggatttcgccggccaac

SEQ ID NO: 15845 - DNA, 19784 bp, Oryza sativa
tcggacatgcagaccggcagtgatgaaaatgtacaaggaaagaagagaagacaggaagttaggaactatctctgcctccatcacatcctcatcactaccaccataccatgccataccactaccaaaagaacatcattatttggtaactagtcatgtggaaaagtttccatgctttccccacatttgaaaagcaggaagcttaaagcacatttaggtgttatttgcaactacccagcaccagctaccagcatctgcaaccccaccaccaaaatataatactttaaatttgttcaacttagttttcaggtagcataaaagctctaatatatttgtcaatgtgtacaatagttatacacctccccaaaagtaacagccagtgacaactagtttgctatcatttacatcccatttgcatctttccactacttggagtcgataacaatcaatggtcaagcagtcttaacctcagtggctagggaggactttctcatatgagctaatacaacagatggtgcttgctacatcatcctccatgcctttaaagaatgaataccttggaatggcactatggcagtaataataacatggtgctaataatttcattttaccaataaattttgtggaaccatgtcatttatagaaacagatgtctcatatcatacaaagatgcagatattaggttgaaggatacaaggataaatatagatgttgtaacgaccaacccaaaaacagcaactttagctgtctctgtgaatcctaagtaggtttgtgagacaacttagaattacgatatgattcaagtcacaaaacggtggcccataacataccgtgataggcaaattctccataattcagaataaacaaaatgaaaaacttttcaaactagaaatatggccatttatgaaattctagccctagcaatatagcctgtacagcagaaggtgtaattctcaagcatatgcatcttaaattattcaagttaccttcttcaatgaaaactgagagaccaaaatcagtggctttgagcattgcattctcttctttggttgcaagtaagaagttctccggttttaaatcacgatgcatcactcccataaaatggcaaatgttgacaacattcaccactgccctgcagatggtagcagccgcacgctctgagtagtgccccttggcaatgatccgatcaaacagcttcccaccagcgcagagctccatgacaacatggacattgctcttggccttattttcttcccggaacttgaccatggtttggtggtccaaataggccgcatgaactgaattctcccggcaatggtcctccttgtcggccttgctcacaagcttgcgcttaaagatggatttgcaagcatactgcttaccactagcgatctccgtgcacaggtatgtcaccccaaactgtccccttccgagttcctttccaagggagtaaaccgagcgcacatcgtcatacggctttccaagaattgtgtctggggtgggcttcggtggggcaaccacaggtgggactaccggagggttcattgctgatggtgtgtacctcacctcagctggcggcggcggctgaggatggttatagctaggagttgtctgagcaggttttgtctggtgagaatagccataaccgtttgctcctcctcgaccagaatctggagacgtagctctgctgcaacacgaccccatttttagtcaaattctccctagcagttgtaggcttgcaaatttgttactccgcaaacgagatcaaccctgcaagcagaacccaagaaggaacactttatgtcagaattaagcgagccaattaacaaagatttgcgctgaatcaaaggactagtgtgaaaactaagcgaatccaaccaacaaaagattcatgcacaaactcatccctccgcagaagcaatgaaagaaaaaaaaaaggaaaaatgatccaaatactggatctaccagcaaaccaaacaataaactcaacacacaacatcagaaggggaaaacaagcaacgaaaaggaaaagaaaagaaatgcctttgacagcatattgacctcaatctactcccagtcacagcccaggaccgcatgaaattcgcatgaactgaggaacaaggtagatggcgagtccccctttggtgacagtggaagcaaccataggagataagggcacaagggtacacgcaaattgggcaaaaggagacaaataaagcagcatctgaaagcaacgggaccagcaaggcacccagcggcaagagagagagagggggagctaaaccactcacgatcgctatcgtaaaaattgatcctttacacgaggaggaagcgataataaacaaggtacagtgaactagagcttcgtcctctcgtaataaagaaagaaagaaaaaactgtaaattcaccgattacttgttcggtaaaaaattactgtctgcatcagaaatctactgaatccaagaacataacccatgaaactgctaaaatcgagcacttgtggacatgtgaggcgctccagtagctttgcaccgctcccagatccaaaagggccaagatttttctcacagttggatcaaatcctcaatcactgaacctccttccaagaagaacagattaactcctaataatctctgcaacgaaaaacaaatccgcgagactacaagcctctcgaaccaaacaaaccaagaaccgaaaaacagagagacgcgtacccaagcgaaaggagggcgcctaacctttcccaaaccaaccaatccaacaatccaaggagcacagccaccgccccggtagtgtcagctggtacaagaatccgcggtggcgcaagaacaagaagaaggaagaatcaaatctcggcgtgggggaggacagctcggcgcggcgaccgcgtggtggtggtggtggtggtggggggggggggggaggtggatttggagctggagagaggtggtgatcctcgatcgtgacagcgactactaatggcgatgcacacggcgcacgaatcgggagaccacgcgaggaaaacaatgaggagaaaaagaagagcgcagctgcctgccagctgcaactgggtttgggtttgttgagaaagaagaaagaagaggaaagcttgcagtttcaagttgcttcctgctctgctcgtgtgtttttttttgcagttttggtcctcttggagatggaaaaggatcaaaggaaaggagtggtagttttccataagagtccctctaattactactccctccgccaaaaaaaacaaattaggattagatgtgatctattctaatacaataaatctagacatatatactccttccgtcccaaaaaaaaaaaagccaatctaagagatgtcacaacaacgaatctagacaaacaacgaatctagacaaagagatgtgtagattcgttgtactaggagaaatcatatcccctcctaggttggtttttttgggacggagggagtatgtccagatttactgtattagaatgtattacatcatcaagtattatgttggttttttatgggacggacgagtagattagttctatagaaattaggactgtggttgagcagattttgagaagcaccagatagaaaatacctaacttctagatatcatcattttctacggggaaaagtccaaatatcccctaaaaaattttgggtggaactgtagaagcccacgcaaactgaactttgaaatcgaacattcaactcagtaaactttacgacaccatttatataactccataagatgtttttgcacagtagtgtttatgttcaattacatgacatacacattaaacatgtatattaaaatctacacttagatctttctttttatcccttgttagctctcacaaatacgaacataataataatattgatatcattgtataagtctaaattatacaacttgtaactgataatatgcaaaatgttatattagatattcaaagttgttcgattaagatttcaatatatgcaaaaccaccttagacggtaatatgaatggtattgtaaattttagggggttggatgtccagtttaaagttcaaggtactagatggactttcatctaaagtttagacggtaatatgaacggtattgcaaattttagggggttggatgtctagtttaaagttcaagaaggtgctagatgaactttcatccaaagtttagaggagtatttagatttttctttttccttttctatattatataactacagtgccttatataatttaagacgagagatagtccctcgtcatttgctcgacggtaaagctctggagaaaataaacgaagaattacaaaaatatgaataaaaattttctagatgttgttagtgatttaaaagctaatataaaaaaataaactatgatgacaagtctgtctttgttttattattgcttacgagacaagtaaaaagttcatataaataatttgtaaatatcaatctttaaaattcgaaattgcttgaataataataataataatataaaagaaacaaatgtggccaaactacaataaatatatattgttgtatccgacaatgaagtataatgaaaaagaaagaaatgcagcccaactacaataaataatacattgatgtatccgacacatactacattaaatatggagtactatacattgtcatatttgttgtgtgtgtgtgtatatatattgttcttttctacagggaggggaactcaacatcacgtatgtcgatgaagagaatacaaattgcaaatgtatatgctcgttggattgggcttgcagttttgagtcactcggcctgatccacgcgagcagctcagcgtatctgctcgtgatggggcgataccaagcacgtgcagggtgcagcgcatcagtggcggcgtgcgtcagcgcatgggaagcaccgcctcggtgtcctataccagcaaagcctatgccatccccaaatagccgcacctccatagctctatccatggctttgtgcttcagcaagaagaagaataagagaggaaggcaaatggtgtgcttgtactcgctgtgagtttaatggcggcaactacacactgatgtgaagacgaagatagagagtttccttgacatcggaacatactggacaagctgctcacgtcgattgggccaaagctaaataggtgactcaaactataaactcagtccaacttgcaatgggtggtaaacataggtcgtccaaagtgaaaatatagggttaccatagtccaatgtgccactttgatcattttaggtggaccaaagtgaatatttactctaatactattaaagttgtaaacatttgggtaatgcaaaaattagattcaattgaagcaagcccttcatttttacgttatccttttttttccctcaattccacgcgcttttggagtttgcagttcacagagccctagctagattaattaatttcccaacaatcagcggtttaagccagaaaatagttaatttgcttcgtggcaagtggcatctttgatggcactgtctgctactgcacttaattaactactagcaccacgttagtagttgactaggcgtctagtgaggatctggtggtttagttgaaggtttaactgtttttcacttaatattctagctgacttgaaagatatgggaatgttttggttagatgaagtagacgtcaaaaaaatatctaaggaattttcctctctttttccttgtgttgaaaggtacttgtaggagaagatttggctcttttttttcttttaaacgtgtgctaaggacgcatcaaggtagttatgcgtgggtataagtttgatgtatcatatatgcgcgtgagtgtatatgtgagtctagctttactctaataaaaatccaaccggaataaatagacattataattttcataatgtgatatcatctttattggtttttctacacaaatttgctataaatatttactcctagctggacattgacaagatcttcaaataaaggctaatgtggtgactattactagtgtaataaattatatataccattatgaaaattattttcaagacaatccacacgagtatcctgtacgcatcctaagaattttaaaatatcaatacttaaagttttaaaaaaattgacgggataaataaatatccaaaacgaactacagttgtacccagacaggatatacaacaacatcaattacttttgtccacaacgttgaaggaaaatgctggacgctgaccctttttttaatacgcatgcatgtgccactacagatgattacgcgcaatcatttccatcaatctacatcaactagcctcgatctatgccgttaaacaaatgtggaacacatgtatataaatgaagcaatccaatgatatactcctatataggttttgccatgaaaaacatatttttattcatgtttgatttatttagataatggaattcatttccgactttgcttcgaaaaagttacagacttcctttttacgcagctacagctaattattacatagagtacgtatcgaataactacgaattataaaatcacaacttgattaaaaacaagaaaactacctatactacgtgcctaaagataaagatggcaaaaatatgaataaccattgtttatcccaataacttgcaagttacatgtagtcttgttttcctcgaatcaggaaatagtatcttcggaaataacaaccgatcattgtaccgatcgaatttcgctggcatcaacgttacaaaaaccagaacaaaagatgatgttggagagtagttgtttttgcagatcttaccaccaccctaaccatcaaattgatccagcaagacatcgccaccgaggacgtcgcactaatagggggatctccaacacgacaccttcaagaaggtcacaacatctagggtgtggttgtctttgtgttttcacctagaaagtccatgccaaagcacgaaggaagggtgtcgcaacattgcctcaaaaaaaagtgtggcgcgcacgggcgtcaccgatgttagtcagatactgccatcacccttagattaggccatcccgattcatgccgtagttgaaggcatgttggtgccgccattgctagagaactgtgcttcaaccacacgacgtcgtctcagccactcacatcgctgccgccaccaccggcaccaacgaagagctcagccactaagttgcgaggtcaacagtaaatgattttgtaatgaggaaggttaaaagtagaacttagtactctgatcgtacgtactatatccattttcagttgatcctacaaaatcttaggcaatatcgcgattctatttattcctacgatcctaaaaatatcatttatgataaagtgcatcgaaagtaatatgaataaatatgctcaaatttacatatataaaaaccatttaaatttatcaaaatcaatattatatgctttaattgatacaacatattatatattttatattaaaatatgcacttccaaaatttgatagtatcccaatactatggtattattccgatcgtatggtactacaaataaaatatgatcatatctagtatctcgatactgattaatttggctgatcacatcatttggttgatcactaaaaattaatccgttcatcccattaagtacaattaaagttattttcctcctctcttattgtgtcgcatcaactcaataaatttcattcattagatctaagtttagcgctattgcccaaaagtatatttgctattaacaattggattcaagcagcttggacaaaattccaatcatatttgcagaatatggccagtactggaattaggttgtagtcattggtagaacagaggaactaattttctacgtgcaccggagttttgaaatgctagcgcgcgctccacctcagctgccgccggcgccccagccagcggcgcccatgctactccgccgcccgcagttcccaacgtccccctcagcggcctcctggccgtcggccgtcgcagccccgaccttcagcgcgccaagatccaacggcggcgcctactgggagatctcgccgccgccaccgcctccacatgtgcccggcccggcgtctgcccagctccggacagtactacccatgtctccgcgaccccagaaccagcaacacgccgcccatgttccttcgctgatgcagtacgcacttctccaggcgccatccttagcccgcctgctccccaaccaccgacgcgcccaacattgaagtccgtctttactgtgccttcgccgcgacacgacgcctaccgccgcgcctacgagctggatccgagagagcggagggacatcctcctccctagatgtacgacgccgagccctgcattcaagccgcgtcctgctttcatgccggccgagcaaggatggacgaaggtaaagcctcggcgctggtggagagagaaggggcattcaagccagagccaacggcccgattcaaggcgacaagacggcgccggacatgcgcctggaagaaggggcgctctctccctggaagaattcagagcaagaaccaggggacgctgcttcgtctgcctggccagcgaccaccgggcatcagcgtgccgcgaccccccgcgttgtttcacctgtaatcgtactggacacagggcgcgccattgcacttcccctcgcctcgcccaccgcccgccgcacccacccaccagatcagctcgcttgccaagggcagcttccccctcgtcgcaccactccaccagagctgctcgtgcctcaccaagaacaagcagatctcgcactccttgcccccaccgccgacatgccttgagtgaccgccacgacaatcctccaccacgcagagagcgccagcaagcgctggcccttcgcgctgccacgccgcgctttccgctgctgcataatcgctgagaagctgctcacctaccaccaccgccacctccctccggtgtgatggcgcaactgggcgacccggagacacgccccctcgaggatgtcgttttcatcccgacatcgcacgccatcgacggggagttgcgcgagtgggagagcacagcggcggtcacctaggcgatgtgtgccccgccatctgtcaccgccaaagacgtcgagcgcaccatcgccgacaagttcggccttcgcacaggggagctcgccgtgttgctccactatccagaggccttcctcctcaagttcaagcaccgccaccattgcgaggaagctgttaagcaggcttcgccaagggtcggggaattgaagtccacttcattcaatggcgcagcttgaagaacgccgccggctccgccctcatgtaccgggtcaagctatgcctcgacggcgtcccgatgcatctttgggcgcctgacatcaccgagcgcatcatcagccggacttgtaccctggagttggtggagattgatctggtccaccccgtcgaagccggcgacatgagagtgaacttgctctgggcatggactccgaatccgagccgcatccacaagcgcgtgtggcgcgccaaacccgcgaccctctcctcgaatcgatcacgattttggagatgccgccggagcactggcaacagggggtcaagcatctagtcctcttccacatcgaggagatccacgattacaccgcggtggccgtcgacctccgcaatcctaagtcctgcaggccggtgacacgcactctgccgtcatggcacttgggcgttctggacggtgagcgccccccgccgcgcctctttgaatatttccctcaccatctgccgccgccgctgacctataccttccgccacggccgcgcggaaggcgtggaggacaatgacgctgctctccaacaggaggctcgcgaccaaggaagcagaacagtccgggacgccattgatcgtgatggtgaacgactccatggcgaggaacaccgcgacaggcgccacgacagccgcgataatcgtggcggccaagacaggcgcagaggccgtaacaggagatacaacaacgatcacccagacgatgatctccaccatggcgggcagcgcgacaacgactacgacgacgatcgcgataacaggggacgtgatgtcacatgcgggcgaggtggcatccgcggcctggacgttaacttccggtgcgaacgcacgcgctcaccgcgcgcccgtgaccgtggcgacacaaggcggcgcgacgggcggcgtcatcaggctggctgcggtgacaaggaagacagggacaatgactgcggaaacggcgactccccccaagcggccctcactccgaccgttgcggcatcgtcctcggcacggaatgctcacctgacatcgcccccgttcgacaaggggcctctgctcccgccgcgtcgtccgcacgatggagcggggtatgaagcccggtccgctgcgtccatcccggcggcgcgggttttcgcccgcatcaacgaggccgttgcggcagcctcggcggaaggggcactgcggcagatgctagttacggccggtgtggcggtggcgcttgacaagctcgccgcgccggtggcgctcgacaaacccgccgcaaatgctgcggtgccatcaccgatggtgacagccatggcgtcgctggcgacgatcagttcgactacaaggaagctattgccgatcgcgtccacagaaaagacgctgctgtccctgaacgctgagtgcgctgcggcgccaactcttcaagacgcgcttgcgacgaatggctcgtccccggccaaggacaccgagacagcaccggcgcctgacatcgccgaattcgactccatttaggtaaccccgccacacgtcctcttcaaagaacttcccccagcaatcctctccacgccgcaggtgctgatcgacatcgccggagacacgcaggtgccgatcccccctgatgatgcactggaggtcgttccaattccagtgactgctgacatgctgggtgaaggacggcagaggagtccaaggctggcccgacagccgatggctggcctaccgatgtcgctgcgggcgcagctcaatctctgccggcgcctgggtacggttccaacggaaggagtcctcaccgacaaggcactcgccgacttcaaagcgatgttcaacaagacgcaatcgacgccctagtgcagctggtcggctttgacaaggaagacgcgaaggcggcggacatggctctggcgaattacctaggcccctctgacattggctgccaggaggagattgctgcggcgtgagcaagctgtgctctgcgcaccggcaaacggagtcctctgtctccatgtatcgatttcctttgcttccttcgtatccgcgtgagactcggacgcgcgctaccgttaagaggggcggcatcgccagacattgctactccgctattcgcagcaacttcgcgaatcagcctctccctactcggtgccgcaactccgcacccaaacaacatcgacaatgttagccaattgtggcgatgacgccagcaaacccccacggccgtcatgcctcgctgacggccagcacaaacgacgcaattctaagggcgccaacgatagcactctctgcgattgtcgacgactgggctgctgtttcgccctcacgtctcctcctaccgccctcgatgctaggtgtggtacaaaaacggcgctgccacgggcacaacgtggggcgacgcacagcgctgcaatacgcgcggctgtcatccccatcagtttcgccctccacctccagcatcaggcatccccggcccaagtcttttcaggccaaggtcttctcaaaccggcccaatttcctgggggccctcaacatgtcttccggcctaggctcatctccccccggctggacttcgtgcaaatggactcggcctcggtccatgagccagatcgaccaactagattgggccgactaccttttagcctgatagcaccgacacggctgtcacccctcggtttcgtgcacaactcccccctgagaaatactggttacacatgacatacccgatcatagacatcctctcctggaacgtccgaggtttgaatagaccggccagaagagcgacaatgagagagactcttcaagaagccaaaccccatatcgcttgccttcaagaaacaaaaatgagtaacattgatgccagactggtacattcccttggcgggggacgcctaaaatcttttcaattcaagccagcgacaggaccgctaggaacaagaggtggcatcctgatcctctggaatgaggattttgctgagctcaaagactttgtgcaaggaacattctcgctttcggccacagtctccttaaaagaatgtcagaccaccttcctacttacggctgtttatgggccaaccagagagagtgccaagcaaacattcctgagagaaccgcggaacaccaagccatctgacaattcaaaatggctggtgctcggagacttcaacataatctacaaggcttccgacaaaaacaatgcaaacctcaatcgcagacaaatgcgaattttcaaagaaaccctcaacgcttgcgagctcaaggaggttgcacttcagaataggcgatacacctggagtaatgaacaagacaacccaaccctcgtcaaactggacccgtttttttgcaacgctagctgggacacaacattcgagagacatctattacatgccctatccaccttactctcagaccactgtccgctaatgctaaccggacaaggggaggccccacgatcgagaacttttcggttcgagaacttttggatccagctcccaggcttccacgaggcggtacaagaagcctggacagccccccaaccccatcatgaacctcaccatagaatctttcacaaattgggatgtacggccaaaagactaagatcgtggagcaaaaaattgatttcgcaggggaagcttcatttacacttggcgctcgagattattcttcaatttgatatataccaagagtcaaggcaactcactcaagccgaactcacgctaagaaggaaccttaaagacagagtgttgggtcttgcagtggtggaaagagcccgtagaacacaagctacacgaatcaccaatctcaaagagggggatgcaaatacgaagttctttcatttgaggatgaatgcaagaaagagaaaaaacttcattcagaggctacgagtgggaaacatgtggaaagtaaaacacgatgaaaaagctgctgttataaaagagcactttcagaccttcatggcacacccagctccacgctcaaaagatcttgactgggacgccctgcagttaccgactttcgacagctccgtaattagtggccccatcacggaagaggaggttcacgtggcacttaaacagtctcccagcgacaaagcgcctggtccggacggcttcacaggtgctttctataaagcctgttgggaaacgataaaagatgacatcatggcggtcattcattccttcgaccggctacgaagtaataacttctcgatcctcaattcagcaaatgtggtgctcatcccgaaaaaggagggagctgaatgcgtaggagactacaggctgatcagtctcatacacggagttgggaagctaatttcaaaggtacttgcactgcgcttgcagcctcacatggggatcttgattagtcatgcccagagtgctttcataaagaaaatatgcacacatgacaactttatgtatgtgaggaatctgacaagaaaattccaccaaacgagaacgccgaatcttctgttgaagctcgacataaccaaagcttttgattcggttagatgggattacttaatcgacctcctccagagaaaaggcttcacatctcggtggactaactgggtctcaaacatcctagcctcatcgacaacaagggtcctcctcaatggatgcccaggatcacctataaagcatggaagaggcctctggcagggtgaccccctctcgccgctgctagttattttagccatcgacccactccaccaccttctagagaaagcaacagaattaggacacatgtcccctcttcgcggaagagctcccagatttcgaaccttcctctatgcagatgatgtggccatattcgtgaacccaagtgtccaagacatgacaaatctcactggcattctaagtgattttgggcaagtgacgggcctccgaacaaacctcaacaaaagccaaattgcgcctatccggtgtgatagcattgatctctccagcatcattgggatcttcccaacaggcctaacaaacttcccaatgaaataccttggcctacccctcgtggttggaaggctcaagaaggtccacattcagcccttaatggacaagtgcaaagcgcgtctcgctccttggcaaggcaaaatgatgtcgaccgccgctagaatctgcctgacgaaatcagtcctcatggagcagcccatataccacctaacatcactaaagctactagacggaaccctagaggagttggacaaataagaaggaaattcctttgggcggggggcgaaaacatgtcggggggaaaatgtaaagtcaactggaaaagggtctgcaggccaaaagatttgggtggcctaggtgttatgaacctacaatacttcgcatcatctctaaggctaagatggctttggaacgaatggatggcgtcggataaaccttgggtgggatctgtgctaccatgcaatcagctagacaaagacctcttcgcggccgcaacaacaataacggtgggagatggcaaaattgcacgcttttggagctcaaaatggctagacaatcaaactccgcaattgattgccccagatattttcgtggcctctagaagaaagaatagaactgtgcatgatgccttagcagaaaacaagtggatacgagacattgatgtctcttgcatctccgaggcgaatcacctccaacagtatgtccgcctctggagaatgatcagggatatgaggcctctaagcgaaaaccacgacagcatccgatggaacctcacagcaaatgggtagtactcggcaaaatcggcctatcgactacaattccttggggctgccaaatctaccttctatcagtcaatctggaaggcatgggcaccgccgaagtgcaagttcttctcttggctggtaacgcaaaatagagtatggacggcagacaggctggaaaaagaggatggcaaaaccaaaagatttgcccactttgctacaatgttgatgaatcggccctgcatctcctggccaaatgcaaactcacaaagaggatatgggcagaaatgcagagatggaccgggactgaccttcagatggacaattgggaaaactatcagtcagtcgagcaatggtggacactcgtaacggaatctccaaacaccccacgcaagcctctcaggaccctggtgattttaatctcgtgggaaatctggtgcaaaagaaacgcaagaatcttccgcaacaatgcatctacgccatcctcagcaaagatcaaggaggaagggagagcatgggtcaaagcaggggcttcaatcctccaggagttcgaaattttgggagatatcacttaatccctgcgttttgcctctctttttgcgggttatttgttttgctttttttcatctaaccctatatatatctcgctataattttctcctgctctattaatatataaagggcaaaacttttgccttccttcaaaaacaattggattcaacttgactggctcatattgtatcattactatacatattatcgcttgcatttattcctctttttagccataattatctctatttaatccagaggtcgattaggcaccaattctgcactaacatataactatacgccgtgttaacattctgttaaaaacaactaataagacttgctaaatggacctataattatcgatgctaccaatatattacgatcattagttcctttatgtcatgtttttttaaatatattttagttcatgctgatttgatttaagatttaagttactatatccaatatcttctaatctcatttcattgatttgcttatgtaaactttatagagattctcacactaatatatcgtctagttcacagtacattatttggtccatttgacctgtatcttgcacatttcattcagctggttgcagcagtagacacaaaatgccctggagaaaaacaaattaagggatggcagctgaggtggaaggggaatagggcggtcgggcgatgatgagaaggccacagaaggccatgatttggacgcttaattggcccggggatagcgcacatgagcacacgttgtttttagagcaaggataataatacagccagctgcttacttatagcctatctattagctaactcatatagtggttaattcttcactataaatatatggtccatatatttatctcacagattttcttggttcctgtgtctaagcctcttttcttggttcttgggtctcatctctctcctcttttctctcatccatcccagtattcagccttttaatagcccactattggtggtggcccatgcttactgttagttttgtcgctttggacgccgagccacacatggcatgagatatttttctcaatccaacgaactcgcctttaattaattgggctggttaattagtttattaattgtagcaaaaggtagcacgcacccactactttgtcctctcttgacctttggcgattaattacgccctttgattctgctccctttgattaaaaaaaaacatatgtaacatcttctagtacaataatgaatctagatagagaattatctagattcattatactttagggacttgttcactttgctactttttccgtttcacaatataagtcattctagtattccccacattcatattgatgctagtgaatctagacatatatatctatctagattcattaacatcaatatgaatgtggagaatgctagaatgacttacattataaaacggagggagtactattttcaaccttaccaagttttgtcattgctaaattttggtaaggttgccaaaattttggtaaggttaccaaattttggcaagatttcatacgcacttactaaaatttggcaacaaactaaatgtagccatttttttataactttatcaaaaagaaggtaaggttgaaaatggtagtaaagtgaacaagcccatatttttttaggacggaaagagtaattgacgtggcgaactggcgatgatgcccattgcaaaaaagagtacacgtgccagtactactgggtttaactgtctgtcttatttttgttatttttagtttattcattaaattattattgtgtattgtttgatttcagattttaaaaatatatcttttaaaagctttcttgcactacattactcaaaccactaggtttatatatattacataatatttaattatttctatagtcaagtagatgatccgtgccaataaatttgctgaatttaatttctccctactgaataatctatttcaaatactcataaattataatcaggtacactcacacacatatgacacttatgtttcacgctcataggtgcatcctatcctatgtttaggtaggtgaagatcgtataccacgatgtcactactattatagttattaatatgtaggtctcatcctcctattacctcacgcgttagtgtttataatgctaataccattcttgtgaataatatgaaccctgtttaaaaagggattggaatcacatgaatatgaggtactcatacgtacttagattggcacaatccatcacaagtaccataatctattactccctccattttttaatagatgacgccgttgacttttgaatatatgtttgaccatttgtcttattcaaaaaattctatgtaaatgtatagatacaaatcatgctcaaagtactttgagtgatagaacaactcacaacacaataaattataattaggtaaattttttgaataagacaaatggtcaaacatgtgataaaaggttaaaggcgtcatctattaaaaaacagaggtagtatgtatgctcacacatctttatatttgcataaggagaaagtactgattttcttttcaaattaagaggtggaagttgttctcagcttgagaaatgtttttcccccggaaaactgatgttgtagtaatagtccacgaacacatagtaaggtacacacagttaccgagttacggaatgagacaagccgaataaaactttgacttaattagttgatcagccgctacagataattcttaaaccatgtgtggtataaacgatggatctccgacgactgtttctttctctctagctaccggcccattctgatatattgtcgcaactagacagtactaggttttcaactatctatatgtcagatgtttgaaacgatcatacatgtaagtaagcaaccactctcaacaacagatcaacatgaagttgacgggaaaaacacctgtcgtgggtgtttgaattcactcgttaaggtttaaattttgatgtatgaatatgtaggtagactttcaggagacttttctatatgtaggtgggctttcaacaggattttagtgagatttggaatatgccaataatttccatccctttgagtgtgtgttagagcatgcacaaaaatagagtttgatataatctcttagctaatactacgtatattatacgtatcacttcctacaatagttgagacagaccacctaaccattaatacacaaaaaaaaattatattacatttttcccttttctttatccccatgcaataaaattccctttaataaaaactaagagctgactctgagtggttgtcatgcataacaaccatatttttctttcctccgctctctcttccacgtcaccaactttacttgcatactaatggagagactccgttaataataaatatcgttgtacatgcccttagatgacgtatttccagaaacgtgagtatgatattgcatgtgtagtgtgtacatgtgtacgcatatgcctaccgtgtaataaaaaaatgaaaaacatgaagttaacatattgcaagaagggtaagagggtacataaagtgaaactttgggttaacaatatatggaaaaagtacgaattacccccgccccctggaaaactattgcggtcggccgaattaccccactgaaccataaaaccggatattcttcacccccaactatgcaaaccggatgaatttccctcaacctaatccacggtggttttggtctacatgacatacgcgtggtagtccagtcagcattctatttatttataaaatagtatgggacccacctgtcatactcttccactcttcctatctctcttctctctcactcttcctctctctctcacaggcggctggcgggggacacggagcggcggcggcgggtgatgcgtaggcggcggcggtgggggatgaggaggcggccgcttggcgcggcttcctgaggcggcaaaagggccctgcggcggcggcggcatcgggtgacgcgtaggcaacggcggcgggggatgaggaggcggccgctcggcgtggctttctgaggcagcaaaaggggacctgcggcggcggcggcgcagtgcaaaaggggccctgcgacggcggcgacgcagtgccaaaggggaactgagacagcggctgcgcgaaggggcactgcgggggtggtgtgatggtggttaaggggccctgctgcggcggtccagcgccaaaagggcgttgaggtggcacggccgcgaagggcgccgcaggggaagcaagcagcctgcgcggggctgaagcggcgccgaaagacgggacggcggggcaac

SEQ ID NO: 15846 - DNA, 3162 bp, Oryza sativa
ctgtcacgcattgcttggcgcagcttcccccactccgccgcctccgcgtaacccgttgccgccgccgctccatggcccccgccttccgcccgtagataggctcagcaatacccctgtctgattcccgttccgcacttacgtttctccgccggaatccacagtagcacccgtcgccatgtccggctgcaaccgccgcccgtcgccccagccaaccctatcccggcccctcgtcactctaccttggccaccgacggccgtaggtctgcgcctctgccgcaccaaccctcaaccccacttcccttcggaaactgatctcctcctcctccctggccgccgcggtgccgtccacctccaaaatccctgatgccggagttacatttggtagggggaatagccaaataggagaagcacacaacctctttgggagccagtgggctgggaatgtgttctcgattgatgtcgacgacagccgccaccgactccctgacagcctccaccccgcggcctgagagagagaaagagtgagagagaagagagagaggaagagtatgacatgtgggtctcacatttttttataaacagaatgctgactggactgccacgcgtacgccacgtagaccaaaaccaccgtggattgggtcgaggagggtaattcatccgatttatatagttggggatgaagaatatccggttttgtagtttagggggtaagtcggccgatcgcaatagttcagggttaattcgtactttttccaaaatatactgatatatgcgcagtcaagactgtaaaccaactgtgggtcgagaggagtatattaattggttcgtcatagccaggcattgcagactaattcaatatgccgaacgacgtaattaatcgataattaaccatgcatgccagccgccagctgggcgtgcgtgcttagtaattgatgaacgagtcttagagcaagtataatagtaggctataaaccggctaaatgctgaggtgaaggagagaagagaggaaagagaggagaagcgggctataaacttacagccggcttgaacacaggaaccaataaactctgtgagagagacaagtggaccatgtattaattataaagagctcactattatatgggtagactgagagaacgttataaaaaaccttacatccaacaggtcggctgtattattagccttgcttttaactaatcgtctaaacgtacgtggttcgagctttgaggctggaaacatttggccacgttacgtgatgatacgtacgtcgacgtctctaataactaatcttatacttagttctcaaaaaagaaaaaaataatcttgtttagacgtgtgttattaaacactaggcgtgttgatcgactgtgtacgtctgtacatgtggatgactacgacgtcgtccgaaacctatcaaaaggaaggggaaacaaaattaattatcaacgacgtgctgagcatcagcacgcgtttcgcgccgcgatttggtgcccaacattgacgccggtgtccgaatctatcacctgcccatccaacggtgatgaattggcaacatgcacgcgtcgccgtatggcaatatacgatataccactggtagagaaactgtctttactcccggtttgtaaccctctgtaatcccggttagaaaaccgggactgtgaatccgggactaaagatcgctatctttagtcctggatgaaataaccgagagtaaatttcacccgggagtaaagatctatctttagtcccggactaaagagaggatagggacaatcccggatggtccccttttctttttttgttacttttttattttctcccgaatcggttgacatgcacatcccaaattaaaccccaaatcctcaaataaagtaacatcccaaatccatatcacaaatcttaaagttacttatacacacaaatctaaaacatcacaaatcctaaaaaatttacacacaaatcaaatacatcacagattatacatctcaaatccatacaatgaatcacaaaattacatatcagtgaatcacaaaatatcaaaaaaaaaaagagacaacaagtaactttgggggagggaggacgtctgcgcgcatgtgctccccctgcaacgcacgtctgcgccgcacgccgcgcgtccgtccgtccacctcgtccgcgcggcgtggcctcatccatctccaggggagggaggaggaagggaaggggaaggaaggaggagcggcctcatccgtctccaggggagggaggaggaagggaagggggaaggaaggaggaaggggaggatctgtgtaagataggagaggggaggagggggagaagagaggaggatcgatatgtgaggaagtggttgtgattgtggaggagaggataaggattagggattaccaaccaggactaaagatctaaaatgatctatagtcccggttggtagtatcaaccgggactaaagatcctcggccccctggcatgcctctgataggggatgaaccgggacttaaaaatcatctttagtcccggttggatcaattttttttaaccgggactaaaaatcgtttttaatcccggtttttaatggaaccgggactattatggaatttggtcgaccgaccaaaaatggtttctccacaccagtgtacgtagactattgtagaacatataacgatttttttacgagaacaaattaacgtcgcgtattattaccctagcaagatactactccctccgtcatgccattaaaaatttgacggtttagaaaaatgccattactatttgcgaaatttgttagatgccactgaatttttttttaattcgaactatgccatctccgtcatcttttctgttcgcatctcttccgtcgttgctggacccactcgtcaggcgtcttcaatctccagccaccgcctcgagccgtctccagccgccgccatgagccgcggcgtgctcatgtgaaggggctgcttccatgatgcctcgacgaaccaggagcaacgtcgccgccgaagccatctcccctgcctgggcaaagcaaaagcaccaactatggcccttcaaaaaaaaaactttttcccaaaaacatcacatcgtatctttcgacacatggcatggagcattaaatgtagattaaaagaaaaactaattgtaaagttatggggaaatcacaag

SEQ ID NO: 15847 - DNA, 1345 bp, Oryza sativa
gagtgatccacgatgtcggacttagggggaaaggacggggaaattggtaatgaagatggagcaagcagcaagggaactccatcacccaagggagccattataccttttgattacagcaaacttactattccctctcacaaattcgtctccgtgccttccgggggtgctcctcaatttgatgggacacattacgccgcttggaagcacaagatgaagttgcatctaatctgtttgcatccaagtatttggaaagttgtttgtacaggtatgacgtaccttatgaagacatggagctcacttcggagcaagaacaactcatccaccgcaatgctcaagcttctaatgcaattctctccgccttgagtccggagagttcaacaaggttgatggactataggaggccaaggagatatgggatactttgcaattggctcatgaaggatcaccagccgttcgtgagaccaagattgaattattggaaggaaggcttggaagatttgtgatggatgacaaggagacaccacaagagatgtatgataggatgatgattcttgtcaacaagattaaaggacttgggagtgaggacataacaaatcactttgtggtcaagagacttctccgtgcatttggtccaagaaatcccactcttgcatcaatgatacgggaaaggaaagacttcaagagactcaccccaagtgacattcttggaagaattgtgtctcatgagatgcaagaagaggaagctcgtgaagtgagacaaatggtgaagaatgtcgccatgatcaaaaatcaagaagttgctttgaatgcaaaacaagaagaagagtcaagttgtgaagaaagtgaagatgaagaaatggcttttattgtcaagagattcaagcactttcttcgcaagagtggctatggcaaagggaggaaggatgatgacaagggaaagaggcaatcaaagagagcgtgcttcaattgtggcgaatatggccacttcattgccgattgtcccaagtcaaatgaagctaaggctaagggaggcaagaagaagccggaacgtgctcatgtggcggaggcacacatggcggaagtgtggtactccagagatgaagaagatcccgaggtcaaccccaagcccaagtcaaaagacaaggttgaaggagaaggtggtgttgctaccgtcgccttcaagtcatcctcttcaagcaaggagcgtctcttcaacaacttgagtgatgacgacgacgagtcctaccactactctttcttcatggcccaaggccacatggtgatgactcaaaagccatctcaaacttctcttgatgttgattctagtgatgaggaaagtgataat

SEQ ID NO: 15848 - DNA, 1405 bp, Oryza sativa
agaggaagaaccgaactcttattgaagccgcaagagtaatgcttgatgagtacaagacttcggatatcttttgggcggaggccgtgagcaccgcataccatgccatcaatcgcctctacctccataagatactaaagaaaacttcatatgagctcttgagtggtaagaaacctaatgtttcgtattttcgtgtctttgggagcaaatactttattttgagtaagaggcctcgctcatctaagttatcacctaaggtggatgagggattcttacttggctatgaatcaaatgcacatgcctaccgtgtcttcaacaaaacctctagtattgttgaagttacaagggatgtgacatttgacgaatctaatggctcccaaggagagcaagttgttgtacatgttgtagatgatgcggatcctagacaagcaattggttgtaaggctattggagacatacgaccagtcgagacgcaggatgaccaagaagatagggatcaaccttcgtcatcgacatccaatagccctacaacaagtcaagagtcagttgacccggaagtttcgggaccagatgatcggaacctctggacctctccaggccaggaagttccgggtccatctgccagaaagttccgggcagaggacagtcaaggcgtgcctacggcacaagtggatgggattgatgccgagggcactgtagagcatcctgatcaggctcaggtcccctcggtgcaccatccaagaatacatcacactgtccaaagagatcatcccgtcgacaacatacttggtgacataagaaagggggtaactactcgttctcgtgtcgctaacttttgtcaacactattcgtttgtctcttctttggaaccaactaggattgaagatgcacttggtgatccggattgggtgatggctatgcaagagaagttgaataacttcactcgcaaccaagtatggacattggtggatgtcacatcctgatttttgtcttaggatttataaattatttaataaattattaatagaatttatattaaatgttctttaatttacaagtgaagttaaatgtgggaaataaaatttcctaaatataaagcatggacggatttaatttttattaaattctccatggttaattatactctctggaattttctcggatttttcggagctcaattattaattttaatcatacaaagaacagttcagtaattatttgatcaataatgatctaattataattgttaagtgcttttcttgtttaaaatccttaaattataaattgttgtttaaaaggaattattagaaatgattttaaaagcttcaaagagaagatctaattttaatttgctaaatctcaatataaaaatgagctagataaaattttattaaatactttgcttgtt

SEQ ID NO: 15849 - DNA, 8926 bp, Oryza sativa
ttcggcccaatactctctctctctcccgcgcggcccaggccggcccagctcagccgccgcccctcctcctccagccgccgacatgtggggcccacatgtcggaggtttcttcaacctccggccggcctcaggccgagcccgagtcggccgaccgagcccctcttcctctccgaatccgcatccaatccggtcctttttcttccgtttgtttgaggggtttttatcctctcatcctcctctatcttttccctcaacaatcggagcaagaggttgagtattttatccgaatcgagttcgtttcgattttatccccaaaaaccgagtttagattttcccgaagcgatttcttgcgggaggagtccgatctcttcaatccaaggctataaataggaccacctcatcgctctctttcgtttgccccctttcccgagctctctagtgcgccgtagagtcgccgccacgccgagttagtcgccgccgccgccggccgatgtccagccgcgccgccgcgccgctcctgccgtcgccgccgcttgccgccgccgccaagaggtgcgccgaggagtgaggaagcccggccgcccgttccccttcgccgtcgcccaccggagctccgtcgccgccgttcaaccgagccgccgccgcctcttgcgtcgtcgccggccgtcgtcggttgtcgtgagacgttttggtgagtaccatcgggttcgtctcgacgtcctctacgcgtaggtgcccttggatagcccggccgatctctctatcgccggcgaggtcgtcgcccgtgtcatgccggtgatgatgacgtcagcatgacgtcatggttcctcttttccagttttttttctaatagattaaatcttcggaaaatcataactaaataaccgtagatccgtttcaggtggttcaagttgctaaatttttctaaaataaagatctacatattaaaattgtccataaattgaattaaatttatttaattctttttaaatgggctttaattagatttaatcttgtaaaattcataataaattcatttgaagtcggaataaggccgttcaagtctcataattcatctaaaatcatgatctacatgtttgtttactttatatgtattgtttatttggtttttattagtctttttcttcgttttgcgtgttagcttgtcgtttccgtcgttgcgaagattcgtgagtgcgtcggaagtgatcaagaagattaattgaagatcggttattgcaaggcaagtcacacagatcctaaacacaatcctttgagcatgttgatcctatatttaaattctctatttatttcaactatgcatttattttcgaatgtcactgggtggtgtgaacctattcctttgttatggccaatttgcattgaatgccctattccttgataccttgggtaataaattgattagcttgaaccttatgtattggtttggttcagctaaatgttatatatataattgcttagcaatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacatttaccgtgccaaccacaagccagcgtgggcaacggctttatcttttgtatagcgtgattcattatagtgcgccagactgagaagtggcgagaagtccatgggggtcgctggggagtccatgccttgtttataagggggtgattatgatccaggaaaggtgcgctgtaatggattatgctgtgcaaggggtattgtcacaactcctttccgaggtaccgtggtggtactgagacacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatactttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagccggagcttcgctagattttattttccgctgcagttttcttcttgatgaggattaagtgcctcataagtaagtatttatcgttttagttaatttgatgaatctgtatattaaattgtcagtttgtgtacctcggctgattcctggacgaggattttatgcacaaataagttcggaaattattagtgaatttctgggcgtgacaagttggtatcagagccatctcaactgttggataagccaaatggtcaaattttaaggacgaatttttccgacaaaaatgatttgtgaaaatttctcctttcttccttatctagaattctttacaaattgtttcattgtctactctcttctctcgttcaacttgagtagttctgaaactaaactagtggttgaaacctgaagacgccaatgaggtctactgatggaggttaagtaaagtggatcgaggaaggaccaaagtgcccagatgtcaagatggaatgaagttggcatcctgccttagaacctatcccgccaaagtgtctttgaagaatagttagtagggtagaacgctgttgtttgctttgtgtgtaggtatggttgcattcccgtcatagatgtagtccagtgatgagcgtgcaactgtactaggttgtttgcttaaccaacttaaacaatataatggtctacacacatcagatcagtgttaacctggttaaggtcttgtctttagtgtaacctctctccttctatcttttctaatctgcaacagatggtgaacactcgcgccagtggaagtggaaacaataacaatgaagagaaccccacccttgctcaagtgctggctcaacagacccaattgattaacatgttagtgcaacaaatgcagaaccagcaagggaacaacaatgtcaatcctccgccgccgcacaacaagttagctgattttcttcgtgtgaggccgcctaccttctgtagcactaccaaccccagtggaaaaaggcgattggtatgcacgctgtatgaaaacaagttggaactgctcccatgtacggatcaggagaaagtcggtttcacttcacatcagttgcaaagatctgcttcagaatggtgggatcatttccggatgaacagagcagaaggacaaccaatcacttgggcggagttcactgaagcattcaagaagacacacatacctgcaggtgttgttgctttgaagaagcgtgagttccgggcacttaagcaaaaggatcgtactgtgacggaatatcttcatgagttcaatcgtctagctcgctatgctccagaagatgtgcgtactgacgaggaaaggcaggagaagttcttggaaggtctgaaggatgaactgtcagttatgttgatctctcatgactatgaggattttcaggagttggttgataaagcaattcgactggaagacaagaagaacaggatggacaatcgtaagagaggaaggattgttttccaggaggcacaggatagtagccagaggcagcgtatcaagccactccaaattggtgaatcttcttccgctggtcaagaacagtcacaacagttgaacatcggtggtgagatcaactcagagactaatgcaagcaatgaagacaatgatgggcaagctactcaatcagtgtcatttcagcaggatcagtctcaagaagataacagtagtggaagggagcagcaggtatgtttcagctgttacaagccaggccactttgcaagagagtgtccgaagtcacagcatcagcagccgcaaggtcagatcaacaacattgtcgtcacaggagccaatgcagtgccagttgcgtcttcaagagttgtgtcttcaagtgttacaactcagccaccagtttcaaagcggcagtagttttctttaaagccttagaataattatcggagttatggaataagatagactgcagtttacctatgcccttttctttctagccgttccgaatctcgggacgagattctttgtaaggggggtagatttgtcacatcctgatttttgtcttaggatttataaattatttaataaattattaatagaatttatattaaatgttctttaatttacaagtgaagttaaatgtgggaaataaaatttcctaaatataaagcatggatggatttaatttttattaaattctccatggttaattatactctctggaattttctcggatttttcggagctcaattattaattttaatcatacaaagaacagttcagtaattatttgatcaataatgatctaattataattgttgtttataatccttaaattataaattgttgtttaaaaggaattattagaaatgattttaaaagcttcaaagagaagatctaattttaatttgctaaatctcaatataaaaatgagctagataaaattttattaaatactttgcttgttcctctattttctagaattttctgggaattatttgagcaagggaagtatttttaataattgaaacaacatttcacaaattgttttatttaaaaaagttcaaaaaacccctccctaagccgttgggccgaattcggcccaatactctctctctctctcccgcgcggcccaagccggcccagctcagccgccgcccctcctcctccagccgccgacatgtggggcccacatgtcggaggtttcttcaacctccggccggcctcaggccgagcccgagtcggccgaccgagcccctcttcctctccgaatccgcatccaatccggtcctttttcttccgtttgtttgaggggtttttatcctctcatcctcctctatcttttccctcaacaatcggagcaagaggttgagtattttatccgaatcgagttcgtttcgattttatccccaaaaaccgagtttagattttcccgaagcgatttcttgcgggaggagtccgatctcttcaatccaaggctataaataggaccacctcgtcgctctctttcgtttgccccctttcccgagctctctagtgcgccgtagagtcgccgccatgccgagttagtcgccgccgccgccggccgatgtccagccgcgccgccgcgccgctcctgccgtcgccgccgcttgccgccgccgccaagaggtgcgccgaggagtgaggaagcccggccgcccgttccccttcgccgtcgcccaccagagctccgtcgccgtgtcacgcccggaatttctatccaaaattccaaacgcttacatgtgtgtgaaccctcgtccaggaatcagccgaggcacacaataacaaattgataatagagtacaattattactctaattaatacgcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttgagaaaacagttaagtaattaaacaatattaatccaacgctatacaacataccctgttgtataggcccaaccattctgaacaaccaccccggctgcacagttctatctccaaaccaggaatataccattccaaaccaggagctaaacaaattattaccagtttaagcatcttttacaacgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaaaccatcatgaaataatagtgaatcattagttatcccgaatatgtgctaatgtttctaagcagggctaagcaattatatctaatatctagttgaactaatataaataaagctcaactagtcaaattgtaataacccaaggtatcaaggaataaggtaatcaagtacaaaagggccataacaaagaataggtcaattccacccaatgacattcgaaaacagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcggaaaagagcaaaatcaccaaaacagcacataaacaaacatgaacagtacatgtggatatttttaatgtgtagatctcaattttagaaaaatttagagacttgaaccaactaaatcggagctaagatgaattagttatgaatttttaaagattaaatcggattaaaacacttaaatcggttagaattgaattatgacgcaataatgaattatttttaaaaaggaaaagagggtttattgcgtcagcgggctagggtttgggtggaccgggcgcacaggcggcggttcacgcgaacggacggccgagatcgatccatccaaaacggacggccgagatcgaacggtctacgaccggctcacggcggacgaccctgatgacgtcagcaatgacgtcaccgacagcggcggcggctcggcggaggagatggctcgaacggcgcacgctcgccggcgaacggcggcgcgaggatgcaaacggagggcaccaagacgaagaggacaacgcggcgaactcaccggtgacctaaacggcggcggaagaccaacggacggcgacggcgacgaggaggaagcggcgggaaccttcgggtcaacgacggcgatgctgctccggtgatctccggcgacggcgaaggggcggacgaggacggcgacaacttggcgagcacgacggtggtcttcccgagcgacggcgacggctgaaacgacggcggcgcacggctggagcggcggcggcgacggcgaagctagggcacacggcgctagagcgattccgacgacgagaggcgaaggcaagggtggcgacgggtagaggagacaccgggggtccttttaaaggggctaggaggcggcggcaaaggcccacggcggccggcgacgaggaaggaaagatcgggaagaacgaatccgagacaaactcgaatccgacgctttccaaaacgatttagccaaagattccaaaggagaaaaggtagaggagatcccgaggatcatatcccctctatcaattcggccggagaaggaaaggagcggccggattggaaagcggcggcggcggcggtgcgctagggtttcggcccgaggaggacgacgatcccgacaggtgggaccaacctgtcagcgacagcgcgcttgcgcgggcggctgcggctgcggactgggccggctgggccgaggagagagaagagaggttttgggccgactttcggcctaaagccaaaagaagactttttaaaacctttttcaatttaaattatttcttaaatgcaattccatttattaaaaatactttcttagctcaaataaatcccagaaaaaatctaggaattatagaattaagcaaagtatttaatgaaattttatctggccccattttatattggaatttattaattaaaactagatcttctcttcaagacttttaaaattatttctaaaaattccaattaaacaacaatttatatattttgaattttcagggcgtgacacgctgtcacaccccgaagttttcctcccaagccaaaattgtaatttttataaatgaccctaagaaaatgctggtgaaatcaggagaaaaccctatgaaagtaatgcaaataataatcggatttgacatgtggaatttttcttgagttctacatgtcgaaactcattaacaggatttttagtggaattttcagagctctagaaataattttaaccaattaaaattgagcaagcaatattttaattccagggaaaatcctttttcctttttctttttcttttccctccctttttcctcctttttccgaatgggccgccggcccat

SEQ ID NO: 15850 - DNA, 5460 bp, Oryza sativa
  unsure (1)..(5460): unsure at all n locations
gatgaacatggagtggttgtaaggaacaaagcccggttagttgcgcaagggttcacccaagtcgagggtctcaattttggtgaaaccttcgcacccgttgctcgtcttgagtcaatccgaatgcttttagcctatgccgctcaccatatttcaggttatatcaaatggatgtcaagagtgcctttctcaatggacccatctcggaattggtctatgtggagcaaccaccggggttcgaggatccaaagatgccaaaccatgtgtaaaagctccacaaagcgctctacgggctcaaacaagcccctagagcttggtatgaatgtctccgagattttcttttgaaaaatggttttgaaattgggaaggcagacactactctcttcactaaaaagtttgaaaatgatttattcatttgccaaatttatgtcgatgacataatttttggttctactaatgccactttttgtaaagaatttagtagtatcatgactaaaaggttcgagatgtctatgatgggtgagctaaccttcttcctcggactacaattcaagcaagcacaagaaggtactttcatctctcaaaccaagtacgtgaaggacattctcaagaagtttgggatgaaagatgccaaacccatcaaaactcccatgcttaccaatggtcaccttaatcttgatgaaaatggtaaatgtgtggaccaaaaggtatatcgctccatgataggatccttgctttacttatgtgcatctcgtcccgatatcatgcttagtgtttgcatgtgtgctcgctttcaagcggagcctaaagagtgccatttgattgctgtcaagagaattctaagatatttagttcatactcctaatcttggcttgtggtatcctaagggttgtgactttgagcttttgggctattccgattcggattatgcctggtgtaaggttgatagaaaaagcacaaccgggacttgccaatttcttgggcggtcccttgtttcttggtcctccaagaagcaaaattccattgcattatccaccgccaaagccgaatatgtcgccgccggttcttgttgtgcccaactcctttggatgaaacaaactctaaaagactttggctacaacttcaccaagatcccactcctatgtgacaatgagagtgccatcaaaatagccaataatcccgttcaacactctcgaaccaaacacatagatattcgccaccactttttgagagatcatgagaccaacggagacatatgccttacacatgtgagaaccgagagccaattagccgacattttcaccaagccgttagatgagaaaagattttgcgagcttaggagtgagctcaatatcttagattctcgcaacattaggtgataggtggttggctaatttatagtcaaacatatatcactaaaatgtaaattttaaaaataaaaaaataaaaaaaaattgtcttgagatcacttcttggtagaagatgatgttgataccaggaataaagctcaaacattccccctttatccaaaaaccccttttgtgaaaatttttgcaaaatcctttgtgtgccttttattgcgaaaatttggtttttatccccttcttgtggtgtatattgaccattgttatgtaatgttgattgttggctggtcatatgcatcataagtctctgcatgtccatagttctctattttccctcattgaactctctcttctccttgtttttgggcctgactgccctttatctgtcaggccggaagttccgagcctccctgtctggaacctccgggtgtcggggagtatatattctcagggggagttagaaaccctagtctctctcctcattcttctccctccccgacgccagccctagccgccgctacagtgccccgagtggcgattttctcttccctccaatcaaattcgattcttctccgtggattcatctacattggtggctgggaggttctttctgtgatcgattcacagtttcttctctcaaggtagcactttttgattccctctctcggttcattgtgtttttatctcgatctctaaatctgtgaacctagggagaaaaccacttggatagtcttgtttctgctaccttgcagatcaccgatctataggatttgttcacatgcattggctatttttgagacctctgttcttcatttttgccggccgaaagttccggtgttcttgcacccggaacctccgggcgctgtccagccaacctaccattcttgcttctctcaaattctgcctaactactgcactccaatttgttgattcctgttgcagtaagctctatgcctcgtgagaaaagacagaaagcctctcaggatgtgtccggtgatgagagtcctcctattcggtttcctcgtggtcgtttgggtaaagagaaagtggttgagggcggcagtggcagcggcactcgtacttctcctaggtttaccaggcaatccagcaaccgttcagttcagattcgggatgttgacagtggtcaagcaagtgatgctcctaatacaagaggtcgtgggagaggtggtggtcgcagttctggggctgaaagggcctctcatgatttccctgttggatctcgtgagaatcccgttcggctctacaagactcttggatttgacaccactcctatgcaccacattggaagacccaagtccaactaccttcatcagcttgccaccaactaccttcatcagcttgccaagtgcagaagggaccgtttgattgatccagagacacagcctgaggagtcacaggatcctcgtttcaggactttcactcaattggattggtataactcagtgattatggccagagaaaatccagtggttgagatgaagtggattgattgggcttacatgaggaagaagaacaatgaagtgttcaatcaagtgatgcaagtgtgccacaacaagaatcttggagatattcttgccttggagtatgattggaatgaggaggtcattgcacagttctatgcgacagtattctttggtactactaggaaggcaactccttatgtgaagtggttgactgagggtgttaggcacaagatttccatggtacagtttgctgagatattgggcttagaggatgaggatctcaataggcctaatattcatagtgaagcacccctccccatgatcaagactaagttcatgtatacaaaggatgctcctaggacttgcatgggatctactcatggattgcatcccaactacaaggtgttgtactccatctttcgttggtctttgcttccaaaggttggagatgctactgctttgccatccaagcttgctcatcttctcagtcgcatgcgctacaatcagcctcccttcagtgtgatgaaattgatttggtatgagattgccaacaccattcttgagcctaagcggggttgcatctatgctcctttcattatgaagatgattgagacagtcactggggtgttctacatcaaagatgggcgccacaatccttttcgtcctcgtgttccaccttcctcttctccagtggtacatacatccattccttctacctcagctggtccttcttctagtgccccaccgagatcctcgagttcttctcccatcaagaaggcacttcaggcaatcttctgtatgtgtgctaaaactgctatgaaagtgaagaagattgaaaggcatcagaaggaagatagaagagaggttgggaaagaagtgtcagatgattctgaagatgaggtctatgttgatccatttgaggcttatgaggcagcccgcaacgttgccggtgaaggtccatccacctacttcaatgaagagtcttctcaatcagatgatgatgatgatgatgaggatgacaccgaggcagctgctgaggatgctcctactgatgttgatgagggcgacaccgctgcacagtccgatgagtctcatctctccggcgataccgagattgttccctcagatggagatggagatgagtgatcctcttcttctcttcgtggtttcttgctttttagtgccttgatgccaaagggggagaaattgtgaattgaagggggtcatttaaatctttttgctgccttgactgttgtctagtcatttggccggaagttccgggtcctgtgatccggaggttccggccagacagatttcctctctattatctccaggcagatttcctctctattatctctctctctctatggacatgtaatcatattctattatggttggatgtaatgactgttagatgctttattatccttatgtcagtaagttagaccatatgaatgttgcattttgatgtgatgtagtgttcttttcatctttttgagtgattgccttgtcatctagtccttcttcttgcatttcactcattattcaagcactcacatctgcatcttatttgattgagggtagtgtgaagtttcttttgagctttccttcgtttttatgcatattgtattcatctcatttcattatatgcatatctttagggggagcttcacacttctctcatcattccaaatttaaattctattatctttttgtgtgctttaaccatgttgtcatcaatcaccaaaaagggggagattgaaggtgcacttaaaccccctagtgggttttggtgattaatgacaaggtggttaaaggggactaacgtgtttatcaagtttattcacaggagtttagtcccaaagcaagttgtgatggctaagaatgcaaggagaccccccaattcaaatgttcctaagtgcgaaaatcaccgaaggtgattagactaggtttttctcttttgaaattgagtttaggaaaatccgtactattaagaggggtttcaagtgtggttctagggtatacaaagtgctcttagtcatatccatgagtcaaaatattttttggaatcatttttgaaaaatgattttctccccgggacagagagggctacccggaggttctggccggaacttccgggcaccatttcattgcaaaaaatttcctaagtgctgcccggaagttcctggcacttttgcccggaacctcctggcaggtttccagttcaagcttgtgagtagcggctagatgacgtcacctagccgttatatatatggatttcgttcccaggtcactctttggctattccacttcagttctttcatgttctagggttttctagccactacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15851 - DNA, 989 bp, Oryza sativa
cagcaagacgacgtgcgctgacatgtggccccttgagagaacacgaagagatgtggattgacatgtggatcctcacgtggggatttacgtgaagttgataaaataacacaagtgattggttgatcaaatagtcacgctcatcaagtttgaccgtaatctgaagaggcccaatataatgggaaagtgatttcatccatcacggggatattccctcgtttcgtgcatgccacctaaatagtcaccaaaaaatttgaaaaaaaaattggtaacatagaataatatgagatatatcactctacaaatatgcatgtttaaattaacttctataagttataataaaaataaaaaatatagctgcaaatgtatgataactatttttagtttaatttattacttttgttgcaacttgtagaagttgaatttggtcttgtatatttgtggagtaatatatttcatattaatctatgttgtcaattgtttttaaatttttaatgactacttagatgacatgcaaacaaggacatatccctcgagagatcacattccaatataaccacatatgtattgttttagactatcagtcgatctctcgtaccattttcgggattggtattgcttacgacggcggtgcaaactgagccgccgttcccttaccttccggcgacaccttcagattgaacaatgccgcgcagagattgtccaagtagaatactggatcagttaatcacagccaagctaatagccgacttgaactcggacaccgacttcaattccaactcggactcggctggctataaatccatgcgcggccgcctccgcattcaccagcaattccttccgccaatcctcgcactcccagcagcgctctcgtggtcaatggcgcttccccgccgctcgagtcacatctcctcgcgcccgatcatccactgccgcagtgagctcgccgtcgaggcgaaggggagagtagtctccaagaagccgtccggatc

SEQ ID NO: 15852 - DNA, 2914 bp, Oryza sativa
tgatagtagtcttaaaagaatagcatttgtttcgaagacaaacagtattcttttcccctctttcccaactcacttctctcattttccacgcgcacacttttcaaactactaagcggtgcattttttgtgaaagttttttatatgaaagttgttttaaaaaaatcatattaatctattttttaagttttttaggctaactagaaaggtagcccgcgcagatgcgcgggcaatttatttattgtttacaaatataattggtaaattttgagataagtctaatggtttagaaaatttgaagattttttttcctaagagagtaggaaaggaaagaggagatgaggagagtacgtccgtaacagggaagggtgtggagaaggtgggtgcatatactttttttattcgatctaatagttaaagtattggacccaccaatttaaaagaaaatcaatggatagattttagagtgtcacttggcttaatccaaacaaattaaaattaaatcaggtctacttgaaaaaacacaactaaattgttttactttttcgcaattacgtagtacatttatgaagtgatatttgacatcctaaaatatgatatgaaattatttaaaattatcataacattaattattatatatttgcccaagatgtggtgatgtatttagaaccgcaatataaattttataagacacaaatattttatttaattaaagaaatacaaagggatcataaattgattatataatttaaaataatttaaaagatgaatgtttagagataattgatttgatattttttatttatattatagatctagtttatatttgcacatatttgtggagtaatatatttttatatggtaaaaagttatattttaaagaccattgattttggtctgacggtaatatgtattatcgattttaaattatttttaatctaaaatggtgggtttaataaggtatagagaaacagttagattagatataatatgtatagcttaaaataactaataactgtggttgtttttttttatcataactactaaaaaaatatagatcagtggagggggcagaaagtgttgtgcgtgtctaatggtggggtgaggtggaggggactttgtttttctatttttttctaaatcatttaggtcaaaaaccaattatcatgtattttgttttttagaaaatcttttttaattttaaagtcatcataatgacttaaaaaggtaatattagatacaccgatttaagctggacgatttaactggagattgcttggttcaaattagctacgtaatatcccggtaaagccatgtaaactgatttaattagctggatatgttatattaccgttaatttccttccacaaatcatgtataataactaatttaattagctatgtataatcttcgtgttaatctcctagctcccatatatatacacatacatacatacatacatacatacatatacatatatatatatatatatatatatatatattgccgtgcatataataaatatagctatgattagtagtaatacaatatgacagctaattaatctcaacttctaacaaccatagatactaatcatccttccggcaaaccatacatacgtacgggagaaaggtagatctaattcattggtataaaataatgggtccaccaatttaagtgaaaatcaatgacagataaagatctaatctaacaatgtaaaataatgggtccacaatttaagtgaaaatcgacagtgaaattatattgtgccatatggcggcctaggagcatttgtaggagcgccatgtgacggcttgaaagcgtttgtagaaagtttaatggacttttagtatataatagatagatacttaattaatctcactataatcgcgtgctttgttttctgtgtcgggaggcaaggttggtaaccatgcttccgaaagtgtttgtaggtgagatgtaaggtgactttgtttgaagcaaaaagtcttgagtttgaatttttcttagtacgtgtatatgaatatgggcacatgtatcatgtgatttgtgggaacgagagtatgaattttgcttaccacgtgtatatgaatatgggcacatttatcatctgatttgtgggaaagagtgtgtatatgaatatgggcacatgtatcatctgatttgtggggaagagtataatggtatagatgcctaaaaaatacatcaaatatttttttttgatttttttagcacctgcaaaaataaaaaacgggtgcacccctacacctataatactggttcaagaaccgacggtaattggtgccggaacctatatatgatataaacttttagaaccggcacattagtgcacggaagcaaggaatacatgtccctccgttaatatctcgttccatttatcggattggtatttcttatggaggcggtgtgctggtgcaaaccgagccgccgtcgtctctttgccctccggcgaggcggcgatacctccatcagttcgcgttcccgtagtagcgatctcagatttcgtatcggtctcgattgatcaatgccgcgtagagcagaatcggattcagaaggattaaccgttaatcacagcctctaagcaccgacttcaactcgaactccgtctccgacttgcttccttcaccgatttcaactcggactccgcttcggctgccgataaatcctagcgcgccgcccctcaccgtctccgcattcaccacaattccttccacccatcctcgcagcagcgctagctcgtcgtccatggcgcttccccgtcgctcgagtccccgctcctcgcgcccgatcatccaccgcgccgtcgacgccaaggggagagtagtctccaagaagccatcagcagggtcgcccgtcaagaagatgtcatccgcgccgtcgacggcgacgcccgtgt

SEQ ID NO: 15853 - DNA, 2278 bp, Oryza sativa
ttttggatacactctcttatttcaaagttttctatgattagtaattttattgttattagatgataaaaaataaataatactttatgtttgactaacttttttaaaaaatatatatatatttttaaaataagacgaacggtcaaatgttggatatataaacctagaaatgaagactttgtgggatgcaggggtagttctgtggtgccttttttttttcacaatttaagacaacgttgatcacgacgatttgtggatgcagtgagcctattgcatcgaattttttttttaaaaggaaatattgcatcgaatttctccggacatatatttgcctgttttctccgagatactatatgaacaatccttttgaaacgagatctttggcaaagggtgccggaacacctctgttttctgtgacagccgccaggtgttcgatgtcatccccggcttcctcggcgagcttctctccacgacagatgcgagaacacgcattccgtcgctagctcgttccatttttgcgactagttctgcaaatggagatggtggaaactgagccgccggtccgccgtcatctccttgcccttcgcgtaaacggagatctccgatttcgagtcgagttcggattgaagctaggaatgtctcgcagagcatagatgcgtataatcggattattcatcagaagtattctgcttggcatccacacgctttgcttccttcaacgatttcaattcgaactcggactcggctgccgataaatccaagcgcgccgcccctcgccgtctccgcattcaccacaattccttccacccatcctcgcagcagagctcgttcgtccatggcgcttccccgccgctcgagtccccgctcctcgcgcccgatcatccaccgcgccgtcgacgccaaggggaagaagccgtcaggaggatcgccgcctgtcaacaagatgtccttcaagaagggcgacgaggtgcgcgtccgcacgtcgttggggaggctagggaccacgacgctgcgcctcgtcatgtggctcggcgcggtcgtcgtctccgacgccgacgacgacggacacctcgaggtcatctacaatggcaacttcccgcgcgacgatcccttccggaccgtgcgcgtcgccgtcaaggacgtcaagcttccggcgccgcgcccggccccgaccccggcaaacatggcggcccagcggccgaccacggccgggaagtcgctgccgcggctgaagatgcagatgctggagaaggagcagctgcgggccaactccgaggcgttcttggcattgtgattagtgttcttcagtaggtgcagaagcttgtaggattcagacattgtcttcctctgttctttgggtgccaatgtcatcgaaggcacagtgatcttgtaatgtcttagataggatggtttattggaattcttcgcaagaagaacgtgtaatctgtgaagtgtatttatcattgattatgaatgaaagatcaagattctttttttatacacgagtgatgtgtttcgtctattatctcatgaccaatgcaatactatccttgtcttttttttgtttgagcaaagtgttaagattaaaatcacaatgatttaccctactgataaagaaaaacaatcattcatttgtttctctaaagataactttaggtgtaaaaatcaccactacatataaggccatctccaatgtgcaacaaaaagtgatttaccatcggtctctatatctctttaagtgcgtgttaacattataacgatgctattataacaaaaaaattagacaaagttaatatagcaaaattatgctagaaactatctaaacatggttgagctggatgactgtccaaacacgtgctagctaatggtaaatacatgtagatactactattcattattcaagagagctttgaaatacaactgccctcaaacatgatctagccatgacccatcaacgacttggacactgacaagagtggatctgcagtggagaccaaaggagacgatggtcaaataagccagatctaggctggtgcattttttttttgttttctgatgttttaatcgatgtatctatcatgtttttggggttggatccaaatgttgcactgcggtagtctgatcttatttcatctgttcttgcatattggttgaatctcaatgttccatttgtgaggatgagttgttcaatcttgatccaactatgtttcagcatttaatagattgaaacattttttattaagtggtgaaacattttttactaggagtgaaacaacgcttg

SEQ ID NO: 15854 - DNA, 10589 bp, Oryza sativa
tcctgcagccccgagcgccagctagcgccttgaccgcccgaagtcggtttccaaaccgacgttgccgcccttaaagccccgggcgccctccctctcttctcctttcgttgcccctctcgccgccgcgccattgccgtcgctcccgtgctctgtctcgcctccgccgtccatcgccgagcaccgggagagccggtgcgttcgtggacgcggaaggggacttcggccgcgccctcttcttcctcttcctcggcccgaggccggagagattactcccgcgccgccggcctctcgtcacagcgcccctcctcttctcggtgatgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggccttgctcggcgtagttccacccaatccgacgctagcgtcgagttcccgaagccgcgtagatgctctcaccgccgggaatcggtctctcgtgacctcgtcgccgtttccctcttctcccgccaccggttgccgccgccgcaatccgccgccatcgagcaacctccggcgaatccgagccgttggctcgtctccccttgtcacgtgcaaccgcccggtgtgcacgcttttgcccgtatcaccgtggttcgctccgccgctcgccgccgccgcccgccgtccattcgcggccgggtcgtcgtctacctcccgccagcccacgtggccgccacgtaggcgccacgtcggcgccagctcagcctagaccgggtcgggccgaccccggtcggtccctccgcgtgcgcgcgatccaccgcgagccgtgaggctgcgcgtgggcccgccgcacctgcgtccaccgcggaccccgcgcatgcaccgcgtcccgtccccgcccgcgcgcgtgcgtcgcgtgctccctccgcacggtgagccgagccgctgacaagcgggtcccacccgggaccgcgcgtggtgagcccggtccaccggactctctcctccctcccgcgcgcgcgcgcgcttgggccgtcttgggctggccggcccattaagctcggccgagccgccccaaatcccttgggccgcaccctagccgcccgaggaaagtctaaatttcctccctcctttcttttctttttcttttccgaaaaggatttaattccttttcctttaggccaaaaattcaataatcttagaaattcaatatcttcccaaccgtaaatccgtttgactctgttcaacttccaaaatttcccaaatctcgagatctatctagtggcacgcttagaggtctttaatagggctttattttcgccgattgttgagttgtcccgtttcgcgtgtagtttcggagcccgaagacccgcagtgcgaggatttcgaggatcaagctccagatctcgagcaaggcaagccacccttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctatgcgagtatcgacggtcgccttcaaacttaaaatctgagtaacaacttgggtaaaactggagttttacaaaagacttggaaaacccgacacctgggtcggcgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgttgtgtaaaaaggggttcggtgtttgaaaaatctgcagctgatgggatcagctaggcccgggtggccgtttgaaaagttgttggcccgggtggccgtttgaaaagctgttggccgggtgccaaccttgttgcaatcctaaagactgacacattgcacatactccgaccggacgggacgcactgtctcaaccgtgtcgtttgagaagcactcactcagttgtttcagaaaagagttcaaataaaatcaattgcaaaaataccagcctttccttgaggcctgcattaaacacttatttcccctggcttgctgagtattcccgtacttacccttgctctataaaaaaaaatcccccccagttgctgaagaagatgaagtggatcctgctgacgaggagttcttccaggagcatgtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgcctccctgtgataccagcactatttcctgggactggtatcgattagcaggttaatttggagcgtcacgggctagttccggtcgggactagttcggggcgtgacacgccgtagtcgttgttgctgtcgggggaggcgaatatgcgatgaggccgggagaggcgaatagtctatgaggccggagggaggcgatgcggtgaggagcgaagggaccgagggcattgctacaaaacggaatgagtaccactgagatgtaatccaacggctgataattaaatgatgatgtggcttcaccaaatctcagctttgggttttaactttatagaaagaagggataccttagattttgtgattataataggtgggattttataaaatttattttaacattattatttttacaatttaagacaacgatgatgacgacgatttgtggatgcagtcaccctattgcatcaaatttctccagacatatatttgccggttttctgcgagatacaatttgaacaatctttttgaaacgaggacttggcaaagggtaccggaacacctccgttttctgtgacagccgccaggtgttcgatgtcatccccggcttcctcggcgagcttccttccacgacagatgcgagaacacgcattccgtcgttacctcgttccatttttatgactagctccgcaaatggagacggtggaagctgagccgctgtcatctccttgtcctccgccgccgccggcggcgacacacctagcttcgctgcgcgttcccgcctgcttggcgccattcggaatggattgcatgatggtggagaggcgtaacggacgtctccgattccgagtcgagctcggattgacgaatcgtgcctgacagcgccgacttcaattcggactcggacccggctggtgataaatcctcgcagccccgatcgccgcctccctccgcattcaccacgattccctccacccatcctcgtcgcagcagcgctagctcgtcgtccatggcgcttccccgccgctcgagtccccgctcctcgcgcccgatcatccaccgcgccgtcgacgccaaggggaagaagccgtcaggaggatcgccgcccgtcaacaagatgtcatccgcgccggccgcgccagcagtgtccttccagaagggcgacgaggtgcgcgtccgcacgccggtggggaggctagggaccacggcgctgcgcctcgtcatgtggctcggcgcggtcgtcgtctccgacgccgtcgatggacacctcgaggtcatctacaacggcaacttcccgcgcgacgatcccttccggaccgtgctcgtcgccgtcaaggacgtcaagctgcccgcgccccgcccggccccgaccccggcaaacatggtggccccgcggccgaccacggccggcaagtcgctgccgcggctgaagatgcagatgctggagaagaagcaactgcgggccaactctgaggctttgttggcactgtgatcagtagtagcagtagcttgtaggattcagatatgtcttcctctgtttttttttggtgtcatggaaggcacagtatctcgtatttgtgataggatggtttactggaaatcttcgcaagagaacgtgtaatctgtgaactgtatttatcgttgattatgaatgaaagatcaagatttttcttctttttttttacacgagctatcgatgtgtttcgtctattatctcatgatcaatgcaatactatgcttgcctttttctttttcttttttttttggtttgagccaagtgttaagattacagtcacaatgatttaccctactgctaaagaaaatcaatccttcatttgtttctctaaagataactttaggtgtacacagtacacgaactttgaaatacaactgacaatgggccaatccatcctatggttagcagttagcacctctgagccagggttgtctcgaacatgatcaggtcatgacccatcaatggcttggacactgacaatagtggcctcgattgttatcaataaggagctcgcatcttagctcaagctctcgcgacgcttgctggagcaacgtttgcaaatccttacggggcgtgtcgtgtgatcgtagatcgatcatgtggtgtgttatgacactcgagatcaaggtttcgtcctcagactctgttactccctttagtttcagatgaatttcgaaatcaacttgatccattagcacgactgcacgagatgggcatgttaacattagatttggatcctgtaagcatcacaagtaattgatcaatccatgttaaatgtataattattctacacttggcacactaattaaggtcaggaacatataatgtttttcacaggcttatgtttgtacagattatagaagtgccacttttgttcatttagtttgtatcaatgagttctttacaaagaagagcactaaggagagcttactaggtcctccatggaatgtttaggctatgccaaaccactacctcctgtaaaatcaaggagttgatttaagaatttgtgtgatgaaaatattggtggtttgtgatattttatttgtgataaattggtgtcttgtgacgagagttaggagattgatagatggttggttttgtgaagtggttgtgcggttgacccgataggtcagaccagccggcgtgatggtgtgatcgggcaaggttctgtttgatgtcaacttcaggttatcttgtccgttttggatagtttctttgtggatttaacttctagattgtttctataagtatggatactgttgttatgctaatgtgagttaagttggaatgaacttgtgttcagaatatggtttctttattgttgcatgtgcaggtgttatttagatcgaagtcaacttgagagaagtggatgtccagagatcaagagaccatgcgggatactaaaggctagaaaacgatgcaaatagtgataaaattccatatgacatacaagaggaattatgtgcatatatatggaaaatggagtcgaattcggacgtgagtctaaattcggaaagattgataaatataagggcctattcactttgctaccaaaaaaacattaccaaaatttggcattgccaaaattttagcatagttgtcaaaaatttggtaacttgccaaaattttggcatgatttcttatatagttaccaaaatttggtaacaaactaaatgtagccatttttttggcaactttaccaaaatttggtaaggttgaaaatggcatcaaagtgaacaggccctaagagatgagttagatacttgcaagagagggtttcctacgtggatgggaatcctaattaatgttagattcgtgagctttgtacaacattcctcatgtataaatagaaagggagggtgaggcatcccggtatcgatttttgagagagttgaattgagagaaatgttagagttctgagtctagtcgagattttggtgaggagtgttgttggtgcactttgtaaacactagttgatgcaataaagttgagatagttcaatctacatcttctagtttttatctacctgtgttttctaggtcccgacggtcagaccgacagcaaggtgacgttctaaccgacgagagtgcggtggtctaactgcaggtggcgcggtggtctgaccggccagacaatggaagtctgaccggcagcacgagggcggttcgaccgacgccttcaggacttcgtcgcctacttcatttgaggcaaatcttttattccgcaaaatattttgggtttttggttttccctaccattcacccctctctgataggtttgtttagtcttgttcgatcatatacctccatttttatttacatgggcagcgtaaaaaaaagagggagtataaatgtagcaatgaccaccccaaaaaaaaagacattaaccataacaggaaatacacaattatgtatattaagaatgttaaaaatgacaactgcaaataagatctcgatgaatagtttaggcacatgaaaactataaaatgtagcaatggcaccctgccctcacgacaaaaaataattataaattatatacagcattagggtggcctgttgaccaaattatctatgcaatgcttttagtttgatttgatacttatcgcatatgtggttaacctctaatttttcttacttcgtaggtttcaatttgccccacttgtgccggagagggtggagtcatttcagagtatcgcaaagaaatgtgctggagagggcgtgttcatgttggcaaggagatcaaagtaaaagttcctctaggtgttaggattccatcggatggctgattgagccgggagcgtttcagccgaagcccataggatggctgattcgactgagcccattcagcaaaacaaagtgggctcacaatggagggtaactggcgtttggttgatcaaggtggatattttccgtttcagttttactatatatttatggacaagttttctctcaaaaaattatgaaatgtaaataccctattgattataatttaattattatattataacttgtatgtaattttcatattataatatcaaattattaaatttgcttcaaggttcttgcaaacgtaagaggagaaaatcactgtgcgtgcacggggtgaggggattcgatatcacgacctccgctttgcaggaatcagcatgttacgacggaatttacgaaagttatatacaggatatattgaattacatgcatgattacatactacgactgtactatatttctgcccgaaaatttctctacaaaagcataaacagtcccgctgaactactactcctgtaacctgataggcccaattcaggcccacgaacgtgtttgggccgaaatgtgaacttgaacaggcctggattgaggcccaatacaactatgggcctaggtggaggcctcctgaacacaaaagaaagggaaaaaacccaagtgagaaaccctaaccgcgcgaggcgcctctcctcctctgcttgcctgccatggagttcgatcgccggaaggcggcggcgctggccgcgctcgcgtcgccggcgccggacaagtcgccgaagggcggcgtcgacgcgcccatcgcgccgctcctcgacgccctgaactcccacccggacctcttcaccacctcctcctgctccggccgcgtctccgtcctcgcgcagccgccgccgccgcagcaggccgaccccggcggggccaagaccaagaagaaggcgcggggcggcgggtgggtgtacatctcccacgaccccgcggacccggaggccctggtggaggtgctgttcggtgtgaaggaagggggagggggaggcgatgatgagctcgtgttcaggttcgagccgatgattgtggccgtggagtgcagggacgcggctgcggcggcggcgctcgtggctgccgcggttggcgcggggttccgtgagtcaggtgagcgtttgaattcgttcagctataggtagtgagatagatggtgtttggttgagttctgtgtgtagtttgtgtaaaagaattcatttcttctgcagtttacttgggtcatttagttacctgtattgtactacatttccatttggaggtgctgtaatttcttgggttccaattctgtttaaaatgggtaaaattccggatgctctttgaattttttaatgtcgatttgatagagtttgcctaaaatttaccggtgaattaaggcacaggttaaattttcaagagttatgctttgacatatttatgttttagatggagatagtgtcatttatattgtctttccactttgcttgccttggtgtgccttttcaaatattctgatcaagctttttttatggtaccatttttaggcatcacaagcttgcagaaacgtgtaatggtagcattgagatgctcaattcggatggaggtgccactaggtcagaccaaagagctcgttgtctctcctgattatattaggtaccttgttagaattgccaacagtaaaatggaggctaacaagaagcgaatgggtggattcctggatcttttgcaggctaaggtatcatttgactttgcataccggtaggcattacatacctcatatttgcacctttctggcattgctgctcatctctaactgggcaataaccatgtgatatcatgcaaagttgaagcatgtatttcctggatatcgatttgatggataaagagaattataatatcctttttccaggtagtttagctattggtcatcacacttctttgtgaagaaaattaattttgtctgtagtgaaaggctcattgaagattatttagacatggaaagcttttattcctcaatttacttattaattctgctgttccatataccaccttatcaataagtatatggagtatggatttagggaatgctctaggcctctatcactttgctcattgtgttctttataagttttaatgcattggttccattcaaactgccagggtctcctaggttcatccaaaggatgtgcaactgcagataatgaatccttagttgcaaaaaagagtagtgatacctataattgtgatgctgataataattgtgataatggatttgtggagatttcactagaagcatcatatttggagagtcaagaccctgtacttcaaaatggtgccaagcatggttttggtaatgctaaacggcatgttctcatatctctttccttttatcctgcttttatttcccctcatggtgtcatgtaaacctattggcctgttcagtccttccatacatatgttgaggagattttggtttgtctaagagaatattaccatcaatacataagtacatgttagttatgtatgctaggcctattgattcagttctgcacattgatcttgtacaataaagtcaataaatgttatttgaaaatgaaatttggtgatgctggcactgtttcacaggagggcatttagtaagccatatttttttatggcattaaattggaaatattaccgtgccagttggctacatagtcttttcaattctaactcataactcagcagctcttatatatatttatcctagatacagagctctttttatatgactaaaccctattattccgtttattttcttctgtagattaacacaagaggaagcattgccaacattgtcaggaaatacaactcactgcctttctactgctgcattggagattactggtgaacctattgagaagctcttcttatggggacaatctgcttgtgcactcactgttggaagagagcaccatatcctaacttttggtggttttggagggccagggaggcacgcaagaagaaattactctcttctggttaatcctgggtcaggattgctgacagaattaaaggttactgggtcgccttcaccacggatgggccatacaattactgtagtaggcaatgatatttatgttgttggaggcagaagtggtccttcagaaattcttaatgatatctgggttttggaaagatctaacaatagatggtcaaaagtggactgcagtggggattttttccgtccaaggtattgtttagacgaaattctttaaatctaattttcttttggacccaataaaaaaaaggttaaaaaaggggttaccaagtaaggcccaaaagtaagggaataagttttttgaaaaaaccaccccattggctccagggaagttatgtgttt

SEQ ID NO: 15855 - DNA, 1216 bp, Oryza sativa
tgcaggcaccgacatgctgctgctgcagtagatcgcaaagtatatgtctttggtggactaagtgatgatggcttatgttcttgcatgaacataatggacacagcaagtatccaatggaatgtgatttctcctgatgacaaatggccatgtgctcgccactcgcattctctagtgtcctatggttcaaaattgtttctgtttggaggtcatgatggtcagagggcactgaatgatttctatagttttgatacaacaacacttaagtggaacaaagaaaacactaatgggaaagctccatcccctagattttcacattgcatgttcatctacaaagactatctcggcatacttggaggttgtcctattagagaaagcagtcaagaaattgcattgctaaatttaaagcataaaatctggttttatgtatccattccatcattgagccaatgcctttgtgtccgtagctcatcagtcatcattgatgatgatcttgtcattgttggtggtggtgcgtcttgctatgcatttggaactagattcagtcagccaataaaaattgatctgcatttgctggagtcaatatttaagcttgcatacaacaaggaaaaagaaatgtctgtacaacacggttcagtgtcgaatgtagacttattagaaggacatgaggaaaattgcaatcccagtgataatgtgaaggtggtgattgatactgctactctaggttcatctcctttggtccttcagctagaaaagaagtatgccaaattagcaaaagacattctaaaaaagtttggatggttggatcttactagaaaagttcgagtaagccaggataacatccatgttctctttcctgttagtaaaacttttcatgccctaatcactgataagcatctcaaggtacaacctgatgattcatgtgtttttgaagaactattgccgttttctgaaaataagctttttggggccagcatttctcttcagaaagcactagaaattttgttgttatgccgtggttccattctgaaagatgaagtagcgatcagccgcaaagcttctaaaactcctcaaaccatcatgagagagcttgtgtctgttctactggataaaaaaggattgcctacccggttattggagcaactgccaactaggtttggtctctgatcttaaatggagtatgaaatataaataataaatccataataatctaagaaaa

SEQ ID NO: 15856 - DNA, 1812 bp, Oryza sativa
  unsure (1)..(1812): unsure at all n locations
ataagtgattttacaaaataagtggtcccttttttggatagggctaatgccaagttagtctacgcatgtgaatggaatccacatgccctggaggctcttcaacgtaatgtcatggacaaccatgtggcagatcgatgtattatacttgaaggagataaccgtttgacagcacctaaagtaatattggttccaaagtttacttgttgatctacctgcactaggatggcttctaaccatttacttctttaactgatattaggggattgctgaccgtgtttgtcttgggttgttgccctcgagtgaatgtagctgggacactgctgtgagggctttaaggtaaacctccccagagttctttccagatttaggcaatattatatacatacagagaggcctagctcaggtttgccaagcttgacttgtgcacttgtattggtatattggtttgtttttttttttaagaatgtgtttgattgagctttcacaaggtgaattcaagccatatcatgttaaagttcacgattgttttaaactttgaagaaagggaaataaacgcttggaatagctcaaagattttcgaataaacaaaatccctaagccaacagttccctgcagcctatcatcatccaactggtgacctctaagtctgctcttaagtgcttatctttgtaacccctaaaaacgtgaatataggctgagcagtagctcctaagctatctttgttactaagtgacggttggtagttgcaagctaggcaatctttagttaggttgtttgtcaattggcactctgaaantgcctcgtggtggttctttcagggtgcttatcgtcaacatgcagagctagtggttctagtggtatttttgatgggacagtgccacgtttctgaagttctcttaggctttcatgtgcatctcaaaatatccagaagaatgtagtataactttgcaaaagaaaaaatattactagacattatattggaaaacatacagggcactgaagcaactggatatgctttaaattacatggttacttcaccttgagagttgagagtcggaacacaatttgttagtggcttgttgatgtgctggatgcacgacgaacacacgacgaacatatgaagttctgactctgctgtgttttacttcatatgtagggctgaaggtggcatgctgcacatacatgggaatgtcaacgactcggatgagtcgctctggttggacaatgttgttaagtccatcactaacattgccaaaacacatggtacgatttgcccttttatacacacaagagttgcgaagcattcgacacggttaaaattaccatcttatgctaccgttgcttttcatttttgtctcaggactgtcttggaacgtcacggtggagcatgtcgaacgcgtcaaatggtacggtccgcatatacgacatctcgtggttgatgtcaaatgccgggcaacctaacaaagcgaaagacttgtccaaaatccatgtgctgtaggttgtggtgtatgacattttggctactccgtttctggttaatccagagaattaaactatttgcgtgttacttcagaaggaagtttgttcagacttttctcaatagcaaagcatctatcaacatttaagtatcatacaaaatatttcctgacatcttattggctgtggctgtgcctgtggtccagttttttatcagatgtttagatgctgtaaattgccggtattcgctataaaattgtcatttgttgaaaacatgccctgaattcctgaaagcaaaagccacatacatgatgtgttgctccccaggcctgatag

SEQ ID NO: 15857 - DNA, 2031 bp, Oryza sativa
ttcctgcagccctcagcaagtcataccgtaataggggtatgatgcagggaattaacaaagaagagctagagtgggtcagttgcatacagcgagcatttataaacagaaattgaaagatttaaacagttgtaataattaattaatattaaacatccgctgtccaacgctagcccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggaccactcgcataaccccctctaaccaagcacaccacacctcaggtttcacccccactcctcgcaaggcagcgggcagtcccctctcgtgcctaggtgaatccggaagccgcataggccgttgcagggcccatccaaactccatcacgcccacccttgcctggatgcgtcggctagaggaaagctacgctacaagcccagccgttgcccacgctggtttgtggtaagtacgataagttctttcagggcatcccgcgaaccggtccttaactgccatgggtgcgaccagcaaaaccatgcacccacagcccaccatgtgattcattttaattaaccaacaccagagcggtggtactaatccaacattatcattagaaccaacagtctaaacattaatatgattttccccattgtgaactagttgaactaagaatagctaagcaattcctagtccaaactctaatcatgttataaccccaagctaacaaaggagcatgatatccaaaaagcatggctgtaacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatctcaaagtacaccggagcgtcggaggaaacggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactataaaagaaaaaccctaaatcatttattgcgcaatatattccagggctgacgtcagcacggaggggggcgcggcgccgacaagcggggcccaccggtcagcgactcgggagaaggaggaaggggcgccggcacgcgggcccactggtcagcggctcgggaggaaaaggggcggcgacacccggctcggcttggctcaaggccgaccgaccggccgcggcgacggcaacggcgcgcgcgcgaacgggttgccggcgacggcaaccggcggcgaaggcgacggcgcaaaaggcgacgcgaaggcggctgcgctagcagcggctaggaaggggagggaacgggcggcgataaaggcggccgccggctcggctcggcacaaagccgaccgaccggtcatggcgacgacgcgcgcacacgcacgcgcgttgccgacaacggcaaccgacggcggagacggcggcgcaaaggcggcgccgaagggcggtgatgctaaagcgacgacgaacgggcggcggcgctaaagcggcggctaggagggagagggagaggaaaagaggggagggtgtctcaccgagggtggccggcgcggaggaagacgatggcgaacggcgacggcaagccacggaaggacgacgtcggcgggcgaacgagcttcggggtgccctaaggaaggagaggagagggattagagggagagagatggaccacggcgaccggaaaccatggccgaaggcggcggtgcaggtggtgctcaccc

SEQ ID NO: 15858 - DNA, 9095 bp, Oryza sativa
gtcggtgctaggatatatgcgagactgaggtaaaagagatggagacgaggatttttatacaagttcgggcccctgagttgtcaggtaataaccctacatcctgttggccgaagtcggtattgctcttatttatgataaccacaccagtacaatgtttggggtagcctatctaactgttgtcgacatgtcagtctgacgatctgactcgtagtcgacaacagggtagccttccacctcgaatccgtgcccggcgagatcagagatagcgctttcgtctttcctgacagtatccggagacaccgtaggatactagccgtgtttatccctaaagtcgatatccggcggcgtgtcttggcgtatgtaggcttctatgttgtggcttctatgtcgattgtgttgggtgttgattgtctcatggtgggtgtccccctgtcctcctaggggggcttgtatttatacccataggtgtccccttgtccaagtagaactagggaaaccaatatgcctacaatccgagtagtacttgtcgtttccatgtagaactctggttgtctttccttatcggaactcctcctatatccgaaagttgtttctgtataggatatggtatgtggtaggtcctgccgagatttagtcaactactattaagtatgtggtatccataactatgacagtaacccccgacttcgatgcaaatgaacgagttcatattctcaactgcagacttcggaggaactgttatcgagctcacgtgaccattttcggtgagttcagagataacgttagacttcctttgtcagcctcgtgcgggcaccgaaagggtttgtctaagtcaatctctgatgtcgaccgaaaaagtacagagcgtacgactaagtctcccgtcttgctgtaatcgagaatttggatcgaagtcaagaaattttatctcggcgggtacaccatttcttcattccgtattccttgtcgagatccagcaaccattctcgagtgatcgagaaggcgtagagtctgcgacggagccttgtcgacatttgtcgtactcgcctcagtcgatcttggtgtagaaccatggagacatggagtcttcgtcaatgtcgaatagaattttcctgaaatcaatactcagaaaagaatatcaaatagaaatagcccccgagcgaacgctcaaagggtgacatgttataatatgtatggaaaaaatgaattaattttaccgaccaatgttttgtgtataagcgtcttctctcttaccgacttcgatcagtcagtttgtagagtcatacactctccctagcccccagccttatcgtcggagaatcgttctcggaggataaggctcttggacccttgacctgccttagttgaacaagaactgatcctatcccccagccgtgaagttggaaagttaatttccgattacacggcttggttaatacgcacggcgagaactcttacacgaccagatcttacatggtctttcttctctacaggatccgacaaggccttatcggttctaggcgtccccagccgaagatcccttaggttcctcggaggccttgtcaagacggcgtaaagggacagtaggataggtttcaactctaggtgtcgtcgtggtaagggatctctgggtaaaacacttggcgatattgcatacctgctatcaactttgttgaagtagaggtagtaggagaaatcactacaccgctagttgaggactaggtagtagtcgtaactcgaccacgtaaagcggaaaatagtgggagaaacgctacgtcgctagtcgaggaccaggcagtagtcgtaactcgagcacttaaagtgaaagtagtgggagaaacgctacgtcgctggtcgaggaccaggcagtagtcgtaactcgactacttaaagtgaaaagtggtgggagaaacggtacatcgctggtcgaggaccaggcagtagtcgtaactcgaccacttgaagtggaagtagtgggagagacgctacatcgctggtcgaggacaaggcagtagtcgtaactcgaccacttgaagtggaagtggtgggagaaacgctatgtcgctggtcgaggaccaggcagtagtcgtaactcgaccacttgaagtggaagtggtgggagaaacggtacgtcgctggtcgaggactagacagtagtcgtaactcgaccacttgaagtggaagtagtgggagagacgctacatcgttggtcgaggaccaggcagtagtcgtaactcgaccactagaagcaaatgtacgagagatcactacgatcaactggttgagaaccggtgagtaggtgtctctcaatcatttggagtcgtggcacgaggatcgctacgctgccggtcgaagaccagttgtagctgttcctcaatcatctgaagttatggtgcgaggaccgccgcgccgccatagtcatacctcgaccatctgaagtcatggtgcgaggaccgctacgccgccgtagtcatacctcaactatctgaagttaaggcacgagagattgctacgtaccggttcgagaaccagcgagcgagtagaattatctctcgagcaccaatggaagctgtggtgtgagagattgctacgtcctggtgcgagaaccagcgagcgagtagaattatctctcgagcaccaatggaagctgtggtgtgagaaattgctacgtcttggtgcgagaaccagcgagcgagtagaattatctctcgagcaccaatggaactgctcgagttggtttattacatgtgcgtctcatgtggccagcatgactcacacacccaactcgtggtatatccggatgtccgttctcaatcatgtcgggtgatcaagccaacggcgttcgccaggaattatctgttaacaaccttttctcgagtagtccagcgatggccggtgctatgagataggtcatcggtcttcgttggtaggttgggtgcgataactccgcatttgtcgagaatgttctcgataatggagtgtactcgaccataacctacccgagtgctcaattgttcctgaaaaatattttctagaaggcaagatatatagcagataatatcgagtatgtattcgaaaagctgcatggatcttctagaattatcaggatataacgagcagatgtaagtatcaggcattatgtaaaccgtaaacaagcatgatttatacagaagaaaacagagcgagccgccagcgttaaaccgtagttgatttaacatcggaaacactcgcataattgatattgtataaaaaatatgctctaggtaaacataataaattactgatatgacaatgttgtatgatctgaataggtacgataaattgcatataaaatattgcgtacctttgtagatatatgccgaatatatctacgaaattagtagattaacttagtaaattaatccactaaataccttgatttgcatgcccgatatactatctacagaagatatatatatgtgcatgcggtagactttgacgtatcttgttggtttggtcgtagagcagtgtaacctgtcacatgcatacacgtgtctaggcatgacacgacacgtcagtgacacagcggcacttgttctcggatgaatcatgtgcagcctgcgttgagcgattttggttggtgggaatcggcaccgtgttcgatctgggccgaagtcgcgcgggcggcaataccgatttgccgtcctccatggtggctacgtcttgatgaagattgatcgatctcgccggatcgaaaatttgacaatgatggttccgatcttattggacgacatactccggtcggattagatctccccataaccgaagttgtcgagtagcatgttatcggagaatccatctcttaaactcatctcgtcgaaaccctgaagcaccaaaatccccctacctggcgcgccactgtcgacgtttgatgtctcgactacggtatttggacagtatggggatcgtcggtgctaggatatatgcgagactgaggtaaaagagatggagacgaggatttttatacaggtttgggcccatgagttgtcaggtaataaccctacatcttgttggccgaagctggtattgctcttatttatgataaccacaccagtacaatgtttggggtagcctatctaactgttgtcaacatgtcggtctgatgatctgactcgtagtcgacaacagggtagccttccacctcgaattcgtgcccggttagcgctttcgtctctcctgacagtatccggagacaccgtagggtactagccgtgtttatccctgaagtcgatatccggcggtgtgtcttggcgtatgtaggcttctatgtcgattgtgttgggtgttgattgtctcatggtgggtgtccccctgtcctcctagggggcttgtatttatacccataggtgtcctcttgtccaagtagaactagggaaaccaatatggctacaatccgagtagtacttgtcgttttcatgtagaactctggttgtctttccttatcggaactcctcctatatccgaaagttgtttccgtataggacatggtatgtggtgggtcctgccgagatttagtcacctactattaggtatgtggtatccataaccatgacaatatgttttctcaatgtattattcaaatatattaaaatgacaacataattttaaattttgtactacctttacgaaactagtaatgtataatatttatattgtattttatatacaagttatttattaattatttttaatatcaaattttagttatttgtaaattatattcctatatggactctaggctcttcttccaatatgatttacttttaattctaaatttttattatttctaattgtatttctatgtggactctaaacttatttttcaatattccctaatttttaatttcgaatttaagttaattctaaattgtattcttatattgactttagactcttcttcccatgttttttttatttcgaattttagttatttgtaaattgtatttttatacgaactctaaactctacttttaaatttattatgtttattccaaattttagttagttttaaattcttatatgtactctctactctacttctaatattccttatttttagttccgaagttctattatttcttaattgtatttctatatggactctataccctactactattattctttatttttaattccgaatttctattgtttctcaattgtatttctatatggactctagtctcctctcccaatattccttattttttaattctgaattttaactattttaaattgtatttctatatggattctgttttctttttctccaattaatgtaggaatttctaggccatgagagtgaatatggaggctcttttttctattcctttaataagttaatagatttgggtacctgatacctggtaagagctacacaatacccaatatcagatcaggtactataggtatcaacccgatctagggaccaagtacctaataccttaggtacccgatacctagtaccaggtctggtacctactggtatctgaccgatgtagatactaagtacatggtatttaggtacctgatacctagtaccaggtctggtacttatggataccatcctgatctagggaccaagtaccccgatacctatactatcaggtctagtacctatggtactaactcgaataatctaggtaccagttacctaatatctaggtatcaaggactcgatacatagacattaaatacactgcacgtatcatgtatgatttgtgggtataaggtcttcgagccaacgagagccatgaggaatactatacatatgcccaagctcttaactctagtgcataaaaagacatactagaagagtgttagagcaagtttaatagtatagccaaatattagctccaaatcatctatagctaatctaataactcattcatgcaatagttacctataaaaatatactacaccattaatacactgtcctacctcttatacacacacaacggcttggggtccgtgttgcagctgcctacaaatctgtaacccgctttcttttctctcttctcttttcttctcgatatgtggttatagctggcttatagcctgctattgtacttgctcttagagcaggtctctagtgtgaactttggatgcataaaaaggtgtaccaatgaaaagccagtactacttagaaaagtgtggtatacagcggtactaaaaaaactatgtcggtgacatgggaccgggagtatcatgacttatagacttgaggcagacacgatcacccacgtggcctaaccccctcggggggggtcgggcccgagggtgatgcggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccggtcagatcgtgggttaggtggcgacaggcggtctgacgcatgcctcgccccatcccgtcaggacgagagcctccaagcactcgtccctagccggagccggcgtgttagctcctggagatggcacgttggttccagtcagatatatgccaggcttcatcctaaccattacaggcaagatgttgtatgaagaagggcgaacatgcagattgttaaactgacacgtggtggacaagaatgaccgatttgtgaccggtctgtcaatggtcatgtcgtcagcagatagccattttcccacgtcgcgcctgcttccggcggaagtggaggtaggtatgggccgtcccatcagaaggtcattcggacagcagccatacaaatctccgtccattaatgaagagaagtcaagttggagggagagagggggcatgtggtatccccttgagatataaaaggaggaccttgcccacttagaaaaaagagggagagaagaaaaacgatcccagaaggatcgggggctggctcgcactttgtagcttcttcatacacagatccaccaaaacacaggagtagggtattacgcttctcagcggcccgaacctgtatacatcgcccgtgtcttgtgctttttccattctcgcgaaccttccacacacagacaaggagcttagaacctcacccaggcccccggccgaaccggcaaaggggggcctgcgcggtctcccggtgaggagccccacgctccgtcatctggcgcgccaggtaggggcctctgcgtgtgtttttctaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgccccctccacgccaaagtcctagccgggaggaggcgctcgagaaggtcgaaggatccgtgacttcgacatccacgggtgatggagaagggcagcgagatggggagcgtcgcctcctcgtctacggcgacggcagcacgccccagggcgcgctccaagctgcgggcgcgctcctacgtcacccgcccattgtccctgacctggagtctccagcccaacgttggctggacgacgtggccaacttggtcatgacggcacgacagcgcctaggtgctggtgagcggtccaccgccaccaagacctctggagctgctaccaccggctccgtgtcgtcaaggcggagggcgcggcgagcggcggcggttgctcgccattcggccgccactccttcgtcagcgcctccgacccgggaagatctgcgtagggggccagatgcccgcatcagtatcgagcaccggcgtaatggccgacgtgctgcccacgcaacggagggcgcctcctcgtccggagtgtcacctcgacacggacacggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttatgccaacagttcaccatgaactttcaaggcacatatccgcgcccaggtgaggaagcggacttgcacgcagtacagcgaagggatgatgagtcacttcgctcatacattcagcggttctgtcaagtccgcaacaccataccatgcatccctgcacacgaggtgatctacgcgttcagggggggtgtgcggcacaaccgcatgctcgaaaagatcgcctccaaagagccccagactaccgcggagctttttcagctcgcggaccgagtggctcgtaaggaagaggcatggacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgctccgcgggccacccgaaaggggaggcctgcgagcgacaaaaagaaggaggccagcgctcccagcagggagtgcccaaccggcaagtggtgcaccgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactctcgatgggggagcgtgtgctcacttttctcgtcggagcctcaaggccatgaagcga

SEQ ID NO: 15859 - DNA, 4548 bp, Oryza sativa
ttcctgcagccccactgtttgcaacgtgaagctggggcgtgtcctcattgatgggggagcagccctcaacatcctttcccccgcagcctttgacgctatcaaggccccggggatggtgctccggccgtcccagccgattatcggtgtgacgccgcctcacacttggccgctaggtcatatcgacctcccggtcaccttaggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcggcgcgcggaccacctcaccgccgcgtccaagcccgagggaggcgacgagaggcttggcacctccgcccccgccgccccgaggcagcggatagtcacatgcgacgaggtcccggtcaaggaggttgccctgggcgacggcccatccaagaccacacgaatcggtggtcttctggatggcaaataggaagacgcgctcgtctccttcctgcgggcaaacgctgacgtcttcgcatggagaccggcggatatgcccggggtccccagggaggtgattgagcaccgtctcgccgtaaggtcgggcgcaaggccggttcggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgtttcctagatgcatactctggttaccatcagatccgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactcttggatctagcggagacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttatttggacggaggaagctgaacgtgccctcactcagttgaaggcatatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagccgaacggtggcccaaggcccccgacgaccggagcaggccctctgcccgcttgtcagacggtgccaggtgcccccgaccccaggaaggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggaggccccgacccccaggacggccccgaggccactgtgggaaggccgctcctgtcatcctccgaccccgaggtcgtcggcacagaagacgagtgcaccccgcgaggccgctcggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaattgcgccattatttccaggcgcatcgggtcacggtggttacgtcttaccccctcggccaaatcttgcataatcgagagggtactggacgggtggtgaaatgggcaatcgaactttctgagtttgatttgcactttgaaccacgccacgctatcaagagccaggccctcgccgattttgtggcagagtggaccccagctcccgagcccgtctcagtccccgaggccagctcgggcccctcgcagccgcctcacaccacccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacggggtaacacggttgccgacgaactctcacggctcgcttcctcgcgagcccagaccccactgggcgcctttgaagaaaggcttgcccagccgtcggcgcgacccgaccccttaggggagacggacgcgcctgacaggcccccgatgcccgtcggagtccaggcctcgggacccgaggggagcgctcccagctccctgagattgattgcttggatcgctgagatccaagcatacctcacagataagactctacccaaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccacttcggcttacgcaccttggttggcaaagcctttcgtcaaggtttctattggccaacagctctcaatgatgcggtcgacctggtccggcgatgcaaagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgattgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagactttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctatgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcggcctcgggccaaccccgcacccccctcgggcgtgcagggttggccgggggctaccacatatgcatattcttatttctcttatatctgtatttcaataaagagagaatccattatatgccactgactttgtcacatgtctatgatttgccactgactttatcacgttctacaatatgccatcgacttttgcttaactgctacaattta

SEQ ID NO: 15860 - DNA, 1167 bp, Oryza sativa
cccggacaaaaacattcaaaatttggataaaaattctgaaatataagattttaagttgttggccaaattttggatgtttacaatcttatgtttataatatgatattttgaattttttatccaaattttggaagtttttgttttaggggtatttcggtcatttggataaaattgtacagtactaacggaggctaattggacggcgatggtaaatcgtagaagttaagcaaaagtcgatggtatattgtagaatgtgacaaagtcgatggtaaatcgtagatgtgtgacaaagtcagtggcatataatggattctctcttcaataaaagcattttcaatttcctaaaggttgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtcttatacacacaacaaatagaattgacacaaaaaatttcctctttatttgattgcagattaaattagtctatataagaagggggcccgaaggcctcggaagaagaaaagaagaagctatttaaagattggcgggggcctgggggctcactccgatgcacccgggtcgccagcctcgtcgccaccgtcgcccactccgccgtcatcgtcctcctcgtcggagttgagggcgaacgcgagccgaggggccgaaccctcgaagctgtggacgatatggtcggcgacgtcccggacctgcgcgcgcgcgccgtcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccg

SEQ ID NO: 15861 - DNA, 3029 bp, Oryza sativa
tgcaccgccagtgtgacctcccgaatagcaacggcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcatggtggtggcgatgagggcagccccccgctcctcttccacctccttggcgatctcccccagcaccttccgacgggcttcgagctctgagacgtgccggcggtgtgccttgcggcccacctccaccatggcctccaccgagtgtcgcccctcttcgacacgcgcccatgcggcgtcaagctccgcccgctctgcctgcagggcctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggactcgtcgcgagctgcctcggaagtcattgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggcctcagactggccagacttggaatggcgggagggacgcgacgggatctcgctgaaacagaagaaagaccagaagacaaacaagatggatgagtgaaaactcgcgttgagagaatgaatacggccacgatgggagtgggacgaacctgcgagggggtcggttaaacgaccaccttggaggggaaatgaggtttccccgggatggttctgtcccccccatcttgcgaagccgtttcttcttccgctccccctcgggctgcgacgtcggcgtggccccctccgggcgcctgctgctggcacgcgccgccccgccccctcggggaggagatgggggaggggtttcttcctgcttcctcttcccccgggcgttggcagggcggccgctccccgggcccccgtcgcggggcccagaagcacgaccccctcccggggtagattgttcccccctgcggctcccgcccgcgccatcgtggcctcgaggagcctgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaagcggttgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgaggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgcaccctcgtttctcgcacccacgcttccactaatcccattcgcccgtttgcggtgcatgaggtggatatgcggctgtggcagtcgagatggaacatctcatgcgcgcgttaattacgctcgctgaccgaagcgccatcatcatatctccaggaaaaacgaaccggcttgtcccgatttttagaccggccccacctgtcaccaggccttaggaagtggcgtcacgcccgaccgcttccctcgaggagggcgatcgccctggcataacgccgggggctgctgtcggtgacatgggactgggagtatcatgacttagagacttgaggaagacacgatcacccacgtggcctaaccccctcgggggggggggggggtcgggcccgagggtgatgcggccgcccttctctttgtctccccgaggggtcggaccgctcccgtctcggccccgagggccgaggcaccccgaccccttgtgggttttgcgccgcgtatatggggtaggtgagcatagcggggctcacctaaccacatttattgcgg

SEQ ID NO: 15862 - DNA, 6069 bp, Oryza sativa
cgttacgcctagcccaccttcgcatgcacttagaacatatttaaatcatggaaaataacggttcactcatatataacttatcccattgtatagacggtatcttgtttcctagtttttcaaaaaagaaaaaaaaaaccttttctgttggtcttgtttcaaaaatgctatttatcgtgcgcccgacggagagaagaaaatatcgggcgctatttcccaaccacccgtgactctgtctttctcgcacctccctttctctctctcacgttcgacgatgttttctctgcttgatgccacagctgccgccgccaccatcgacaccatgttggacatcagctcatccgtccaaggatggaacaaggcatgccgcctgactgtgattgaggggtgtttacatggaggcagaggcgaaggttggtcgactcacacggagcaacctggcagcttcctgtccggccgtgaacggcggcaatggtcgtcttcttcaccgcggttgtcgccagagctctcgtctccacttgctggatgtctacgggtgtcgttttttcggtctactcctgcactgcagccattggaggagagggaggaagccagatctgattgatattttcatgattttttttatgttttagccgatgtatctcgatatttctttgtgattggatcaaattgttacagcgagatttcttatggtgtttcaattttgtcttttgatttttatggatttgttggtgttttagtaattgaactttgatgtttcatgtttcaatccatgattcaatcatgtttcatcattttaatagtctgaaacatgtgttaaaccagtggtgaaacattcttcttaaaaaactgaaacaatgcccgatttttacaacaaaaatagggagccccatttctaggtcctccggccttgtttgcttgaacccactagccgagaaaaccgatgtcacataaatcctgtccaccacgcatgacgtatttggcccaaagcccactacttaatccacagttcggcagtttacatctcttcggagcaacaaagggaaacaaaataacattgccgcctcaactaaatttctttgtgaacagactactactaattcttttgggattcgttgacgttgttgagagccaaacggttcgtctgaacgaaaagtgaaaatgacattaccagctagatgctttgtttgctgcatatccaggctctcttgatcaacaaaggcaaggaaagccaaaggcattcaaagaattggaagctgaatcctagctataagatcaaagttatcagcaggtggattgtaatcatacatgtaatcagagggcagctggattgtgattctgatccaaacacttggatcaacaaaaccaaggataacatgcatcatgcatgcatatattggtaaaaaaaaatgaaacaagaagagaaacctcgatctttcattcataatcaatgagaaattacagttccaacagattgcatgttcttcttctcatgccaagaaatcatcctatctatgagaatttacaagaccacattgccttccatgcaaaaccaagacatgttctgatttatacgagcttctgcagctactgcacctactgaagaacactgatcacgatgccaaaaaggcctcggatttggcacgcagctgctccttctccagcacaaacatcttcagccgcggcagattcttgccggccttgttcggccgcggggccgcaatgtttgccggggtcggggccgggcgcggcgccggcagcttgacgtccttgacggcgacgcgcacggtccggaaggggtcgtcgcgcgggaagttgccgttgtagatgacctcgaggtgtccgtcgtcggcgtcggagacgacgaccgcgccgagccacatgacgaggcgcagcgccgtggtccctagcctccccaccggcgtgcggacgcgcacctcgtcgcccttcttgaaggacatcttgttgatgggcgatcctgatcctgacggcttcttggagactactctcccctgcgcctcgacggcgagctcagtgcggcggtggatgatcgggcgcgaggagcggggactcgagcggcggggaagcgccatggacgagcgccgagagctgctgcgatgatgggtggaaggaattgtggtgggggcggcgcgcttggatttatcggcagccgagtccgagttcgaattgaagtctgtgaaggaagcaaagcgtggctgtcagacacaattcttcaatccgagctcgactcggaatcggagacgtccgttacgcctcgccaccatcatgcaatcccgaatggcgccaagcaggcgggaacgcgaagctaggtgtgtgtcgccgccgccgccgccagcggtggacaaggagatgacggcggctcagcttccaccatctccatatgtagaactggtcgcaaaaatttttattatttctaattgtatttctacgtagactcatgtttcaatattctttaatttttaattttgaatttcagttacttctaaattgtattcatatattgattttagactctacttcccatgttgttttattttgaattttagttatttgtaaattgtattttttacatgaactctaaactctaattttaattttattatgtttattctgaattttagttagttttaaatttctatatgaactttatactctacttctaatatcccttatttttaattccgaatttcaattatttcttaattgcatttcgatatagactctatactctacttctaatattccttatttttaattttaaatttcagttatttataaattgtatttctatatggactctactcttctcttccaatatttccttttttaaaattttaattctttttttaattttaattctgaatttcagttatttataaattgtatttctatatagactctaatcacctcttccaatattccttatttttttaattccgaatttcaactatttctaaattgtatttctatatggactctgtttttctttttctccgattaatatgagaatttctagtatgtgagagcgaacgtggagactcctttttctatctatctattatatactaaataaaagtccataaaacttcctacaaacgctctcaagccgccacgtgggactcctacaaacgctcctaggctgccacgtggcactgtctaatctcaccgttgattttcacttaaattggtggacctgtttatttacaccattagattagatctattattaaaaaggtgatagtttttccccttaaaaaacatatgcaaccggtggctgggaaaaggaaagaaaaaataaatgtccctagggaagtacaattaaaaaacggtattgctaaatttgtgtacagtcgaatgttttaaccgtgagatcgtccagtaatattcgtttcaagcacttgaaggctgcaccccatcttacagcttatgcgaaagaaccaactgcacctaatcaagctctaaactcattagcacttcacctccatcgtaaaactaataattatttatatatttatacgaatttacactgtagttacactccacttatatatgtaattagtatataaatttaggatttacatatgtaattttgggacttatattataaatacactaaaattgcatatgtaattcagggaattacaatgtaaatacataccgactattttttggtgaaaaatatggcgccataaatatagctactccctttttaaaaaaaacatataaagctacctactgttagctggaagaaaaaaaatagacatctatgtacgataaaataaagcaaaaaaaaaagcgtactataaagaaaaaaaagcgtacttagtatccgtggaaaaactacggtctaaaaataggattttgtataatataaaaaaataaaatataatactacatcatatacggaagtatatgcatgtaatcgagatctataataaaccaatagattagatcttgtaattaaattataagaaaaatcaatttaatttgatgtattaaatctattttttaagaaaaaatcttgagtcaccgtgtgtcacgtcctataaaaagggaaaaaccttagaaattcttagaaaaaatgaaacacctcatcattggctttcacttaaattatttaaaaaagttagaaaaatataatctccacctcctcaccatcacatgtacacaacactgccatcccctccctattgttttatctattaaataaaagagaaacaataaataatgtttgatgttttttttaaacaaagtacaaacgcgggcgctcacaacgcgtgcacaatcacttctgtgaacgcacacatgcaaatacccctttgagtattttgaagagactaggctgatatattttgagattgacgaaatcaccacgtacgtcttgatatcgacgggtacattgcctactactgaaagaatttgttaagtctgaactcgagcaagttccatcacaagaaacctaaccggttgagctacgttcatttcacaataatattggatattaaaacaaccataatttttaagctacattcttggagtactcctatatctttaaaaccggtagaaccattatttctaaccgttagaactatcttataaaaggaaacacaagcgtgtattcatggtatgtcacatttcaaaaatattattgtacaattatatttcatcgttatcgtatgcacgttagcttgcgtggaacctcttacccactctacatgaaatgttcatagatggaccaactctcaaactacatcaatcatattaggctatataaacccatatatttagtggagcttcatgtctcacccaattcatcatcgaataaaccataataatacatatgcaattaaaaaaaaagaaaaataccttagtttaccttacacttacatttcgttgacatgttttctaaagaaaataagtctaccttcttttccaatgatgaagaagattataaataattgcttataaatatcaggtaaatatgatgctgctataatataaaactaataggttagaaaattaaaagcaattaatgttcaacaaaacaatttacgaagaaatcatggtagatgttctatggttgtagatgttctacggttgatattttgctcttataactgtgtcaaacatagtgtacaaaacgcatgcccacgcattcgcgcgggctacattcctagttcctttaataagttaatagatttcccttatattttgcctaactggaaaaaaatccacaagagattgggtacctgttgcgtccagaactatgcaagaatcaagatacctgcataacatctaatcaatatttacaatgttcttcgatgacaagtatgacggtctatcactttgttttgcagcctgtctaggtgacgtaagcacatattcgttgaacttttttttgttgtcgtgagagcagggtgtcattgctacatttatagtttttatgtgcctaaactattcatcaatgtcctatatttgcctagtggttgcagtgacctgagtagcacccaaggttctaagttcaaatctccataggagcgaattttagattgggttatttgagagctaaaaggttctaagttcaaatcttcataggagcgattttagattgggttatttgagaactaaaatattgcatatgtctagttggatgaagagttcacgtaaaaaatacccttctcaaaaaaaaaaaaactattcatcgaggtcctaggtcctatatttgcagtttttaacataattgttggatgtagagttcgggtaaaaaaatacccttccctagaaaaaaaaacttttcatcgaggtcctttctatatttgcagttttcatttttaacattcttagtatacataattgtgtatttcctatgatgctcttctttgtaaagaactcattgatacaaactaaatgaacaatttggcacttctataatctgtacaaatataagcctgtgaaaaacattatatgttcctgaccttagtgcgctaagtgtagagtaattatacatttaacatggattggtcaatttatgttattgatcaattacttgag

SEQ ID NO: 15863 - DNA, 682 bp, Oryza sativa
ggcctgaagcaaatgttcacaaacatggacacagacaacagcgggaccatcacatatgaagaactcaaagcaggattagcccaacttggatcaaagctttcagaagctgaagtaaagcagttgatggaagctgtatggcaccaatcctagactgttacagtatttttctgaaccatggtttattgaccttttatgctgaccttttctgatccattccaggttgatgtagacggcaatggatccatcgactatgttgaatttatcactgcccaatgcatagaccccagccttcgaaagagatgagcatttgtttaaggcattccagtattttgacaaagacaacagtgggtgagtattctgaactgtcacattgaaaaaaactcacaagtcgcagtattttcacaatggcagtccgccaaatatgattatgatcataattcacaggttcacattttataatatctagtgctcactagtctagaaccatcattggaaaaaggcagttgtacaatgccatctgcgcatcaaactccccatggttgatctgactagagaattacctcaattttatgcagcttcatcacaagagatgaactggaatccgctttaatcgagcatgaaatgggcgatacaagtaccataacgcatattatatcagaagtcgacacggataaatgtaagt

SEQ ID NO: 15864 - DNA, 542 bp, Oryza sativa
agagtcaattgcctaaattgatactaccttcttggaggtacctacgacttcattgtacaaacagatctagaactagaacgatacatttacaggggtgtagctggaagcctggaaattggactgttgaacataaataatgcagttacttgcgtcctcgcctccttggtctcctcaggactcaggagccatcaatcagaagtctcaactgcagacaagtaaaaatgaagatgtaataatcctggtgcccaatacaataaaagaagtaacatatttttaacttaaccaattcgtcaagtatcaggccacaagcataacaaccgcaattggctaaagttaataccattgtgcaacctgcaccaacgaagaaaattgcacctaaaacactaccatttcggggggtgaattactgtggatcggatactccgattgttgtactccagtagtctagtgaagaaaagaaatatacagtgtgctatttttcttcatttttttagctgtacgggttttaaaaaaaatcacactaagttgattgcaaatggaga

SEQ ID NO: 15865 - DNA, 962 bp, Oryza sativa
aatgacttacattgtgaaacggaggaagtagcacattgagtttcaccaaatcagccaaaaaagatccagatcaaagcaagcatttaatatgagacagaacatcacagaatcgaaaaacatgattcagggcaaccagaaaaatagagaaaccatggatggtgaacaaaaggctatcaaaatcaacaagaaagaccagaaaaatgcagaccatctcagatatagagaagagagaatgttaatcaattgagttaagttatatttcaagtttgcatgcctgcaggtcgactcgataagatccccaaatgtacattctactatcctggatggttggatgcccacattagcaccactgtaccaccgctaaaccacaaaaagctcaagctcagtatcctaacttcttacactgcggcagttacataaatgactacatttatatactgcaaaaatttcagttttgcaacccgcctgttactcgactacagtatggcaagcgctcaacgcaacctaagcataaaagatacaaacataaaacataaacacgaaaaatctcaacaggagtgcacggtgcttacaatccaattccgggtcttggcgaggcgacgagcaagagcatggatgcagtaggcgacatccgcccgaggcctaccgatggacgtcgccgctgcaatctctgcaacacaaccaccaacccatcaaacaccaaacccaacagagaatggggaaaaccccaacagcaagtaccctccatcccaccgaacaatctcaattctcaaatctgattccacacacactgaactaaattaagcagaaaatcgcaagcgaggatataggagattggcagattggtagtgaggacgaatcaacgtacttcgcaggtggcgctccttgggcgggcactcgacgtggttcgtggccttcacaatcgccacatccagatcctacagaggggaaaaggaaaacat

SEQ ID NO: 15866 - DNA, 1303 bp, Oryza sativa
  unsure (1)..(1303): unsure at all n locations
tagtgaggacgaatcaacgtacttcgcaggtggcgctccttgggcgggcactcgacgtggttcgtggccttcacaatcgccacatccagatcctacagaggggaaaagaaaaacatcgcaaactaaaataaatcccaatggatgcgtacaacacagatccaaacgcctccccctcctggactcctcgtcccccagtcggttgcggcaaatcggatgaactgaaccagtttgcgccactggattgggggagggtgcaaaagctcgacgcggaccttgaagtcggagttgagattggcgaggctgacggtggtggtgtccttgagcgcgccgtacgccttgcgccagctctgcagcgccgacattctctgctcctcctcctcctccgctcgctcgctcgccgccgcctgctgccgcctcctcgacttttttttttctctctctctcccccctttgcttctgattatttttttctctcagccctgcggcctgattcgatttccggctacgcgtccgcgagattgctcggtgcacggaacggcaaataaataggaaggcttcgtttttccgatattgccaaatgtgaaggcgcgttggcacttttcatcacaccttctaaagcctgacgagcagaagctataaaaaggatttcttttaaatcgaggagagatgaaactttttaaatactcggatttaaattagaaaatgaatcacttctcgaatttaaaattccaatggccgcctgagacagcgtgtccagatgattggtttgttggattgttgattaattgggggaatctcatattttagactgtaacagagtactaagtagtagtatttttcaagcctaattcgaaggcaataagctagagtcaattcaggccggctgctgctcctatcaaaagcggtagtgtagcagctggtttggttaccaggcagttccatgaaagtgtttaggttggctggtccaacattgtcaaaaaggcccaattaagctacggtttaaaaaatttgggaaaattggaaccatgccattataattttataaaatttgagatatgtcattctaactcacatgtcattgactcatgtaggtcctacatgtcattgagataccaatgacatatcttaaactttgcaaagttataatgacatgtttccaaattacccttaaaactttggttaaacctttcttctgcgcatggcttgactcgtgagcatgcgctaggcatgatagaagaaagaatctcagcannnnnnnnnnnnnnnnnnnnnnnnnnnnnnnnnnnnnnnnnnnnnnnnnnnn

SEQ ID NO: 15867 - DNA, 1699 bp, Oryza sativa
cttggatgtgaggacgaagcagacggctggcgttggagtcgaccggcagttggtccgcttgcatatggcacagaaacacactgacacgcattcggcccgttccctcgatgcgtcgttcggaatgggccaaaatcccggccctgtatttggtgatggcctgggatttcagtggacttagcaagtcagaagcctgtgagagcccaataagccctacgctgtggacaaacttctgccgtgcgttttgttatacactcttttctttgccatcgacggtttcaccagtggcgcgacgcgatccgcgtcaggcgcatctgacggatctgcttccttctggaccgaaaattgtgcgcatgtatgctatcccgatgcagcgtcttgctattataactccaatcaaactacgaattctggtagaggccctgacgatctacgtgcgcctcagcgagggccccaaagatcaattctccgccctcgccatccatgtgatggaaaaagtgcaccaaggtccctcaacttgccatcgaattataaaattatcccccaaccacaaaaccggatatccggtgtccctcaactaaccaaaaccggtcataataggtccctcggtggttttaacccggttttatcctatgtggctgctaactcagcgtgggacccacgtgggccccacatgttaggctgccacatcagcgcatactctatttccccctcttctctctgttctctccttccttcctccccctcgctctctgctctcgcacgagcggcaacgcgtgcggccggcgacggtggctcccgagtggcggcgcgcgggctcgccggcctccccgtccccctagtgtggtcggcgatggcggcgtgcggttgcggccatcatgcggaaatcgactcgacgacgccgccatcaagtcgctgccgtcgggcgtcggcgatggcggcgcgcggctgcggccggcgggggaggcggaggaggtatgcgcggacgacctcgccctcgtcgttgatgtcgccaccgatgaagaggtccgcaccgctcaccagttcgcatgcctcgtcgtcgtcgacactcgccactccggtccggcgggggcccagcgaacaagcgacgagaagccggcggcgcggcgcccccgccgcggacgagcgacaagaagccggtggtgtggcgcccccacccgaagccgccgacgacgatgaggccgagcggcgcagagtcgtcgacgccgccgctccccatccaggtcgcgctcagggtcgccgcgctgaaagcggcacatccagcgcctgatgagctgccgcgcctcatgacgttgcagttcctcgccggtcagctctcccctgtcatggtcaaattgcaagggatcgattctcctcaactcgggtacatccaacctgtcgtttgattgcgaatccatgtagacgaagctatccagctgcttggtgggtgtggcgccgccatacgacggcgacgaggctaccgactcaccagtgaactacgacctctcctcatgcgaacacatcctgtctctgaagatgtgcgtcctcgacgccatccatggtttctacatctgggcactcgccgtgctcccatcggcgacgattggacgacacggcggtcattgctgcggccctctcgaatccgcttccaacatcatccaacgtcaccgtatggtacgccgccaccgctcctcctctgcct

SEQ ID NO: 15868 - DNA, 608 bp, Oryza sativa
  unsure (1)..(608): unsure at all n locations
nnnnnnnnnnnnnnnnnnnnnnnnnnnnnnnnnnnnnnnnnnnnnnnnnnnnnnctattagcccctaacaaacttatctagcttgatcatctatctcgttgattaagacacagtttccacctggggaccgtgtgatcgacggagtcctgaaatttgttactgaagcagtcaagcagaggatgtaatactgtgctgtaaccagatcttcacgttgttcgctagaccggcaaaccggcattactacatatggtctgattggaatttgatcagttcgtctgttcgtggccatgggtgatgatgggcctcgcaagactctttggtttttatatggggacctagagcttgccaccaggcgaagtctacacgccgctgttcagtcttcagtgcaccggaggtgtggcggcttggcccggcacggcacggtgcgagcttatacggttttgctgttgcagtgggcttagtatgttgggccttgtctcggccggccgcgcggtgggcctggccccggaagggaagcaaagcgaccaggttaggagttagtaggagtgttggacaaagaggcgggggacgcctgacaaaaaaacgaaagaagagcgaggaggtgcccg

SEQ ID NO: 15869 - DNA, 8931 bp, Oryza sativa
caaattgcaagctccatatgtatggacattgtgtgtggaggagttgaggaagaagaagggttagggacactggcactgtgctggcagtggatgctatatagcaacgacgctgttcgtccgccgagcgatcgggccggccgtcgcccaaatggaccgtcaggttggactggaccatgaaattcaggcaacttatctccctctttatatctgtacagaaatgtgttctgttccaggtacgaaaaaactattttggtaagttggattgaccggtagctacgaacttgcggtttgtgaaaaaatgttttattcaggagtagaattttcccttcatgcgatctacttaaattctcgatcagaacctaataattcaagagcttcacatgagaaatgttttgaaatttttcagaagaattttggggcgttcctatttagcagtactgcagtagacccctgcaccgagatacgtcgtccggtaaggacttgttggatgggccgaaatttcggcccatcacggagaagccttaaggaggtcgcgtatttctaagtttccgctttcagtgccaagcccatctggacgctcaccggagatggccttcgccgtcgcgccgccggtagcgccgcctccaccttctcccgcggcggcatgggggaggcgccgcgcgagggcaactcctccgcggttcgcgctggcggcatctaccagagacggcgacccggccccgccgacgttcgagcggctgcgggagcagctcctacagctccacgcagaagccgacctcacccaatccaaaggtatacgcattccggcatcccgtggctgctattcagatcggctctactggttcagtagttggggagttgtggaatgatgaatccttcggggacaggggaacttatctgttatatgctccagacttgtgatagtacgttatgatccatgtcaagttaattttgattggaattgagtaggatcttgtagtcaaatggtgagattgtttgtgtatgtgcatgcgaattgagtggacagccactgtggtatctgctgcactcaaatttgtggtttgttcttgtagcaaatagcacgagggtaaggcttgtgcggttgactgaggctgctgagaatcttaagaaaagagctgcggtcagcatccgaatgggcaaagagaatgaggcagtggatttacttgtgcaaaagaagaagctgaccaaagctcttgaaagcataaaacagcgcattgaggtgcttgataagctttccatgaaaatcagtgaggtactgaggtcatgtcttttttttttactatgtaccatatgctatttcttcttaggaaaacgaatatattatgtagtttgtgccaaaagcttatggtacctagctactgccaattgccaaaacattaatcagcagttacatgctgtactgttgatgtgctaaattggcaattctgctgattgtgtcaagtacgaaaagttacagattctctttctttatagagttggtcattaacaagaacatatctgatatctcacatataccactcctactaaggaagcaaatttcaaatttatgttcatctatgcatttgaaattctattatgtaaatgatcctactatttttctactttgttggattcaggcaatttcagtgaagcagaacatgttaattgaacatgcattgcatccagggatgtctaatggcaaagaatccaatgacaacataagagttttctctagtaaagttggtgatgaggctgatgagactactagctctcctgcgaaatcatctgaaaaggcatttgatctgcaacatgtggtgcattcaggcatgactggccagttggagcaaagtgaacttcagacgtccgatagcttctcattttccagtgatcttgaatcaccaaacagcataactaaccattcttcttatgatgcttttctagaccatattggttttcagctggattcattagaatgtgaaattgaacaatatatcagttcccaactagcagaacaggtggacattcagaagccaataaatgccaagtggcaaaaattgtctgacgtattgaagcttgtaactgaaactagagaaaggtgagtcgaggaggaggaggaagagaaacacagcgtattcaaagggcatgatactttttaattatacagttactgcatggctactacatacttaagcttcataaccacccattatttcaggattgcaaagattgtggataatacagtaaaggaggctggatctgaggactgaggtcatagcgaagtatataaagcaatgtattgatgacatcaaaccctgtttcttttatttgtaacatggtaagttgtgtcattggtttgatttcactgcacatagcttagattatcactattttcttgtatgagacgatcttatgattctttaatatcaattggttattgtctacctgcctctttgcttgtatacctaaatatcaatacaatctagaaacaaatatgcaagaaatcctgaagctgaagttatgattgaattcattcaaccagcacatggacttttacttctaaccaagaaacagagtacttcgaatagcgaggttatttaataggttacccacacatgtgcatgctttagtgtctgtttaacaaagtataagacagcaactatcactatgatatcaggtattcatatacattctgtaaatcatacttataattttccaatgatgtccgcaagagtgatctttccacactttgcaaggccaagctgatcaaactggtctgagatcattgcaatgtctttgtcatcgatctttcctatctctttgagtttgtagatcagaaagtccgatttgctgtggcataaaaagaaaaagaccacaaagttaggactggataactgccttgaatacaaaaggtcacactgtaatgcaacattataaattactttcagattaatacaataaagaaaaaaacaaaaggtaacgaaagtaaatttcatgaaggaccgtgaggtgttaattttcatggtgtcacctacatcacgggcatgtgaccttgccctaatgccctatctatatgtttatttgagtaactcaactctgtttctttatcaaacatttttcaatgttcaaacaaaactgtactctggccctagtttcatcactaacaaagaaaaatgttcttacatttttggtaattgaactcttggtattcttattgcaaaacatgaaaacgtacttgttaaacaacatatgcaggtatatggtttcatggaaaatttgtgcaataccttacagaagcatcatggtctaagtctgcagccagtggctcattgtccattttcttctggaggatccattttgtagtttttcggttccttctatccatccttagatctgttaggaacaggaaggccttggcaactgccaaagtgctcactaacaaacacactgttgcagagagccttcctgctggtgttgagaagccataatccccatatccaactgttgtcacagaaatgactgataaatagaagctatcaatccaatttagaccctccacctcatgcactatgattgtacaaattgagatggtgcctacaacaacccctaacgcaagtagtactttcatcctccctcttgatcttttcttttcagcatcaatcatataggtgtcaaataccctattaagcttgttatcatccattgtgctaagtaagactgttctctgcttgtcaagtacatttgtcaacagctcatttagcacaatgtcaacaaagcgaacaccgattagtagaaacaagcatgtgaacacctttgtgaaggtagtgcaagggactatgtcaccgtatcctatggtgcacaagcttatgatggtgaagtaaaggccatcaactaacttcagtgtggacctccccttgaagccttcaacatttgtgatgtatacaaggactcctattgagatgtacaagatgacgctaacgatagcctgccttgcaaatgatggtacgtgttgtgcagcatggctttgctcattgaactcatctgcacagggagtttctttgattgatgtgaacatagaaggagaagaatgcacccgctggaaattttgtgcggtaactatattgccatttccgctagtatgtaacggatgattgggagtattggggttacctttgctatttgtacttgggtgaaaggaagtcacgaacctgtttgggacatcggaggattttcttctgtcttgtcttgaagagtatacttgatcacggtggactacaggcagcaggtgctcttccatggtagacatgttagatcttggattcatcagctcacagcttgcagttctcaggactgtactcatcaatttatatccatggcagttctgctgtgatctcggtgatggaattggtaaccacgagatggtcgtcaatcaaggatgtacacttacctgctctttctgggttgaaaggagtgtatcaaatctcaaaacatatctttcttatttattgcaacatttatatcacgtagtttccagtatattgcatagtagctgatacaagaggcaattgatgaaagggaaggaaaagacgggtatattctctctttcgatatctgaaacagcattgctagatctatatcctaattaaattagatttactatgctgtcaacgctcacctgaaactattcatttcacatatgctatccacatcagtatgttggctaaaggattatcgtcgtagttacctatgttgtggcagggataatctttcactgacccactattcgtgcacgtgcactactaggtgttcccgaattaaatctgatgttacattttatgttgcagatatcaagattaacaatggcttgttagcattctgattttgcaagttggccttcccttctctgggatgatccattgacataaaggcaatgccatattctccaggactctgttctacaacaggggttgcctttttctggatgggaacatgtcagtttcttgcggctatgagatcttattgccggtgagggaggtaaatgctgcgccgacggaaaggttctcaagctggggatccctgtttccgtgtcatctatgtatcttcgagctgtctttttctgacggatcttgactggagtatcttgtccctgatgatcagtctctgcgtgacactctgaagaaaaggctgtgcagatgaaaactgtaagaccttgcctagaggctagaatataaccgagcactggagtattttagagaaccgggcaagcaagcattcttcagccttccagcttcctggcataaatgttgatgaatttgtcgccatgaatatctattagcccctaacaaacttatctagcttgatcatctatctcgttgattaagacacagtttccacctggggaccgtgtgatcgacggagtcctgaaatttgttactgaagcagtcaagcagaggatgtaatactgtgctgtaaccagatcttcacgttgttcgctagaccggcaaaccggcattactacatatggtctgattggaatttgatcagttcgtctgttcgtggccatgggtgatgatgggcctcgcaggactctttggtttttatatggggacctagagcttgccaccaggcgaagtctacacgccgctgttcagtcttcagtgcaccggaggtgtggcggcttggcccggcacggcacggtgcgagcttatacggttttgctgttgcagtgggcttagtatgttgggccttgtctcggccggccgcgcggtgggcctggccgcggaggggaagcaaagcgaccaggttaggagttagtaggagtgtaggaccaagaggcgggggacgccagacaaaaaaacgaaagaagagcgaggaggtgcccgtgctccggccggcgtcagcttagacgtcagcgtctcgccgatgtcaatgccctgtaatcctgcactgtcacatgtgacttgtgagtcgtgtttgtgtttgtgtgtgagagagatccggatctgctgcaaatctatggtgtgtgtgatggcttccgtgttggatccgaatccaagagttcaggtttatctacagtgtacgtgtaataacaatttttcttttcgcagttactaacaatataagttgcagctatactaataactgccgtacatcctcctccctcggcgacgcaatttctttgactccccgtacaccttggcacgtctctttggtagtacgtatccaaagggtatgtctggttagctacatgttaaaatgttgacaatactaaaaccttggtactccctccatttttatattataagtttatcaaatttatagaaaaatatagtaatatttttaatataaaacaaatatattattaaaatatatttaatattaaatttaatgaaactaatttagtgttgtagatgttgcaaatttttttctataaatttgatcaaacataaaaaactttgaaaaaaaatcaaacaacttacaatataaaacggatgaagtaagtgttagtagtgccatctttttttaatatataatttatatgtgtgttgttggcatatattgatagcaaaccaaacactagtaaagtgactatttaaagtaccgtgaatgagtgtcgacgtttgatgtcgcaattctggtatttgcatagtatggggatcgtcggcgctaagatatatgcgagactgaggtaaaaaagacggagatatggatttttatacaggttcgggcccctgaattgtcaggtaataaccctacatcctgttggccaaagccggtattgctcttatttataataatcacaccagtacaatatttggggtagcctatctaactgttgtcgacatggcggtctgacgatctgactcgtagtcgacaacagggtagccttcctcctcgagctagcgcccgacggaatcagagacagtactagatccctatggccggcctctgaaggtaccggatagggtcgatccaggcgtatctctgatatcgatatccggcggtttgtcttggcgtatgtaggcttctttgttgtggcttctggtgggtgttgattgtgtcacgccccgaactagtaccgaccggaactagcccgtgacgctccaaattaactgttaatcgataccagtcccaggacacagtgctggtatcacaggaagacagattaccacagcacagaggtctctttattaaagagtagaggtacagtcatgttgggctgtggacagatcccgagctcacaactgcattacaaaagggaagcggaagccaggacttggaccaaacaacacaggcgcgacttgggaactaggccgaaaccctaaaactcatcgtagccggcttgctcctagaagaattcctcatcagcaggatccgcttcatcttcttcagcaactgggggggagattatttatatagagcaagggtgagtacgggagtactcagcaagccatgggaaataagtgtttaatgcaggcttcaaggagaggctgttgtttttgcaattgattttatttgaactcttttctaaaaacgactaagtgagtgcttctcaaacgacacggatgagacagtgcgtcttgtccggtcggagtatgtgcaatgtatcagtctttagaattgaaacaaggttggcacccggccaacagcttttcaaacggccacccgggccaacaactttcaaacggccacccgggcctagctgatcccatcagctgcagatttttcaaacatcgaacccctttccacaacagtaatttcacaagcagtagtcaaacaaaactaagctaggaatcacctcacatccgcccatgaccgtgggcatggctgttcgaatagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccatttcacccatgtggtcgtacttgtcttatgtttggatgaaattccaaggaaacggtccttaggtgcaagagcgggaaaccgtacacccggtacgttccccggtccgcggttttggaaattcatttagttcgcaagcaccgacccaggtgtcgggttttccaagtcttttgtaaaacccaagttttacccaagttgttactcagattttaagtttgaaggcgtccgtcgatactcgcacagggtgcacgaatatcgagacgcaactagatagttacaaggggacatggtatatcaatcaacaaaggaaggatcaaatgcaacaaattaggtaggtccgccaatctgccttgcagacgagacaacagattaagtgcaatcctatcaatgcataatatttttcaagcaacataatttagttcaaatataggctcaagatgttcaaaggtggcttgccttgctcgagatctggagcttgatccttgaaatcctcgcactgcgggtcttcgggctccgaaactacacgcgaaacgggacaactcaacaaacggcgaaaataaagctctattaatgacctctaagcgtgccattagatagatctcgagatttgaggaattttggaagttgaacggagtcaaacggatttacgattgggaaaatattgaatttctaagattattggatctttggtctaaaggaaaaggatttaattaaatccttttttgaaaaagaaaagaaaagaaaagaaaagagggagggaaaatagacttttcctcgggcgggggtaccgagctcg

SEQ ID NO: 15870 - DNA, 564 bp, Oryza sativa
  unsure (1)..(564): unsure at all n locations
nnnnnnnnnnnnnnnnnnnnnnnnnnnnnnnnnnnacgcaattttgcttggaataagttcactctaggtcccttaagtcaaaaatttatcattaaaccacaataacagataagtatgatacgtcctcaactccgaaaaccagtgaaataaggtcctaaaacggttcggaaggtgattttaactgacgttgcacttaaagttaagaaaatactatgggactcacatgtcagcgagtgttatgttaaaattaaaaaaaattgcggtgggcgccggcggcaagccaggcttgccatgctcagccccagctgccgttgccacactcttcttctcgctggcctctgcatccctctcgacaacgcctctgtacccgaagctgaagtcgtcccgctccacgccgtccgctgccgatcaattagtcaagtagcaagaacagagcattataagctcgccgccatatgcaaccacggaaataccggtgccagggagggtggtgtgtgttgtacctttacacggcgaagcgacggtgatgcggactttcttgacagcgatgcagacctagatctc

SEQ ID NO: 15871 - DNA, 1631 bp, Oryza sativa
  unsure (1)..(1631): unsure at all n locations
acgggctcgggcctcgtcgggctcggcagagggaagctgtccttggtcacgcagctcaacgtcgaggccttcggctaccgcctctcgtccgacctgtccgcgcccagccccatctcgttcggctccctcgccgacgtgaccggtggcaacggcgacagtttcatgtccactccgctactcacaaacccggtggttcaggaccttccgttctactacgtcggtctgaccggcatctcggtcggcgggaagctcgtgcagataccttcggggaccttctccttcgaccggagcaccggggcgggcggcgtcatcttcgactccggtaccacgcttacgatgctcccggaccccgcgtacacgctggtgagggacgagctgctgtcacagatgggctttcagaagccaccaccggcagcgaacgacgacgacctgatctgtttcaccggggggtcgtcgacgacgacgttcccgtccatggtgctgcacttcgacggcggcgccgacatggacctgtccaccgagaattacttgccgcaaatgcaaggccagaacggggagacagcccggtgctggtccgtggtgaaatcatcgcaagccttgacgatcatcggcaatatcatgcagatggacttccacgtcgtgtttgatctgtccggcaacgcgcggatgctgttccaaccgcccaccgcctgatacgggagattatgaccgttgattttgtgcgccgtatgtagtactagcactctagcagtgtagcacgtacaattgtgccgtagcgaataagttctgcacaaattattttctgccatccgcgcttagttgtaagtacgcgagcttatgtaatagtcttccaagagaaattgaacgggcataatactgcatgtacggttacaatatacttataaacataaacgtttaaacacatatatagtataccatatgattagtactactagttattattttccggttctaatgtaaaaatacaaacgaaactatagagagtggaatttaaatgtaactctcgacggacgtctagttgtttacatgtaaattaaatagtcatgatttttttgcaaaaaaaaatattgaaaatgtcttaacagtaatatatctctatctccatctctatatactattataaaaattaaagatgtttccgtcagactttcgacacgtcatccatgttagaatcggttttaattttatgtttgtgttaagtcctatctctttttcttacgccaaagtgtctatcttatctaagacgtgcgcgatttaattgggccccgcaccttttcacgcgtccattgccgcacgcaacaattgggcccgtgcccgggcctgtttttcacacgcgtctttgcgtgccatggcgattgggcccgcaacacccttgcgcccacgattttgtcgtttctgcatgtccgattgggactgcgtcaccctcgcccgcgatttaaaaattgaagatgtttttgccgaaactatagtacgtcatctgtttccgattcccgtcacgtgtaacattcattgcgaagtcacgactcgcgagcgaactacgagagagagtccgtgtggatatcatgtacgtcannnnnnnnnnnnnnnnnnnnnnnnnnnnnnnnnnnnnn

SEQ ID NO: 15872 - DNA, 582 bp, Oryza sativa
  unsure (1)..(582): unsure at all n locations
nnnnnnnnnnnnnnnnnnnnnnnnnnnnnnnnnnnnnnnnnnnnnnnnnnnnnnnnnnattaatgttttggcaattggcagtagctaggtaccataagcttttggcacaaactacataatatattcgttttcctaagaagaaatagcatatggtacatagtaaaaaaaaaagacatgacctcagtacctcactgattttcatggaaagcttatcaagcacctcaatgcgctgttttatgctttcaagagctttggtcagcttcttcttttgcacaagtaaatccacttgggccctcaatttccttttcccttttttttgcccattcggatgctgaccgcagctcttttcttaagattctcagcagcctcagtcaaccgcacaagccttaccctcgtgctatttgctacaagaacaaaccacaaatttgagtgcagcagataccacagtggctgtccactcaattcgcatgcacatacacaaacaatctaccatttgactacaagatcctacttcatttccaatcaaaattaacttgacagcataacgtactatcacaagtctggagcatataacagataagt

SEQ ID NO: 15873 - DNA, 1522 bp, Oryza sativa
tcctccacacacaatgtccatacatatggagcttgcaatttgaagcattttcaagtttgcatgcccatgagaaggagaagcagttgtgtactcacactgaatgcgcgaatgctgtcgctacttcttgattcaaaggtcatttccgctctgtcaaattgtgcgatgcattatattgcctatctgttttgattgaagtttgaagttattgttggctgtgattgacgtttgtaggttcagaccagtgttcttgcttactggtattcagatgctataataaaaggttataatacatatcttaggttttggatgtgttctttgctttcatgcttggcattactctgtgcacttatgcgctgtctgtcagtgtgcagaatacatggaaacctgaaattaagtgatagttaatctgtcctggataagtgtatattgcaggctttatccacagaatgaagtgtatatggcaggctttacctgaaattgtgtatttgtgcgtctcctagtatgactggcactctcgaacaaaatgaagtgttagactgttaggtgttttactgaatccacacacaacagcggaaacatttcggatgacatcaatggcagtatgttctggaataagaacagatgtagcaaacaaaaaaataacactaatgagctgcgcatacgtgcatatatagacagacaaacctgcagggttgtgagctgcaaatgctcaaattgatcactcgaataatgcacacagcagtagtataggtgcaagcattaagtcgtacatacgttttcttccatcacatacacatcaccggtcatgactcagcagacaagctgttcttacatgttttctcatggtcaacttattccctgatcaatctcccgaaagattactgtttggattccatgacgtctccatgaccaatctcaccattgccatgctcgtgatcgttgccctcgacgacgaagagatcgcctaactgctcgtcgttgatcagagaatcaagaaacgaggagaagtcgtcgtcacccaccatggcggaagcggaacccatgtcgaagccaccatgaactgcatcctcggcacagaactgatcgccaaatcctccttcgaatccctcggcatcggcggcgctcaccatcgctgcgaagtcaccgccaccgtcggccggtcgggcacgatcgtcgctgcactcaatgccagcggccggcgaggatgccgtcctcggcggcttggccggcaccgccttcttgtaagaagtggcggcgacggcagcggcggcgttggagtgatcggcggcggccgtcagcggcttgtgcgtccgcgggtcgatgccctgcgcgatgagcttcttgctgagatgcgagttccagtagttcttgatctcgttgtccgtgcgccccggcaacctcccggcgatcagcgaccacctacaagcacatgcacgggcggtcacctcaccggaggagcagtacgacctttgcacacgagcgatcgccttcggtgcatcaagaattgcttaccggttgccga

SEQ ID NO: 15874 - DNA, 7408 bp, Oryza sativa
  unsure (1)..(7408): unsure at all n locations
gcacctcgtcctcttcgggcgtccaggcccatgtttaagggcggcngccgccgcctcctccccgcggagcagcgccgcgggccgcttccgcttcatcgtaggatcgatcggcgattaatttgcgcgcgagctagcttggcctcctcgagacgtctcgatttgcttaattgcttccggcgatggcttagctcacaaccagatgagacggtgtgcggggctttttctcgccgtgcaccgcagcgccacctccccggagaggaaatggtcggtgggggtgggtttgttctcctcggcgtgcggcctgtggcgttttgcgggaaacgggaagaattctcggggacggatccatcgggtattcgggttggggtacaacgtgtcacgctttttatccgaaaaggcactgcagatgcaaatgtacatcgtcgcgatttcggcaattcggcgccgcggtgatagtcctcacggggaaaaagatctgtagcattagcaataaaatttggagcaaactgaatagatggaattatgaggattatttctgtctacattcataaattacatggctatgtataacttctgtgaacgaataatagcctaaaattaaactccaaggcttcgtcttttttcaactccaaactaggtttcctttttgttcgttaacacattttttaaaatgttaaatagtgtgttttttctttaaaaaataaaataagcctatttttaaattttgtaataatttatactaattacagatgtgctaatggtttgactcattttgcttgtgctaaaaagctaaaccaagttagagattcaaacagaccctaactacagttcaaacttgacagttaaacttggtggtcaatactaaaatactttgagatggtctttttggacaatcggtttagtaatgggtccaaaattttagcctataaattctacaaatttttttatttgagtaattttactttgggtcacctttttattaccggtgtctcgctttggatcaccatttaactaatgtttacattttgaaccaggtaattttacctttgtggcactttgaaccatccctcaactcttttatccatctacatcaaaattatcatatgtcaaagaaacaatctacatacatttgagggggttttgacgaggagaagccgacgtacttgaggtcgttcatctgctcgagaagagagtcggggtagtccaaagttaaggaaaggcaagattacttggtccaaaatgaaaacattggtttaaagggtggtccaaaacgaaacatcggtaataaaatttgtcccaaatatgaaatttactcttttttgtttttatattttttgttaaaatatttttaaaatattttttcaaacttttgcaaatctatagcacgcattaggagggcatttcctagagggcttctttatgacatggtagatggttattgacgtgtacgtctatatatgaacgcccctcatatttgtatccccagctgtgagagatcagcgtcgagagggttctcgtggtccatagtggcggaagagaagagaagggagccgatgagctcaagctcaccaagcatgtgcgagaaggaggcggcggcggtggcggtgggcagctagagtggatgaggccgcagcctacagcagcggaggaggagaggacggaggtgatggagaagatgcgcccaaaattttaaggtgtgcttagttccacgataaaattggaagtttgactaatattgaatgcttgaagaaaaaagttggaagtttatgtgtgtaggaaagttttgatgtgatggaaaagttggaagtttgaataaaaagttgggaactaaataagggcttagtctataaatttcaaaagttgaaaggttgggctgatttttttttttttttatgttttgaggttaagagaaatgattgagttggactatgaaagatcccatggcctatggcccattaccaccctttcaagctcaacaagttcgagatggcccaacttgttgcagccgatcgagcctatcctaccctagctaagcatgactcgaaatgaacaagacgtgccagcaggagtcatgctgccttgtgtaggaagcacccgagccgctgaacaatcaactggagtattgaaatttgaaaggtgctctcgtggaatatttgcacagctggtggacgtgcgaggactaggagacctcgaatcgggctacggaaaatcccaaaacgctagcgacgtcaacgtgtgcttttcttggcttccaagcaggtctgcctcctgccttcctgcctcctatggtgtccaccagttctctcctggtcaaagtatgtaaagtttaactgggcgttcggcttgactagaaagggatagattattaatgaataattaattaattattaactattttcaattttaaaaatagattcctttttattttttaaaaccttctatatataaagtttttttaaaagaaatatatacttttaacaatttaagaagtgtgctcacgaaaacgataaagttgctcagtcaaaatgtggaatcaaatccagctaggtgaaggccttgccatttgcaaattgcagtggcacattcatgagggtgtgtcgctaaggtgacagtgacctgaagaattcctagttctagatgtattgatctgctctaccgtaaaggatactccaggtttatattactctctctatttcaaaatataagaagttttgattggatagaaaatattttttaagtacgaatcagattcataatagtatgatgtgttccatctaatcaagatttttttatattttgaaacggagggagcattagtttgctcaaagctcgtacgaaattgaccgttggtatctgcatcagaaaacatggatcggtattttacacacgtgtatgtgtggcgctaggcattttttgcgatcacgtggaagattcacacgtataacacgcacgtaacgtatgtacgcgcagacgtcctattgcccagctagccagcatcgattgcctgaacgtacatgcatcgggacgccacgacgaagatttcggccccagttgaaaattcagctaatgatcacgcagaaaaggaacagcagtacgtacagctgaagaaaaacaacacgggtcttgggctcgtcgcgctcatacttgtggttgtgtaatctttgcaaaatcctggcgtaatcacatggctagtacatcccgccttccccgtcagttccattttccaagcaccgaaaaaacaggagtgcgcgtaacagtcaaaatcctgcacaggaaatgcctatatatgcaggtacctcctccacccagtgatgtcacccagctcgagcaaataggctgtagctagccggccggcgagaaaaatggacgagtcaggcagaggaacaggtgatgatcatggccgggagacgaaggatgctgcggcggcggcgtcgtcgtcgtcggggaagaaggtgccgctgttcagcttgttccggtacgccgaccgcctcgacgtgctgctgatggttgtcggcacggtgggcgcgctcggcaacggcatctcgcagcccctcatgacggtcctcttcggcaacgtcatcaactccttcggcgcgaacaccagcggcagcgtcctccgcagcgtgaccaaggtgagtgcccgcgggcgcttagtgatacgcgatggagacacaccggccggtagccaaattaactttggatcttctttctcctccaggttgtcctcaacttcatatatctgggaattggaacttcagtagcttcctttcttcgtaagtaaaagtcctttctctgattggaacacctctttagtgaagtagagagaagctcctgcccttttcgctgaaaaaaacaaagaaaaaaaaagaattagtggaacctgtagcttcaaattatggatgtgaaacatataaatagtattcagcaagggaatttgtagtaaacagtattagaaattctttcaatatctaatttgttcctattattcaatgagtctccgggtatccataagtcaataagaaatttcatttaaagggtctcagagtatccatcagattccaaagcaaaattaacactttttattcaaagggtctcagtatccataagtcagtaagaaattttgtaggatagtgtgaaattaggctttgtttggtaaatgggattgagaaataatatcccaccctccaaaaggtaatattgcatcctagctatccattcttcacacctcatttaatcctagccatttattctttacacctcatttaatcctagtcattcatccatttccatttcccaatcccacctgccatatcccatttgccaaacacacccttaggataagtaattaatttgctcttgcatggatgcgcaatcaccaatacataatattcattattaacatcatggttgtcagttgttactacatgttagaattcggttattctcaactgtgatacactaacacagtataaacatcatcatgcacttatccggtgagaagtaccaaatgcgttccctaaccatataatcctcagcatcttcgatctaatctgttcggttaaatatatcacatgctaatggtacaactgccagtaaaaaactcaccttaatttgtcccagaggtatcatgctggactatggcaggagaaaggcagtctgcccgcatccgttctttatacctgaaagccgttctgaggcaggatattacattcttcgacacagagatgacaactggtgaagcagtttctagaatgtctagtgataccctcctaattcaaggtgctcttggtgagaaggtactaaatacctagtagctccgttgtaaggaacatactattttttattaaattgctactgaaaaaaaaacatatattttcatcacagtgcaaacaaaagtgtggatagacacaagttgatggcaggcataattatttgcatatttaggaagatatatcaaacggatatagttatcatatttactaactgtattatttcatatattcaggcagtaagttacaccttgtgctactgttgctgatgtgttcttggatttttaatcttaacctttacagggagggaagcttgtagaactgttatcaagcttcatcggtggctttatcatagcattcactagaggatggcttctcactcttgtcatgctaacatcgctaccgttaattgctattgccagtgcagtttctgcacaggccctaactagagtttctagcaagagacaaacatcatatagtgatgctggggacacagttgaacagaccattggatctataagaacagtgagtttcacatatttatatgaattgtttaatgctataacacacttctttttttggagtagcagacagtaagtttgataaatatcctgtgttaacaggttgtgtccttcaatggtgagaagaaagcgatagcaatgtaccgtaattttataaagaagtcatacaaggctactattgaggaaggcattatcactggttttggcatgggctctgtcatgtgcgtcgtatttggcagctatggattagccttctggtatggtggaaagctaatcattgagaaaggttacacaggaggaaaaatcatgactatcttgtttgccgtgttgaccggtgcatcgtaagtttcagcaaatcctccactgttgatatcaaaatacatgctgtttagtgcactacaataatgaacccccaatctattcatgtattatttggattgatggaaatataacaagaaatttatatatattacctcaaaatcaagaaggctggttagcatgcaattttagaagtgcaaatggcagttttgttcatttctcaggtgttttttagaaaacttctcaggatttcaagatgattttcagaattaccttaaattattttcaatattttcttgattactatttacaaaaagacaatgctaattgccaatgcatgaaagtaacttgtttcttgtaaacagaatggaatgaacttaaagtttgatggtcaagtcaattgcttgactatacataatccctaggccctattaccattttaggcagacataccaattgctaaggagtagttattaattccagttagtaaaaggggatcatgaactgagatatagacataagtacctaatagctaaatcaaggtatccttagcaattgcaagagcaggtttaatcaatatgttctgcgctaacaggagaagtagacaaacgctaggcttttggaatcgtcacgaagagaatattctcctgagaagtacattacatgttatatgcaaacgattgcattgggtttcactgctttacctacattacttgctatttctcctaaaatcacattaaagttgaaagatttacaacaaaatagccattaaaattttatcatttgatatggtatataatgttctgaacatggcactttccaattgtttgtgacagctcattaggcaatgcaacacctgcagttgctgcagttgtggaaggtcaatctgcagcatacaatttgttcaaaacaattgagaggaaaccagagatagattccgatgataacaatggcatggttttagaagatatgaatggcgatattgagctaaaggatgtgtactttcgttaccctgcaagaccagagcagttgatattggatggattgtcgttacaagtagcgagtggaacaacaatggctatagtcggagagagtggaagcggaaagtcaactgttatcagcctagtcgaaagattctacgatccacagtctggcgaagttttaatagatggaattagcatcaagaaactgagacttgattggataagagggaagatcggtcttgttagccaagagcctctgctttttatggcctccattaaagataacataatatatggtaaaaaagatgcaacgcttgaagagatcaagagagcagcggagcttgcaaatgcagctaacttcattgacaagttaccaaatgtaagaaaggaaaaactgaatgctccaagttctcaaatttaattgtatattaatgaaataatcagctaacaatgttttcatgtcataccagggttatgatactttagttggccagcgcggtactcagctctctggaggacaaaaacagagaattgcaattgcaagagccatcctcaaagatccaaaaatccttttgctcgatgaagcaacaagtgcacttgatgtggagtctgagaggatagttcaggaggcactaaatagaatgatggtagaaagaaccacactcgttgtcgctcatcgtttgagcactgtgaggaatgttgattgcatcacagtcgtccgcaaaggaaaaatagttgaacaaggttgaattaacttgaannnnnnnnnnnnnnnnnnnnnnnnnnnnnnnnnnnnnnnnnnnnnnnnnnnnnnnnn

SEQ ID NO: 15875 - DNA, 4774 bp, Oryza sativa
ggaaaaactgaatgctccaagttctcaaatttatattgatattaatgaaataatcagctaacaatgttttcatgtcataccagggttatgatactttagttggccagcgcggtactcagctctctggaggacaaaaacagagaattgcaattgcaagagccatcctcaaagatccaaaaatccttttgctcgatgaagcaacaagtgcacttgatgtggagtctgagaggatagttcaggaggcactaaatagaatgatggtagaaagaaccacactcgttgtcgctcatcgtttgagcactgtgaggaatgttgattgcatcacagtcgtccgcaaaggaaaaatagttgaacaaggttgaattaacttgaaatgcactgtttttctattatagaaaatttctgcggtcaaccttaaatgattcattataccaaaacatgtcctgcgtacacaggtcctcatgatgcactggtgaaggatcccgatggagcttactcccagctaattaggctacaagagactcatcgtgatgaaaggcataaactaccagattccagatcaaaaagtactagtttgtcattcagacgatcaagaactaaagattttctcagcaagagcaacaggtattccttcaagagccccttaggattgcctgttgatatacatgaggatggaatgacaagcgaacaacaaaaggttgaccactctgacagtaaggccattaaaaaaacaccatttggacggctttttaatcttaataagccagaagtgccagttcttttgttaggttctatagcagcatcagtgcatggagtcattttgccactatacggtataataatgccaggtgttctaaaatcattctatgaaccgccagatcagctgcgaaaagattctagattttgggcattgatgtctgttgttctgggggttgcttgtttgatttcaatcccagcagaatattttttgtttggaattgctgggggaaagcttatacagcgtgtccgtacactgtcatttcaaagaattatgcaccaagaggttgcttggtttgataagccctccaattccaggtgcgctactctaatgtacttttgctattttatcttttataaaaaaatatttacatttaaaccaatgctaagaggccatcttatttcttacagtggggcacttggtacaaggctctcagtcgatgcgttgaatgtccgccgtttagtaggagataacctggcccttatagtccaggctgtagctacactaatcactggctttgccatagcttttgcggcagattggaggcttgcactgatcatcacttgtgtaattcctttagtgggtgcacagggctatgctcaagttaagttcttgaaggggttcagtgaagaatctaaggtgacacattacagcttacaactgtaaaaattgcttgctgttttattgagaatgatctagacaagtgatctagaattaaattgattgccattataatgggatctcattatacaggagatgtatgaggatgcaaaccaagttgcggctgacgctgtaggcagcatcagaactgtagcatctttctgttcagagaaaagagtggtggcaatatacaacaagaaatgtgaagcctttaaaaaccagggattccaagccggattcgttgaaggaatggcctaaggttcttcaacctggaggtattatctgactaacggccttggcttctatgtgggtgcaaagttcgtaagtcagggaaaaactactttttcaaatgttttcaaagtaaaaaatcctaaagtatttcaagtaccaatggcctatatgaatattaattctagtatcattcacaaatgggctggatgcttttcaggttttctttgctttagttttggcagccgttggtgtttcgcagtcaagtgcattgtctactaatgcacaaaggcaagggattctgccatttccatttttagtattatcgatcggaagtctaggattgattcaagtagcgacgagggagcgataatggaaaacgtcactggcagcattgatttcaataatgtcagtttcaagtacccatcacgccctgatgttcaaatattcagtgactttaccttgcacattccttcccaaaaggtatacttccacattcacctatttgtcttcctttttcctatttcttgaaactagtgcatgcccaaaatttccatcagaaaattaacttgattattgaactatttacataatacaactagtaacatacttcaaaatagatgcgagtgtgacccatccacttccgtgacatcatatgtgttgatacacaactttacattttattttttgcatctcagcatttccatgcactgaaatagttatgactaaaccttttccttccttttctacagaccatagcacttgttggagaaagcggtagtgggaagtccacgataattgctttattagagcgtttctatgatcctgattctggtaatatctcactagatggagttgaaattagaagcttaaaagtcagctggttgagggatcagatggggcttgtaggccaggagccagtgcttttcaacgacacaatccgtgccaacataacatacgggaaacacagtgaggtaacagaggaagagatcactgctgtggccaaggcagcaaacgcccatgagttcgtatcaagcctgccacaaggatacgacacagtggtaggtgagaaaggggtgcaactatctggtgggcaaaaacagagggtagcaattgcaagggccatcctaaaggaccctaagatactgctacttgatgaggcaaccagtgctctagatgcagaatcagaacgtgttgttcaagatgcattggatcgagtcatggtcaacaggactaccattgtagtggcacaccgcctctccacaatcaaaggggctgatatgattgcagtcctcaaggaaggaaaaattgcagaaaaaggaaagcatgaagcactattgcggatcaaggatggtgcatatgcttcacttgtacaactccgctctaattccgagtaaaatgatgtatattttgatggtgtataacttatttagccataaattctagctacttgtgatttgagaagttgatgctaaactagagggtgttctttggtagtttgttactttgttgcatgaaagacctatggttctgaacgtatgatcttggtagccacagacagtaaattcaactgtgtctgtgtgtacgcactaactatgatggaataagccttgtggtctttggtctttgtggtccttctcttgcttttaggttgtttttccccttttaggacagcatcctttcagttttgcttttagcatctttcggttttgcttttagcatccctaggacagcatctagcatctcctttatgctttattcagtttggatgctctctaggacagcattgcgttcaaattttagactagtgtgggcagcaattagctagcagccatccagccagctatggctatatatatatgtatccaacctccctcgggaaggtatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgccatgtccgacgctcagtctcggcgttcggtcgcctcgagcactcggcgtcagcaggacgccgagctcgccgcagcagaagagcgcaggcgagcaacggctcagaccgctgcagcagcagcgagggcggccagactggcggcagcggagttggcagcaaccaaggcggaagcggaggcggaggcggcggaagatgcggcacgtgcggcggaggtagaggttgagaccttgcgcagcagcatcaacggctccatcgccggcgacatcaccgccgacagggagcttgaggagctggcaagaggaagggcacgggagcgagcagagcggtgggcagcagcccacctccacggcggcggcggcggcccaagggaccgcgcgcccgccgacgggaacccagacgggcgcaggcgtgccggcggcagcccggagctcgcacgcggccctcgcaggcagcacggctctctctcccctgaccggcgccatggtcaccacggtgtccagacggtggtcagggactttggtcccggcggtgggtggcctaccctcaccaaaaccaactacatcgagtgggccgcggtgatgagggtgaggctccaggtgcggcacatgtgggaggcagtccggtacggtgacgtcaactacgacgaggatcggcgggcactggatgccctcatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtcagacagatcgctcgctcgatcgaatctct

SEQ ID NO: 15876 - DNA, 3583 bp, Oryza sativa
aggcccacgtcgcacgggtgaagaagtaagagccggctctgctcctggctcacgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccggccgacgggagttcttcaccgagttcgactccagcgtccgaggctccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacgaagcagcggcggctcccctttccccagcagatgagcttccgagccaaggagcggctcgagctcgtgcacggggacttgtgtggcccagtgacaccggccacaccaggaggacgacgttacttcctgctgctcgtcgacgacctctcccgctacatgtgggtgacggtcctcggcagcaagggagaggctgcggacgccatcaggcatgcacaggctgctgcagaggcggagtgcggccgcaagctgcgcgtgctgcgcaccgacaacggcggcgaattcacagcggctgaattcgcgtcgtactgcgctgatgagggcattcagcgccactacaccacgccgtacagcccgcagcagaacggcgtcgtcgagcggcgcaaccagacggttgtggggatggctcgggccctcctcaagcagagggggatgccggccatcttctggggggaggcggtggtgacggcaacggcaacctcaacaatggcgtcggatggtcagggacaggggcggatgtggctaggggcagatgcggcggcgtgggaaggcagagaggagtgcaagcggcggcgccggatgcagccgggggtggaggtgatggtgtcgaatgtggcggctcaaccgggggagccggatgaggcgggaaggagcgacgctggaatactcgccatgggtgctcccttgaggaaggagagagaaggaagaggagaggttgcgggaagggggagagggcatggggcacaccattggccaactgttgtggctggctagatttggccagttgctagcagggtttggccagcgggatagcttggtcagcccgttagagaggctgttggaggacattttttttcatgtggttgctataatttggtttggagatgctctaacaattgtgggtggggcggagccaaaagaaaccatcttcatgcatagtttttttttatagataatgcggtgtctcttagattaattaagatcagacagcagtacttcctggattggctcagggattatatcacggtagatattacaagtttttagctctgaacattgagctaaaaggtgagccgcggcattagttacacgacatgcatagttaaacgtgtgattatgacacactccgttgtttccaacatgaattttcaacttctgactaatatcggtagattccattccgatggccccttttccgacataatactgatattatcaatatcactacttttttcagatctaccaatctgagtccattttcgattaaaaaatggaaatgaaaatggtaaaaggtttttccgaccgttttcatccctagctaagttgatttgttcttggtaagtctctttatatcttcatttttttcacaatattttgtataagattttaatgggaatttggttttaagtctagcactcattgatttcgtcatgtctattcctctggggctagggccagtgaacccgcggaggaggggggcggggatgttcctatccaacccaccctcgccctgccccattgccacctctagcgttcaagcctaattgtctcacccttgtccctacccttgatgggcaccatagtgtccgttagacttttgatgtacgaaaggtaatcctgctaaattttctctccaaaaaccaaatctaaatagtaagtttatgagacttgcattttatgaaatatttatcatttctcacaaatctatttgcaaaaattatgtgaagttttcattcttgaagcttaaatttagggcatattgtgcgattatttttctgctagtggaaaattgtagaaatacccgttattcatagattatgaggtaattttcactttagataaatgttgaaggactagagggaatgagtgatatgttttttgtttactatatgcattggtcatctaataatgcgctgaaaccatgaaaacaaagaatagtataattttacctgtattgtcttagagcatctccaacagtgtggccatttttgactctccaaatacctatttggccagcctaacaaaaatttagagagtgaaatttatcttctattccaacagactctccacattccactctctattaaccaatggaccccacctgtcattctcctctttcttcttcctccccttttctcccatcctctgctcgttcttctgcagagctcgtgctagcggcggcggtcgtggcgggcgacgacgcggactgcagcggcggtcgcggcgggcgacggtgtggccgcggacggcggcggggctcgcggacgacggcggaggtcgcggtcagcgacgacacggatggcagcgacggtcgtggcgggtgacggcgcagactgcggtagcttaggccgcggccggcgatggcgcggacggcggcagtggccgcggcgggcgacaacgcggatggcgacggcgggcgttgcggacaacggcgtggacggcgggcaacggcgtggccgtggccggtgacggagcagacggcggcggggctcgcggacgacggcggaggtcgcggtcggcaacgacgcgaatggcgacgacggtcgtggcgggcgatggcgcggactgcggcggcggaggccccggccggcgacaacgcggacgccggcgccggtcgcggcgggcgacggaggccgcggacggccgtgcggtcgcgtgcaacaacgagagagaatagccggatgttaatgtgcgtagggcccatagttggctagtcattttggctggccaaatttggctagtggagggagggttttggccagccagatggcttagccatccggttggagaggctgttggagggtgtttttttcactggaatggctaaaatttggcttggagagtcatttggagaggctgttggagattctcttacacctaacaaaatctgaagtataggt

SEQ ID NO: 15877 - DNA, 1667 bp, Oryza sativa
  unsure (1)..(1667): unsure at all n locations
nnnnnnnnnnnnnnnnnnnnnnnnnnnnnnnnnnnnnnnnnnnnnnnnnnnnnnnnnnnnnnnnaaaacctaaagtataggcaataagtgatgttccatatatctttgatgcataatattgtgtgcattttcccaccttgtagatgaacaaacctaggggagaaaaaaatacatctctttatgttgtctttgagtgtaggtctaccaacgatgcatagactccaccattgatcctcatgagagatcccctcatgttgtcccttttcagcgattgaaccatccttgatgactgcaatcacatctgcccctttaatcgtggacagacggtgtgctaccacaatggtggtcctgcttaccataacttgatctagtgcatcttgaacaatgcgctctgattcagcatcaagggcacttgtagcctcatccaatagaagtatttttgggtccttcaagatggcccttgctatagctatccgttgcttttgcccaccagatagttgtgttcctctttctccgacagtagtgttatatccctgaggcaagcttgatatgaactcatgagcattgcttgccttagcaacagctataatctcttcttcggttacttgtcctttcctcccgtatgctatgttggcatgaattgtgtcattgaaaagtattggttcttggcttaccaatcccatttgatctcttaaccaactcaatttaagtttttaagttctactctgtctagtgagattgtgccagaatgtgggtcatagaatcgctccagcaaagcaattactgtggactttccactgccgctctttccaacaagtgcaacagtctgcatatgacaattggtttatagcatgtcagtacaagtttaattataaaggaaaataaatatagagaaatttgtattattggtaattttcatttgaaaggcatatttagttctcttgccttgctcaatgaggatgagaagacaaggatcagggcaatccaacatactgtaggaactatcaagtttaaaaaggcaaaccttagtgcataggaactcatatttgtaacaattgagtgcacaccctatattaagagcgtacaagcacaatagttgtaggaagcaagatatttcctccaaaaataaagcgctcctagtttgctgcttttttttttgggtgcacaacatctaaatgttttacccttagaagtaaaggaaaaacaattaaaagtaccaagttaactgtacctttccggaggggatgcctaaggtaaaatcacataaaacttggacatctgggcgagatgggtacttgaagttcacatgattcaattctattgtgccattaaccttttctagtatgattccttcatcaatgcttgagtcaatattggactttctgtctatgattgctaatattgaagctgcggattcatgggcttttgatgaatccgatgccattgcgcttgtttgagaaattccaaaagctgtgaaaactaaagcaaagtaaacctgcaaagcgattacaagattgacatattgtcattgaataaaaacaaccttatataagtgatgccaaatgtgtatctcttactctgaagacatctttaaaggttgatttccccccatgtacaaactgtgcaccaacatagaaacaaagagcatatgtgagatacaccattaa

SEQ ID NO: 15878 - DNA, 1024 bp, Oryza sativa
tgcataggaactcatatttgtaacaattgagtgcacaccctatattaagagcgtacaagcacaatagttgtaggaagcaagatatttcctccaaaaataaagcgctcctagtttgctgcttttttttttgggtgcacaacatctaaatgttttacccttagaagtaaaggaaaaacaattaaaagtaccaagttaactgtacctttccggaggggatgcctaaggtaaaatcacataaaacttggacatctgggcgagatgggtacttgaagttcacatgattcaattctattgtgccattaaccttttctagtatgattccttcatcaatgcttgagtcaatattggactttctgtctatgattgctaatattgaagctgcggattcatgggcttttgatgaatccgatgccattgcgcttgtttgagaaattccaaaagctgtgaaaactaaagcaaagtaaacctgcaaagcgattacaagattgacatattgtcattgaataaaaacaaccttatataagtgatgccaaatgtgtatctcttactctgaagacatctttaaaggttgatttccccccatgtacaaactgtgcaccaacatagaaacaaagagcatatgtgagatacaccattaaatatgaaaagctgaaacctaggcctccaaccattccacttctaatactttctttcattgaagcttgacatttttggttgtatgttttaatcactctcttctctgcacagaaagacgctacagtcctaatgctaccaattgcttcagttacaacttgacttgcatcttcatacatcacctgtagaaatcgctagcagttagcaaaacaatatttactaatattgcaagaaaaaaattcattatgcgatgccaatcatgaaatatgtcagttgtaataccaaattaggtgtcatctaacaaaacacacatcttcatcaaatgtggaaagtgtcaggattgtctgtgaattttttatatagggtaccgagctcgaattcgccctatagt

SEQ ID NO: 15879 - DNA, 1252 bp, Oryza sativa
agtaaatcctgcaataagcgttacaatgcactgcactagtatggctaagttatctcccacaaggcgtcggatgttcaaagcatcaatgtacaactttgctccaagtgatccgctgtaaaatttagaagggtgaattgacattcaaaaaaagtgttagatataagaatgaaacttataaatccatttgagtaacaaacctagaatgggaaggatcatcaaaccaagaaacttcttgatggacgatgctttggaaagacaaacagcggacacgttctataagttttccaccagccattccaaataagaaatattctaattgaatcgataccagagaaatgattgccattagaatgcacatcaaagcccagaacctagaatcttttcgaagttggtgtggtggatagtaaaaagttcttataccaccagacatcattatactaaatatcgggaaaagaagtccatgcacaaaagcagttataatagctaatagtagaataggtgcttctggcttgttgagattaaaaagtcgcctgattggtgctttattaatatccttgttgtcaccacattctttatcttcaggttcatctgtaagaccatgcttgtgcaatccatcggatccagatgagccaatatgttttgctaaagagttttttcttctatttctaggagaatcattgatcattgattgttccaaagacaaacttctacttttaagtcttgaagttgacacctcactatattgtacatcatgcatttcttcagtatgagtctgttgtaactgaataagttgagagtaagctccatcgggatccttgatcaactcatcgtgggaacctgtgggacattcatttttggagaaacaaattgaactacctctgattcacaatgattatttagtacggagaaaataccaagtaatgggtatggaagtatggcttaccttgatcaactatttttccttggtgaaccactgctatgcagtcggcattcttgattgtactcaaacggtgggccacaatgagtgtagttctccctatcatgaccctatttagtgcctcttgaactagcctctcagactctacatccaatgcactagtagcttcgtccaacaggaggacttttggatttttaaggatagctcttgcaatggcaatcctttgcttttgtcccccagaaagctgagcaccatgttgacccaccattgtgtcatatgcctatatcatgtgaagataaaagggatagttaatgg

SEQ ID NO: 15880 - DNA, 7382 bp, Oryza sativa
  unsure (1)..(7382): unsure at all n locations
aaggtcttgatgttaattccgtctattaacacttcaccatcctgtgggtcatagaatctctctaccaaactaattattgttgatttaccacttccactttgcccaactattgccattgtagtaccattaggtacttgtagacataagccatctagtatcaactgttcaggccttgcggggtagctaaagcacacatccttgagttcaacattccccttgatatcttctaatattattccagaagttccagtgatgtcaatatttggttttctattgattatttcgaataacctatgagctgcagattggccttctgcaatagcagaaatagagggtgatgcgttacctatagccctgttacaaacaaaagatgcatttagtgtcaaaaaaaaagaagaaaaaaaacctatttttgtagttgaccaaatagtgcagatcatcactacatagttatttgacacatgaagtttgggtccacttgttgagttgaacaagtttcatattatcttatgcttcaaaagtaacactgttgagaaatatggtatttagtataatcataggttaataccataataattagataattgggtgaaataacaattgtatcaataacaagaaatctttttaaagagaactggatacctaggcatggagttgcaaaccctattcctacatatatgatgaaaaattataaagctttacaaaatctatacttgtaacaaaatagttgtgtcatgttatttaatttaatttaatttatttttttagcattattcgtcttgattttggcatatggcaaaggagtattatattgtaatgtggttaattctaactattgtagaagtaggcatcaagtgcctagtatgcctcagtctttttacttgataataacatggtagctgagaaactatatcaaaatgtttagtatatgtactagtgtgctctagcatatcatgttacagagtcaacaattaggaaactcacattgaaccagtcaaaattgcaaatacgacattgatgacttgccctccagtgtagcctttgctaatgactaacttggcaccataccaaaatgcaagagagtaactgcagtaaacaacaaaaaagatagagcctattccaaaaccactgataatcccttccatgatagtggccttgtatgccttttttatgagagtattatacattgtaattgctctcttctcaccattgaaggagacaacctgtttttttaaatgtttttttatgttaaatagttgcaagtaagcattattattgatgtacaaaactaagcattattatttgtcataaattgaaataattagaacataccattcgtatagatccaatggtctgctcaacaacattccccgcatagctatatgatacatgcgtctttccagatatttgagcccgtaatcgagagactaatgcaaaagagaaaatacttggaggtatacaagccatcacaacaagagccagcatccagcctcttatgaatccgatgacaaaaccacctacaaaggctgtcaaaacctgtatatattttcctacctgaacatgagtagtcaaattattagtgttacatcagatctttgcattatgtcatgagcatggaaatctatgtactgaaattggaccccccccccctctttagaaaaacagagtgtcgtactattaataaactagataattaccctgacatgttgctgtgagaaattaagttgcctaatatgtacaaataagttgcagtatgcttttttaaaccaaaacaaaatgacttctaatgttttatataatttgcacgtggttgcaaatatagtgcacggtgagcatattttatgtataattgatactaattattgtgagagaagaaagaagagacaatttgtaccatagatctattatctaaagactacaaataattatgatgatgtggcttcatgagagaagagagaaataacattaactatattttgtggggatgaactatataaatatataacccagtaacactaaaaacacatctttctagttaatgctatttccaaagaaaaaaattctcaatgcatgtgcatcttttcaaatggtgctctaatggaagttttcttctagtttcatttagactagtctagtgtactttttagtcttgttaccttctcaccaagggcatcttggatcagtacggtatctgcagatattctagaagcagcttctccagttgtcatctccacatcaaagaatgcaatgtcttgtgtgataatcgcttcgaggtacaaggatcgaatgcatgccgactgcctttctccagccattgtccaacatgacacctctggaataggtagatggagcactcatgagattctgtcatatgtgaatgtacaacccaactaaacagaaattttgttgcattgttaacatgtccaattgttccagaaaatttgtaaatagaaaattactggtaaatttgctttctaattgtggcaaatgtaattaattaatctgttgtctcatgaagtaatagaccaaaacctcttaatatcattttgctgatctgactatgaagttcaggaatggtaacaagtagtaaaactatgacattaaaatagccaaacattcaacaactttagaaaccatttttatactcttggtgtgtggatcgctatgttactcttgctagtgatcttaaataatttctacggagttgatggtttaagggcatgtacaatggttgataggggtatttttcttttggaagttcaactaaaaacaacttaaaattcaacatataggcatatgcaagagacataaaatatgacaactaatgtcactcgtttgtactttgtgctcataatatagttgtgcatatatatgcccttcctctcttacccttctctcatctacatcgttaagatgtactatgaggcgatatgttaattgtggtgttttacatgcccccaacatatagcttgagattaagcattcttacggagaaaagaagccattgatgttcccactcccaagtagatgtaatacagaacaacctgggtaaaagaaaatgctagagggtaaaagaaaaggaaaaaaatcataatagggaaaacattttgagatattgagtgaaagtaagtcatatagaagcacaaactggaattctatctttttccccgttccaatattaaggttaccatgggaaagtcatttcatgccttaataaatagttagaaaaaattaacctaaattaccatgtcatatttgactttacaaacttgtaaggctaaactcaatatacatatggagaaaaatataaatgtgactaaatttgttgatagaatgcagcattacaagtttgtactttgtagggtgaaatatgaaatcataatctattgtaggctccattcaaaaaaaaaattctattgtagggcaaaatacgaatcataatataaattatcatcccattttcaattcttgataactatttaaatgatgtgtataaaatgaggttatgcgatcctaaagtatgaaacctcacaactaggtcggtggaccaaattaatattgtaaattgatacaagtttgatatgatatatgtctgatttgtagtcattgtgtcatgcaaattattgtggatgttggagtttgttttatatgttaggattagtcatatacctcctaattatttcacatattcagatcatttttttgaaaacaaatatattcaaagcttaatagtattgtcgtttgcaacacaaattaaaatgaaagtggttgaaatcttcaaggcattctcctatccgtgtcacttccaagggtgaccaggccagatggagctcaagcaattgctgccaccacccccacctcccttgcaccacctaagctactcatcagaggtccagacggctgcaagataacaaaggtgggactattttcttctccccctcatgtgcactagagtggtcacggtgaggtgttcgagacgagcggtggtcatggcagtgcctagatccatgcctctgtagctagatatagggtatttccttagtggagactaggaagaactatgtatgtacccaacgattggcatagtttcttttattttattcaatggtcccatttagttgattacatggcccaattacataccatgaaaccttttctttttgctactttagatgtccatattcaggcaaggtggtcggtggctgacggggggcagtggtgaggaaggaggccaatgcacatggtggagcggcggatgcaaggcatgacgatggcgaccgtggtctaggtgtggaggttggtgatggctgtggggcaagcccacccgcatgaaggctggagacaaatgcctttagatcgatgatgaggctggtggctagttgtggagaagaggttgacaagataaagtgcttggatttggccacatagagtcaaatggtggctgcagtttgtcttttgctacctggcttggctctctctttgtatggcaggtctacttctagatatggtagcaaggagtaccatggtgaggggtgtgccagtggcttaggcagcaggggaggagggctgttgcatcttgagaacggtgatggcgagtcatcttgtcccgccatcttgttttttccgatctgatctccccttctttatagagccccccacccccacccctacccaaaacaaaaaaaaattgtggccgatctgcttctagattcagccatatggagctccacggtgagagtgagacaaatgggtcgggtaacaagagcgagaacaattcgcgaggagtcgggtagaggggtgtcgctgcgcattagccatgtgttggcaatggtttgaatggttgtggctggctaggtggatggtgaggccacaacggcaataggaaagcatgtaggctccatgcaaaaaagcctaagctaaaaaaaggacgacgctttgggtgctgcgatcccccttgagagcattgccaagtaatcttcctctccttcactaacatgatcctctatgtgaaaatcatatctaagatttcttgaaaaggctacaatgcttcggtgtcatgatgtctatgggtgaaaatggtacggaaattcccaaccgaaccgatatcgtttccataaaaataaatatcaaaataatgttattttttaccatttctatttctagccatatacaaaatttacttttttaaaaaaaatatgtcagtgttgtattaaagtcgctactaaatagttaaattcataaatctacgaactgatgtcgtttctctaaaaataataaataatgcggaccatttcgagtcgacctgcaggcatgcacgttttatccctaatggtctccatggaggtaatgctttgggaggtcccattcaatgggatgtgcatacgtggatcaactataaattcataccagtggtttgcttggtgctacgctccttcccgcattgtcggcatgtggtgtagtatcctatttttttatcatgattatagcctccggttctggagtcttggattttattctattttgtcagaagaaatttcacgttgtctagtgtggttcatttaaaaaaaataagtaaaactatttttctctcagaataaatgaaattaatttgccaaacacttttttaagataatatttgtcaaacacctacgctaaacatacctaaggagtggcattaaacaagattattaaaaaccacgacaatatgaaacaagcgtgggcccatcacgattgttccatgattccacccacttgccgcgcgtctaggtaactactactactttctccgtttcacaatgtaagtcattgtaacattttccacattcataataatgttaatgaatctaaacatatatatctatctagattcattaacattaatatcaatgtgaaaaatactaaaatgacttacattgtgaaacgaagggagtaccaagcaagcgcggaccactaacgtaatctagtgcaacggattgactccactagagacgcctagatcgtgaccggacatctgaaactgcagttgcatcagggtgaggtaattaaggtgagccaaacgaagcgtagttgattacacctacagtaaattaaacgcgatttagacaacatactccgctacgcgtacgagagcatctcgtccggtggtctcgcgctaatgttccatttagaaaaaaaaaaggtcggaaaagaaactttaatcatttctgtggctatattttattttatttttgaaaaatggaaatcgaaacggtattaaaaatatcagaaaatcaattggaaatcagtacttaatgcaggaatcattgagctacagaatcacatatttgatttaacatggctatatgttgtgatcacggaaattcaaacttgcactatataaattagaatctctcttatatttattaatgtactcaaaatagctatttggttgagaagttaaactataggtcaaacagagacatgtatcacaaatattggatatttagaaatagagtaaaattcataaaactacagatattttgactaaattatcacaagatatagatttaaagtgatgtataacaaaactataaatttaacaataaatttatcacaaaattataagtttaaggctaagtatcaatttaataatagaattatcacaaaactacagatttttggggtttaaatccttaacactaatactatgttgagttataaatgtccgaaatttatgattaaatttatattaaacctgtagttttgtgatacaatactttaaatatgttttaaatatgtagttctgtgataaatttagtgataagtgagtgattttacgatacatcatgttaaatatgaagttttatgataatttagcaaaactacttatagttttgtgaatttattcttagaaatatggtgattactatattataaaactataatttccacttaaatataaaaacagttgataaaacaacagtcgttttcgttccatattttaccgttttcgtttctgtcagttaccattttcaaataatttgaccggtaaaaattatactccacccggtgcctggctgactgccgcccgatcgatcagagttgccacaacaggcaggccgcgggtacgtatatatataggctgtgttgctcggtgtgggtcgggaattaatcccatgcaaaaaataaagtggtagattagcatattattaattaagtattagctaaaagtttttaaaaatagattaagatgattttcaaaacaacttctacatataatttttttaaaaaaatatatatcatttaacagtttagaagcgtaaccgcacgaacgagagagtcgtggttagaaaccnnnnnnnnnnnnnnnnnnnnnnnnnnnnnnnnnnnnnnnnnnnnnnnnn

SEQ ID NO: 15881 - DNA, 2599 bp, Oryza sativa
tcagacacgaatgaaaaaattaatttcataactcgtctggaaaccgtaaacgaatttattaagactaattgatccgtcattagtacatgtgggttattgtagcacttatagctaattatggactaattaggctcaaaaaattcgtctcgcaatttccatgcaaattgtgcaattagtttttttatccatatttaatttctatgaatgtgtccaaagattcgatgggacgattttgagcaaaattctcttggaactaaacaaaggcctgagtttgcctgtgtgctctggccctctttagatttcaacttttttctttaaacttttaacttttccgtcacatcgaatttttctacacacataaactttcaacttttccgtcacatcgttccaatttctttaaattttcaattctgacatggaactaaacacagcctctgagtccctccgcatgcagtgatacactggtacagacgtacagtggaacaagggcctagatacaaccacacaaattggcacccgttatttgcttgtgaattaagcgtttataaaaaaatttaaaaaatagttatattaattggattatataagtatgtaaagaaacatgtcaggcaaaattcgacttttgacttgagggtaaaaatcagaaaatgcatagtacattgtacaacgtaaataaaatttgttattttcttcttaatgtaatagatcaaatttagacatgtatctttgtgtggtgtcttatattatcataatctatcttatcaaagtttataaaaaaatttatataatatttaaaccgcatatatacacctacacctaggtatattgtggaaaaggctatacgtactaactttttcttactaataacactaatgtgtcatattatgagtgcatctagattttttttgtaacttccatctacttaaatcaaacggttgagatgattgttagtaaaagtttagtaaaaaaaatttacgtgtagcattgctcgtatattgtaatagtacctagtgttgtagaaaatattttctggaggtatggtggggggcggcagtttcttaactactggtggaatttaaagtgtttaaagtcgattgccctttaattcatgtgcgcgagatggtcacggccactcgtacagaaacagaagggatatgatgttctcctgtgtagattcggaaaaaataaaataaaacgattatgatcattcccttctgtttttttatggtggaatctgtgcggtgctaaaggtcgaatgtcttttaattcgtgtgcaattatggtcacttgtacaaaaacaaataagagggcacatcttgatttgaaaaaaaaaatgatgatgaccgtcccatcattgttgtttgggttaaattttacggtttaaaaatataccattactatccacctaattgaaacaatgtcattataaatatgttgaaatcggagatatgtcactatatatcccttcactgtatttttttatatttttcttggaccaaattatcccttatctgctaccttcatccgctgcactcttcttcctcccacgatcgagcgtggcggcggtggcgctctgcactcctcttccaatgacggtgcggatggcagcggcgcttgagctcggcagcatagaacatgtcggagctcaagcgtagtgacgcggtagtcagcagcgaggccagcgcaacactcatgactatagaggcgagcatgcattattcactcggtactcgtcacggaaagccaagcacccaaaaccccaaatctccaaaacctccccaatcggtggcggcaaccatggacacatcctccgtatggttgtctcccaccttcctgtcaagaatgtcacgctctcaactggctagcgcggcatttggcgctctaccctgctcatcctcatggacgccaacctccttctcgccggatgtccgaccctaacaccatggctgcatgtgaggaggctcgctctatcatctatgccgtggatccatgggctagagggattggatacggttgaagagagaagaggagagagggaggaagaagacatggacaatttgattaataaattttataaaataggctaaaagagtaagtagtggtatatctcaaatacacattgaattgtaatggtaatttttaaaactaataaatttataacgatatggatccaattaacccttgtttttatgatggaatatgtataatgttactataatcgactttcctttagttcatgtggaattaagtccaggagatgtttatggtcactcgtacgtaatgccgtaaaatgtagaaaaatatttttttgttgatttgaaaattttaaaatagcgatggccattccgttctttttatattggaacatgtaaaaggttaaaattgactttcctttaatttatgtgcaattaattaagcccaggagatatttagggtgtgaaacaaagtagattatgtgtgttggttatttaaaaaattagactaaattatatacatcgtacattgacttggcatgtgggtggaatttagaacaagaactttagaagtgagtgtgctaatgcacgtataactgggtaccgagctcgaattcgccctatag

SEQ ID NO: 15882 - DNA, 7000 bp, Oryza sativa
  unsure (1)..(7000): unsure at all n locations
nnnnnnnnnnnnnnnnnnnnnnnnnnnnnnnnnnnnnnnnnnnnnnnnnnnnnnnnaacccttgtttttatgatggaatatgtataatgttactataatcgactttcctttagttcatgtggaattaagtccaggagatgtttatggtcactcgtacgtaatgccgtaaaatgtagaaaaatatttttttgttgatttgaaaattttaaaatagcgatggccattccgttctttttatattggaacatgtaaaaggttaaaattgactttcctttaatttatgtgcaattaattaagcccaggagatatttagggtgtgaaacaaagtagattatgtgtgttggttatttaaaaaattagactaaattatatacatcgtacattgacttggcatgtgggtggaatttagaacaagaactttagaagtgagtgtgctaatgcacgtataacttggtagataggtgcaatctagtaaaaagaacttaacaaatgagtgtaggagtataacatcttgtaaggtgagtacgattttaatacaataacttaataaatgttgcaacaacgttattatttcaagtatttttttacacgttagtttttaagtacttagtttatcaatatacttgtgtgtatgtctataagcatacataatttttgtcattcaataatgaaaaagtcaattaaattttattgtgtaaaaaaatattgtatttcggttaagatttgagaaggtgaaataaaaaaaatccaaaccgatggtgcaaattggataaatagtgtgattcctatagattaaaacaaggattgtaaggtcctatagattaaatcaagtattgtaaggtaatatccttaatattgctatgtaatggtatattggcatcatgaaaaagtttgtggagcactcaataactaaaacagcatacgtagccaagttgttgcaccaaattctaaatcgtcgttcttgtacacctactggccaagttgttgcaggccagttgttgcacttgaatgtttaattcctaagtttatatactagatcatatccacttatcaacttacactacaagaaatttttctatcaccatgaaaatattgcaacaaaatattatttgtagtaaatgtattattctattaccatgatctaacttttcgtgcaattgataaattatattaaaaaaatgtaccattgttgttatagtttattttttgttgcaatatatagtgggctatagccacattgtgacgtggaaaactaacattgcgacatggcaattttattgccataatttttattttcgtggaaattggcgtaatctcttcgtccatgctacattatcgttgcattaataattttgagcacctcacagtatgtaattgttgttggcacaattatagttccttgtattaagtttgttgcaatataaattttcaacatataagttttaagggctttaaattttcatattttctatacatccgccgatagattcttttggtttaaattagtcaaattttcatatgttggattatgttgagagatgtactctcgccataaattttcctgtagtgatagatggtttttcaagtagtggtttttaccgttagtacaatttactcaaaaagtaattatggtatttcatttatcttaattcaatttggttatgtcatctctccatccacaaataatagcatttctacctttttaaattctatacacaaatatataagcattcctatatttttgctgttgtgcttttcattagctgctaacccatatgcacacacccaaaacataattggcctgtaaaatgaggggtattatcataaatagaaacaaagaataactttcgttgtttttatcttaatctgtattttaaaaagataggaacgcttatatttgtggatggagagagtaaatagttcaactaaccgatatgatccaattaacaattgcgaattgaatgaaatgtactactggtattttatcagaccgcatgcatgtaaagcgcttggggtcaccatattaatcaactctttcttttccttcgtgtgcatgtgtgcgttatatcatattttcgccaaccttttcatttattttttcgttatctcttcttaattaagtttggtaaagatattctgtagagtgcattgttcgatgattgagacatatatgatcttttgtagttctcgcctcgaagggaaatatgatcgatacctacagatcgtctaattaatgccgccaactacaatggttggtaagagtaggacgtggcctctctattttatttgtcccaacctattttatttgtcccaacaaaagttgtttgtaccaccagtcggagatctataagtagatttcctctgaattaacaatgatgcggtgctgatgcttgcgtgatgttgcattattaattggcagtgtcactgaaaatttcttatgtctatagctggtgattagctagcataggcatcatctcgatctccgaatgacagataatataataaaagatgatcaaggaaatttttctcagctgttgttttcgggtggtcgattggtacatgtatggtaatggttgctttgcggtcaagatgaatagatatctgtcaaaagtaactttgattgcacgctgattcccttttggtgtttcatcttctctgcctagctcgcgttgttgtcgatcgatcgggttggttgttcttgcaacgtaaaggttactacgtgaccaaaaactgactcatatcaaacagacaacgaccaaggttgtgaaaggaactctgctatctaggccaggacagcagcgattaattattccgactcgagttcagacttcagacttaagctcaactgaagtctaaagttttgttaggtgaggcgagaacatcagctgttccatcaggcatgggttgctgtactgccgacctcggctagtcgatcaggtgagacacacgcatggtcccttcgcccgtgcatctaccgtaccaacctcggctgagaccgcatcagatttacaaagaaacggaaaaatgtgttcttgcctcttttatactttgtgattttatccttgtttcttaactgaatcttgtgttgccgatgtttcgcttagaggacttaatataatggtgtaaagacatgtattgcccttgcaatttgtccctactttcacgatggatttgtaattttgtccatgatttgatatcaagcctattgatatgaattttgctcctattttagcatgaatttttcgcattgttaaagccatcctaacagaataggggcaaccgggcaagcataagctttagtaaaaaaaataggataagattacaaagttgggaaaataaagataaatcaccattagagttactaacatggctaagaatacaattgtctatataaggaatggtttggttcacatcacatgtttttaatatataacgcaattgacattttgttggcattttttaaacaaaattgagttatatattaaaaaaacggaggtaacagtagtatacttgcattctctacggttcatccggatcggtagtctagcagaggttgagtagcacaaaaggaatatggatcatttgccgtgtcgctaaccaaaagaggacaatgataaaagtgtataattaggcgcacgcccgaccatttgattcatgatcaataatttagattgaaatgctacagtaaattaatgcatgattgaacctgtgagagatgtgtataagggtacaaacatattgttttcatgccaactgcatattgttttcgtcaacgggatttctcagattacttgcaatcgtatagacacatccagtggcatatgtatgactcttttcttatatatagctccaaacaattgcccaccactgatagtttggaagaccattatcgagtatatatatatgaaaattctttgataggacgacttgaaatagctcttttattaacgacaacatctgttcgtaatggacgaaccaagaaaaactagttcttggtatgaagtttaggaccactaatttttgtcccatgataataaggcaaaattggacaccacctagacactgaaagactcctctcgatcgggtagacaaagaaaaaccaaaaaggcacactgacgaatctacagatgtacaaggaacaaaatgtaccgtacctttccaggatgcaataggctagtattacccttaaaaaatgaaaaaagatgcaataggctacagtacataactgcattttttaggtatccatccaaaatctccacgaaaatatttttcggtgcgtgcttttggtgtcagtatccttaaatttcttctcctttatgtaaaaaaaatatttgtaaccattaacccagggaataccttagtaatacttatgtattttcctactgctttcagtcaaatataattattctgctttctttttctccaatacagtttgatacttgatagggattttgcctttatatattctcaatttgcactactgaagaataatgcgccacatcttaactttgtggatgtgtcaatcacctcaggcgcataatgttttgttggtttatcatgcaaggaggagcatatgaatgctcgatgtgaccagctaatttaattttattcgttaggacttaaaactaacggggtttcctaaaaaaaataatcagggattttagaggagttaacaggatttagttcaattcctctattaatttctagcttcctccactctaaggaaggcctaagatgattttattgtataattagggtatgtttagttggtgaaatgaaaatttttgggtgtcacatcggacgtttgaccagatgtcggaaggggttttcaaacacgaatgaaaaactaatttcaactcacctagaaaccgcgaggcaaatcttttgagcctaattaagccgtcatttgcacatgtggattactgtagcacttatggctaatcatagactaattaggctcaaaagatttgtctcgcgatttacatgcaaattgtgcaattagttttttctttttatctatatttaatgctctatacatgtgtctaaagattcgatgtgatgtttttacgaaaagtttttgggaactaaacatggccttagcatgcatgttttagccaagtactctctccgtcccaaaatacaagagattttggttggatgggactttttggacagagggagtaattcattttcatttcttagacaaatctctccatctcaattagttggcacctttcacttggctgtaaggtgattgccatagtgccatcaaagatcaagatatgccaatcaattagagcaatgctaccgtactaaatttttcttactaaacttttactaacaatcatctcaaccatttgatttaagaaaaagttaggacgtatagccttttccaatcagttatatggtcatgtccacctcccttgttgtcgtctccgactggcagtttgttctaccactcatttttctagcatgtagtagtagctggagccggaatgtcagttccttgcgcttacaacttgtcattgaaattgtaagtttgcctattgccatgttagtattcacttgcatggcagcatatgtatgtcacatgcatgatgtcatcatggcatcatctcactgaaataaattgttgacgatgattgtctcctaagtctgcattcttttcttcaattctaaactaaaacttccttctttttcattaacacatttttcaaattgctgaataaaactttttttcaaaaaagaactttatatatatatatatatatatatatatatatatatatatatatatatatatatatatatatatatatatatatatctttaaaaatcaaataaacatattttttaaattgtaataactaatactcaattatttatgtgctaataatttatctcactttgcgtgctaatgaaaagctaaattaagttggagattcaaacgtaccctaagtcctaacaaagttcatttggtatgcacgttaacgttcgatttgcataggttatattgatcttaatttggaattattccctatagatctttagaaaaaaaggtcttaatggcaaatcaaatattgtcgtgaaatgtagtgcatgttaggaccaaagtataatgagactatttactgttggtattgctgtagaagttatgggttagctctaggggtgaaaacagtatggaaacttccggctaccgtttccagtttgcaccaaccgttttagtcggtttcagtaaccgacggtggcggaaatggaaacggtaatatcttctggaaatggtagcggaaatgggacgggctttttccgaccgttttatcggtaaccatatttgtatggtaatttccgttaaaattccgaaaagaatccgaaagttccccagcggctcagccagcccaacccatcggaagcctatgaatgaagaaagcttggtaggcttgcagcctataaaaaagtggaagtgactagggaaaatattgttaaccctatgacgttgcatgtggattttgctgaactttggtcttctcaacttatcgatgttgaagcattgttgaactttgtttatattgtttgtcaaacttattatcatatcattaattatcatataacggtgttatgtggagtgtgatgatgcaagaataaagttaaaaaatatctacgtgcatagttaaatgtgtgctatgccacactccgctaatttcgacatgaatttttgactttcgagtttcgaccaatatcggtatattccgttccgatgatcccgtttccgatataccaatattaccgatatcgttaccatttccgggtctaccgttccgatttcgttttcaagaaaaaaaaagaaaatgaaaacggtatagggtttttccaaccgttttcatccctagttagctccatggtttgtagacttgtagttgtatgtctaagagaatggtttccannnnnnnnnnnnnnnnnnnnnnnnnnnnnnnnnnnnnnnnnnnnnnnnnnnnnnnnn

SEQ ID NO: 15883 - DNA, 697 bp, Oryza sativa
  unsure (1)..(697): unsure at all n locations
ttgcacaacccgttttagtcggtttcagtaacgacggtgccgaaaatgaaaccggtatatcttctggaaatggtaccgaaaatgggacgggctttttccgaccgttttatcggtaaccatatttgtatggtaatttccgttaaaattccgaaaagaatccgaaagttccccagcggctcagccagcccaacccatcggaagcctatgaatgaagaaagcttggtaggcttgcagcctataaaaaagtggaagtgactagggaaaatattgttaaccctatgacgttgcatgtggattttgctgaactttggtcttctcaacttatcgatgttgaagcattgttgaactttgtttatattgtttgtcaaacttattatcatatcattaattatcatataacggtgttatgtggagtgtgatgatgcaagaataaagttaaaaaatatctacgtgcatagttaaatgtgtgctatgccacactccgctaatttcgacatgaatttttgactttcgagtttcgaccaatatcggtatattccgttccgatgatcccgtttccgatataccaatattaccgatatcgttaccatttccgggtctaccgttccgatttcgttttcaagaaaaaaaaagaaaatgaaaacggtatagggtttttnnnnnnnnnnnnnnnnnnnnnnnnnnnnnnnnnnnnnnn

SEQ ID NO: 15884 - DNA, 408 bp, Oryza sativa
tttttaagatcccttatccacggaaccagaaatctccactcctatactatccaaggccgttcacttaaagcccttaggcagtatatatgggtggtttcgctgacgtgacatcttagtccacaaaaaaaaatttaaaaagtacgtgggacccatatgtcagcggcacatattttttttcatctcttttcttgtccttttcttctctcttctttcttctctcttctcttctttggtcagggaggccggcggccgccgatgggcgggcgtcgggcgagagcggcagcagacaggcgacgggcgagcgcggcgggcggagcggcaccggcctgcggggcgaacggtgggctctgcgaccatgacccctgcagttcctgcggcagcggcaaccatggcctctccgaatccctc

SEQ ID NO: 15885 - DNA, 1279 bp, Oryza sativa
  unsure (1)..(1279): unsure at all n locations
aattcgagctcggtaccccatagcaccagatgctcaacaactaatagaaccaataaaggcgcgcctgttctcttaccaaggaatagcacagaacaaacggtaaatggcattgtttgcacattatgcatgcctaatttatctctcatgtggtcatgcatacaaatatacaacatttagattagaggatacttatttgtcacaacatgagggaactatactagtacccagattataggatttttagaaaaaggaaactcaagctaaagtgagaactggagcaaaaggcatatcatgcaaactcagaattaatgctgtaattttgaagttcgcaaacatgaacattttatttgagacaagactccaattttattaagaaatatgtgtgcgacaagccaacaagtcaccagacaagaggtatcatgccttgatcagctgcaattgctgctgcagctgctgcagccgcagtagttgaaagccgctgcagcaatcacatccgaacacacccgtcattaaaaatcactaaacataaaggtatatcgagacatatacacacctcagataagaggaaacggcataccctgtggaacatagagtaggattcctatactcctagtagcagccattgcctattgcaaggtctgctttatcttttggtatcttatggaaaaatcatattctgaagttgctatttttttttcagcttttggatatattcaaaccatataaggatatcaaaatcttacagttctcatctatggttaacgccttcggaggtttttctgatgcagtaagcttccagtcttcaacaattttgtgctagttctgaataaaaggatgcatagtaactttattgtttaaaccaggctgtggacacgaaatttcggaatcgagtaaagagatatgtgggcctatggtgctgtgtgcagctccgtgaaatagggcacatatattatgacatgtactgggatgagaaaccaggctggaagccccttcctccacagaccaaggtggaggaccatccaccttggttggaggtacaggaatgaggctaactacaatcacggatgttattttttgattcaaaggcaagatagattccttactacagattaactcctattatcatagcagtcactacctgttggaaatccaattgattcttcttgactgcttactgtgaaggaaatagaaatcaaatggcaatcagttttgtagctctgatctnnnnnnnnnnnnnnnnnnnnnnnnnnnnnnnnnnnnnnnnnnnnnnnnnnnnnnn

SEQ ID NO: 15886 - DNA, 807 bp, Oryza sativa
  unsure (1)..(807): unsure at all n locations
tccccttttcagcggcgtctgcgcgctctcccccggcgccgcccccgcgttggacaccgctctggcggcgagcatggacaggcgggagcgggagcgctgcacggcgcgcgtgtagttgatgcctgcgggctcgatgcggaccaaggcggcttggaagctcgcgggaggcggcgtgggttggatgccgccgtaggctacgcgagtagcggaaatcagcagtagaagcgggagcatgagagcaagcgctcccaatttggtatccatattacagagagcgtatggcttgcaaatgcatgtaatgtgttatgcatgaggtgatctggacgaatggagttcgatcgtttatataaacattggggcatggatttttatttcttccatgtcttctaaatagttattaaatttaaaaaattaacaacatatacagattaatataaaatatatcactccatgaatatacaaaactgaaatcaatttctacaaattgtaaaaaacatgaaataaactgaaaataattaacgtatattcgtagttagtatattttttatacaatttatagaaattaaattttagtttgcaagtttgtggagcggtatatgttttatagtaagaatcttgtcattttttttaaaaaaatgataactgtttaaatgatatgtaaaaaagactggatatcttcccatggaatgaaaacagtttccaaaacattgtagtataacgtgagtcgtttgatagtttggcacgatannnnnnnnnnnnnnnnnnnnnnnnnnnnnnnnnnnnnnnnnnnnnnnnnnnnnnnnnnnn

SEQ ID NO: 15887 - DNA, 1957 bp, Oryza sativa
  unsure (1)..(1957): unsure at all n locations
nnnnnnnnnnnnnnnnnnnnnnnnnnnnnnnnnnnnnnnnnnnnnnnnnnnnnnnatgcataatatttttcaagcaacataatttatttcaaatataggctcaagatgttcaaaggtggcttgccttgctcgagatctggagcttgatccttgaaatcctcgcactgcgggtcttcgggctccgaaactacacgcgaaacgggacaactcaacaaacggcgaaaataaagctctattaatgacctctaagcgtgccattagatagatctcgagatttgaggaattttggaagttgaacggagtcaaacggatttacgattgggaaaatattgaatttctaagattattggatttttggtctaaaggaaaaggatttaattaaatccttttttgaaaaagaaaagaaaagaaaagaaaagagggagggaaaatagacttttcctcgggcggctagggcacggcccgagagaaacggagcggttcggccgagctaaacgggccggccggcccaaggcggcccaaggcgcgcgcgcgggagggaaggagagagagagccggtggaccgggctcaccacgcgtggtcccggttgggacccgcttgtcggtgacacggttcaccgtgcggagcgagcacgcggcgcacacgcgcgggcggggaagggatgcggtgcacgcgcgtggttcgcggaggaacggatgcggcgggcccacgcgcagcctcacggctcgcggtggaacgcgcgcacgggaggggctgaccggggtcagcccgaccctatctcgggcgagctggcgccgatgtggcgcctacgtggctgccacgcgggctggcgggaggtagacgacgacgccggccggaacggacggcggacgacagcgacgagcggcggagtgaaccacggcgatacaggcgagagcgagcacaccgggtggttgctcaggacgaggggagacgagctaactgctcggattcaccggagggagtgcgtcgacggcggattgcggcggcggcaaccggcggggagggaagaggaaaaaggcgacgaggtcacgagggaccgattcccggcggcgagagcatctacgcggctacgggaatccgttgctagcgtcggattgggcggagctacgccgagcgaggccggcgacgagcgggtgctacggagcacgggcggcgacggcggcgagcacatagcaagcggcgacaacggtcggggcggcgctggctagctacgggtaggctactcgtgctactacccgagtctaaggggaggagatggagcgaggaggaagaacagagggaggcactaccgagatgaggtggggcgctgtgacgagaggccgacggcgcgggagtaatctctccggcctcgggccggggaagaggaaggagagggcgcgcccggagtccccttccgcgtccacgaacgcaccagctctcccggcgcttggcgatgaatggcggaggcgagacagagctcggaaggcggcggcaatggcgcggacgagaaacggggaggaatgggggggaaagaggaagggagggcgcctgggctttaaagggtggcaatgtcggtttggaaaccgactttgggcggtcaaggcgcgagctggcgctccggctagcggccaaatcggcgacagggcggagggaggatgacgccggcgggaggaaaaggggaaaaggagggagagaaagggggcttgccccttgcctctttgggaaaaggaggaggggagcgggggcgacgccgcaaaaggaggaggggctctgcctccgtcccttggcggcttgcgcgcggagtggcggggcccaggcgatgacacggtgatgacggcgggacggtttggagcggagcggcgacaccggcgacaggcgcgtgcagaggctgacggcggcggcgaccgggcggtcggccaccaaggcacgcgcgcgcgggatgcaacgggaggcgcg

SEQ ID NO: 15888 - DNA, 601 bp, Oryza sativa
accctttttctggatgggaacatgtcagtttcttgcggctatgagatcttattgccggtgagggaggtaaatgctgcgccgacggaaaggttctcaagctggggatccctgtttccgtgtcatctatgtatcttcgagctgtctttttctgacggatcttgactggagtatcttgtccctgatgatcagtcgttccacgaatgcggaaaaaaaaaacgctggctcgatgcatcggcttaaattaagttgctccctatcacccccataccaccatcgatttatccaacaacatcctccaaatcacaaaacacaaatcacccatcaatccatctaacaacaacatcccctgcacaaaatcacatagcacaaatcacaaaaatttcaaccggatatccatcaacaattgcacattatagaatcaagcattcatcaaaaaccaaatcaaaggaggtgcagtcactcactgcagacgagaactccgcctgccgccatcgctcattggggcgccgaggttgccattgtttgcttcatgtgcgagagccatcgacgccactggatccatctgcgggagacatcggccgatccgctcatgggagcccat

SEQ ID NO: 15889 - DNA, 822 bp, Oryza sativa
  unsure (1)..(822): unsure at all n locations
nnnnnnnnnnnnnnnnnnnnnnnnnnnnnnnnnnnnnnnnnnnnnnnnnnnnnnnnnnncactaagttttattaatcccttatgatatatgcattgtttcaatgtatatattcattatctttacaagtttacccagtgttttatgactgaacttctctcaaaatttcacgcgctcaatcctttcaattgattgttcatcaataatgttttggtgaaaccgcactaggcatcaactgctagatatgttcatataaaacctcttgtgatgatgggctgatagaaatccaaattttcttcattcgttggttcatttgattgttctttttggacaagcatgtgttgatctaccttatgtttcttttttttttttgctctttttaattcttcagcactttttttgtgctagtgcctgaaatgctaatggcttttctataccaagctttcctcctgtttgtttctttagtgcacatgatgtcttacacttgatctctgaacttcaggtaagttcatatgtggacatatttcattgctgatgcactacctacctttccccccttatttttttgttgataattccagtcactaataaaatatttggtttcattttctagcattggtaaacagcagattaatttaaagtttttcttgttgttttggagagtcttgtgttaccatttccatacttgatttacttcccagtatgtttgtttgtaaattcctagttgctttgttctactttttttctcagtactgattttattggctaattgaaatgcataccatctatgttgatgtacttgcattctgcgtattcttgctttt

SEQ ID NO: 15890 - DNA, 5280 bp, Oryza sativa
  unsure (1)..(5280): unsure at all n locations
nnnnnnnnnnnnnnnnnnnnnnnnnnnnnnnnnnnnnnnnnnnnnnnnnnnnnnnnnatgttgctagaaacactgtaaatctgtaataccctgtggggattatgctgtacaatgggataatgtagccaactctccttgttcagcaccgactcagggtatcaagaagtgtacttgttcggttatctctctcatttgaaatatgtgtactgtgtacaggatagcgactgcgttccgcaatggccatattggttcactactcggtaccaaggccatccaacatggggccttggatgagttggatcctattcgtatggtattgtgtattcgctgtttttcctcgcctccccgtttgcatgagccgagcgccgaacttgggctaatgggcaccgttcgatcgaagttcgaacaaatatatgcaaagcacaggtttcaaaaaaaacgaagagcaaacgtaaagcacgtaatatcacacagattaagtaaacaggcatgtactcctactctcctagtacactaaaattctcctaaaaacgcaattacgcctaattaattagcactatcaagcaaacatgccaatgtaatcgagttcgacggagcccaaccacagcttgcccttctgctccgccacctcgctgagcgtgacgcccttggcagccgtcaactcctccacctccacgccgtcggggttgagccgtacgccgaccaggtgcttggctgcgggcgccgcgcccagccgcatcctctcctggttgagcgccacccagtagcctccctaggggtcgcgcctcacgttgtcggggtagcccgggaggtcggcgaaaagctcgtactcgccggctttggtgccccgcagccagtaccggaacgcctggcacggcacggtgtgcgccacgacgaggtgcgttctgtctcggctgacggcgacgccgttcgggtacggcaggtcggtcttcagcacggtgacccgccgcggtcgcgcgtcgtacttgagcagccgccctgtcgcgtcggcgttcatcgtgatctccccgttgaacctgcgggtgtacgtgctgctgctgtcggtgaaataagcattacccgtagcttggtcgacgtcaagggcattgagnaagtggaagggnacgccgtccgcctcggtcgcgaccacttgggcctcgcgccgtcgggcccgaccttcatcagccccttgtacgcgtcggcgatgtagagctcgccggtcttcctgaacaaccggatccccagcgggcgcccgcagatgctctccctctcctccggtggcacctcggacgacgagcagagagggattttccggtagttcgcattgtacgcgaacgtggtccagccggcggcgctgcctccccacttgagcacgcggccgtccgagacgccggtgtagaggccgtccttgccgtcgaaggcgaggctctcggcgccgctgacgccgtcgggaagcgggaggtggtagctccaccgcgtgtcggtggtcttgatctgctgggccgcgcacggcgagatcaccagcagcgacgcgacgctgagcagcagaagaaacgtcgccgtaaaatcgcgagccatgggtcgcctcatcgttgcacgtagccgagaaaacgttttcgatggagaactagccgctacctgcatgtttttataggttatggctcgtgacagcctcggcgtttcccggtgtccaagttctactcgaggtcgtcagtaatcctgctcgaactagtactctatccgtctcgtattataagtttaattctttttaagttaaaattatttagatttaattaaattatagaaaaattaaaaacatctgtaataccattaatttagttaaatttaaattatattttaataatatatttgtttactaaaattattagtagtatattttttataaatttaattataaatttagaaaaatttagaaaatgttaaacgactcgtaatacgaaacgtattgagtattgcagatggacgggaagacgaaacccaaccgaaacggagccacgacacaggcttggattcggttttcttcacccccgcgggctccggctccgttccaagttcccaatgccaacctctccttccacgaacgccacgtcgcggtcgcgggcaacccacgcgcccagccgcccacgccccaaccagattggcatcgcggccgtccatcgccgcatcggcgcaggcgcggacccgaaacccaccacacggcaaaccaaaaaaaagaggcctcaccgcacggacgcggaaatgggtcgcgacccaacccacgcattccgcccccggctccgatctgctaagccccctcggatcgggttgcgggtcccctcctcccccccgacccaccaccgctcgccgccggccgcctccgacgaggtcagtccccgctcccttcctcgcccttccccccatccccacgctgcctcctccgcctcctccgtggtgttatcgggtccagtaaccggagtcataaaccctagccgagggcgcggtctacgagctgcttcgtgcccgatttcatgggattcgagtgtggggattggacccatggaggctccgatttagcttgtatcttccagatcgctcccttgtatacgctgattgcgtcgttggtttgggacactggggattcgggcgggttgagccggtgaggtgaggggatttaatgaaggtattttgtgcgtgtttcatcaaccgggcggaatggcagcttgctgcatctccagatgttttaatgggatttgtggattatcagaggcgttctgtagtgtgagtgtatgcttaggatatgagcttttcctgccaatttctacttgcgcgtgtatagttatagcttgtagctacaagtagaagagggcatggagaaaatatagtaacatcaaaggtcactcattgctttccagtgttttggacgcgtgagagtttgtctggaaaagagagtcaaaatgatgctattaccttttctttgtatggatgtagtgtctttatatatactatattgctactagcgttgcatgatgtgcttgtttggatctgctgcagtgggcgatcatatttagatacaagatagcatgctggagccaacagctatggaagtgccgattactagctcagtgaacactgcagtggtgcctgtgcctgtggtgcacaatccacgggcacggaaattgcggtctgcagtttggcaggacttcactaaggaacggcgtgctgatggaagctgtgttgctgtctgtaaccactgtaagaagcagctcacagctactagccggtcaggcaccacacacctacgcaaccacctcgcaatctgcaccaccacctccacgcgtggtgctggtaagcgccggaagcttattgtgcgccgtattctccacaacaaaacctccactgatggacagtctggtgacggacatgcttcgggagaggaccatgacaacgatggcacgcattttgaccaagaactcagtcggcgagatcttgcccatatgattgtccagcatgggtaccggttttcaatagtggatgatgtgggcttccaaaagtttgtcaagaacctccagccacggtttaggatggtgtcatatgaaacagtgagggctgatagcatgacaatttatgaaagcgagaagctgaagctgcaggatgctctgctcaagatcccttgccgacttagtatctcagttgatatgtggcgatcgaatacacagatggacttcttgtgtttgacctgtcactatattgaccatgccaatgatgagtggaaagttaggaaaaaaattctgaactttgtgcatgtggaggcaccttttacagatgatcagattgctagtctcattctagagaagttgcgtgagtggggtattgacaggaagctagctgccattgtactggacaactgcgcctctggtgagattgttgctagagagcttctcgtagttctgcagcctaggagactcctcctattaaatgggaatttgttccaggtgcgctcttgtgcgcacattcttaacctcacagtccaagaaagcttagaacagacatctgatataattactagagtccgtgagatgattcagaatgtcaagttctcacaagaaaggttcgaaaagtttcaggatactgcaaaactgttgcagatggaccaaaaactgctagttcttgattctcctaataactggccgtctacatacttaatgtttgattctgcatgttactatcatgatgttctcatgcgccttgcagaacaggaagcacattatggtgcttttctcactgcgaaggagtgggccgatgtgaaagccctcactgaaatacttgatgcgctctatcataagatggagaagtttcctgtggaaaatccgactgcaaatctctattttaatgacatgtgtgaggtgcatgttcttttgaatacctggcgtaatagtccatctcctgttgttgcacaagtggctgaccgaatgctgacaaaatttgaggggtactgggatcttactagaccagtaatggcattcgcatctattctggatcctcgatataagatgaagtctgttgagtacttctgtagactcatttatgctgctgatcaatttagagcaaagacaacaatagatgacattcggcagagttttaccaatttgtgcagtgaatatgaacagtcaggaaattcattcaagaatccatctgctctcttctactctgcaaccagtaattcttgcatgagttcggtatacagcaatggtgatgattttaagaccttctcccgtatcacattatctgatgctcgaaggggacttgatcaatatatacaggagacgtcatcaggccaatcctttaagtctgacttagacatgtaccttgaggaaccggtctatcgccaaaaggaagggcatttagataattttgacatcctgggatggtggaagtcctttgcagcaaagtatcctgtcctttctcaaatggctcgtgatattttagctgtccctgtatctatcatcccattggacagtgatgctcggacattaaatgagtatctcagtaccatggacccttcaacagtgcagggattggtatgtgcgcaagattggttgcgggaagatacagaaggtaccactaggtcacaccttctacagtaagttatatttctgcgggcatgttaatctgaattatttgtttcacttgtgcttttgcagttgctagttcagacggtcatnnnnnnnnnnnnnnnnnnnnnnnnnnnnnnnnnnnnnnnnnnnnnnnnnnnnnnnnnnn

SEQ ID NO: 15891 - DNA, 2453 bp, Oryza sativa
  unsure (1)..(2453): unsure at all n locations
nnnnnnnnnnnnnnnnnnnnnnnnnnnnnnnnnnnnnnatatgaacagtcaggaaattcattcaagaatccatctgctctcttctactctgcaaccagtaattcttgcatgagttcggtatacagcaatggtgatgattttaagaccttctcccgtatcacattatctgatgctcgaaggggacttgatcaatatatacaggagacgtcatcaggccaatcctttaagtctgacttagacatgtaccttgaggaaccggtctatcgccaaaaggaagggcatttagataattttgacatcctgggatggtggaagtcctttgcagcaaagtatcctgtcctttctcaaatggctcgggatattttagctgtccctgtatctatcatcccattggacagtgatgctcggacattaaatgagtatctcagtaccatggacccttcaacagtgcagggattggtatgtgcgcaagattggttgcgggaagatacagaaggtaccactaggtcacaccttctacagtaagttatatttctgccgggcatgttaatctgaattatttgtttcacttgtgcttttgcagttgctagttcagacggtcatgcagatgacaaagcggcacgtggtgatgaacttatcgtgttaccaaaataggtaatatattggacgcagatcacttgtttcagtttgctttgatacttttatcttttcccagatgtgcattcatgtgacgttctcatgcggaaagtttgggaggagcttcaatatttatgcttacatattcaagtgtttgactttctctgtttgctcatgttttcaaaaccttgaatacattgaagatcaaatctatatctatactctggtgcaaagattatgttcaataatataatttatccaacagcagtgcttgggcttaccctgagcagaatatccctactttcaaatagtagtatgcgttggaagtttgagttacatttttctcgaacaccagttcaagttacatgacaccattgattgagaagatcatgtgcacagatgttgctaagcttacaaactgcctaattgaattgctcatgaattcttgtttgtacaatttcataaatgcataaggggaataaataaaaacattctctaaaaagaaatggctacgtgaagcaccatttgctagaactgaaacctgttgaccatagtatttgtactcttaggcttgtagcctgctaatttactcacggcttcagatctcgatattagctaatactccgtattacttaagtacttccttctatacgttttcatataaactttctttactctccatttgcaatcaacttagtgtgattttttttaaaacccgtacagctaaaaaaatgaagaaaaatagcacactgtatatttcttttcttcactagactactggagtacaacaatcggagtatccgatccacagtaattcaccaccgaaatggtagtgttttaggtgcaattttcttcgttggtgcaggttgcacaatggtattaactttagccaattgcggttgttatgcttgtggcctgatacttgacgaattggttaagttaaaaatatgttacttcttttattgtattgggcaccaggattattacatcttcatttttacttgtctgcagttgagacttctgattgatggctcctgagtcctgaggagaccaaggaggcgaggacgcaagtaactgcattatttatgttcaacagtccaatttccaggcttccagctacacccctgtaaatgtatcgttctagttctagatctgtttgtacaatgaagtcgtaggtacctccaagaaggtagtatcaatttaggcaattgactctgcattaatgacttaatgtgtattatgctgctaagctaagttatctccatcgtagctaagttatctccatcgtatttcttaagaatatgcagttatgcaggcaacactcctgaagtggataactttgaatccaacatttcaaatgtgacaaaatttattctactatcaaagaatctgaatctgacgagtgacgacttgtgtttatgtcttttttttttctttcttaaattagccagtataaagaacggtcaagtctcttgaggcttatcaagatgttgaaaatcgtctctctcaactcacagaactttaaagttggtcacgaaaacgcaaaagtatgatgctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15892 - DNA, 682 bp, Oryza sativa
  unsure (1)..(682): unsure at all n locations
acatgaggcatgcgagcacgcatgggggaaatggacataatattttagcctactaaatttgaggcctacatttaaaataggatgagttaaaattttatactttttataaaaaaaaatattgagatctaggtctgcatcgctgtcaagaaagtccgcatcaccgtcgcttcgccgtgtaaaggtacaacacacaccaccctccctcgcacccgtatttccgtggttgcatatggcggcgagcttataatgctctgttcttgctacttgactaattgatcggcaccggacggcgtggagcgggacgacttcagcttcgggtacaaaggcgttttcgaaagggatgcagaggccagcgagaaaaaaagtgtggcaacggcagctggggctgagcatggcaagcctggcttgccgccggcgcccaccgcaattttttttaattttaacataacactcgctgacatgtgagtcccatagtattttcttaactttaagtgcaacgtcagttaaaatcaccttccgaaccgttttaggaccttatttcactggttttcggagttgaggacgtatcatacttatctgttattgtggtttaatgataaatttttgacttaagggacctagagtgnnnnnnnnnnnnnnnnnnnnnnnnnnnnnnnnnnnnnnnnnnnnnnnnnnnnnnnnn

SEQ ID NO: 15893 - DNA, 809 bp, Oryza sativa
cgagctcggtacccgagaagaaattagaccatcacatatctgattcaaggtctaaaagtagaagtttgtcattcaagcgatcaattagcagggattctgcaggaaatagtagcaggcattctctagcccttccctttggcttgcctggctcagttgaattgcttgaaggcaatgattcgactgtgggggaacagacagagcagggtggtgatggtgaggtccaacagaaagctcctattggacgactggctagactaaacaagccagaggtaccgatacttttgttagcaacactggctgcaggagttcatggagtgcttttcccaatgtttggagtaatgatttccaatgccatcaaaactttctttgagccagcagacaaactaaaaaaggatgctagcttttggggtttgatgtgtgttgtcctgggtataatttcaataatatcaataccggtggagtactttatgtttggaatagctggaggtaaacttgtagagcgtgtccgtgccttgtcattccggagtattattcaccaagaagttgcttggtttgatgatcctaggaattccaggttggttgcccattctttattgggtgttttctcttcctcctaaatatcaaggaattttacacattgggaactgatgatgaaatttcatcctacagtggagcgcttggtgcaagattatcagtagatgctttgaatgtccggcgtttagttggagacaatcttgcattggcagttcaggtcgtctcaacacttatcacaggaattgtcatagcgatgatagcggactggaagctca

SEQ ID NO: 15894 - DNA, 508 bp, Oryza sativa
  unsure (1)..(508): unsure at all n locations
gagcacaattcgtacgcaacaataaaactacttttggggacgttttcaaggttagtaaatgcaaaactttaatattaaactttttacccttcagagttttcctctttttaaactcataatccctccataaacaagagatctgcttttacgggggtgatttgacatagttagtcatgtttggcaggttttctttgcactggtgttggcaactattggaatatctcaaacaagtgcgatggcttctgattctacaaaggccaaggattcagctatctccatatttgctttgctagaccgcaagtcacaaattgactcgagtagtgatgagggtaggacattggccaacgtcaagggaaacattgatttccgacatgtcagcttcaagtatccaacccgcccagatgttcagatcttcagtgattttactcttcacataccctctggcaaggttatnnnnnnnnnnnnnnnnnnnnnnnnnnnnnnnnnnnnnnnnnnnnnnnnnnnnnnn

SEQ ID NO: 15895 - DNA, 304 bp, Oryza sativa
gaattggtttctggacatttgctcaacatatttatgaactttagttgatttgtaacttttctagatgggggatgtctagcaatcgaatgccatataagaaattttgtttaccttttgtagatgggaatgtccctcagtgatggaggggagacgggcgagtactgcatccacctgccgacagcatccagcgacgaccggaggactggcggccagcttccggtgcggcgcgaaagggaccgtggtggagatcgacggagaggagcggatccagtcgcgagatgtggcgtaggcgacggacttttgg

SEQ ID NO: 15896 - DNA, 687 bp, Oryza sativa
ctataggcgaattcgagctcggtacccattaatgaagatcacagcatcatccgcatacattgagatccgcagccgagttgttcttcctcgtaattttgaaattgcacccaactctgttgccttggaaaggatacgctgtagaggatcaatcgccaagatgaagagaagcggcgagagggggtccccttgccgtagtcctcttccatgtttgatccgttgccctggcgagccattaaggaggacttgggatgtcgaagacgacaggaaagcccctagccagtctatccatcttgtcgggaagcccttgcgctgcagcaaggccagtaggtaatcccatcacacggagtcgaaggcttttgttatatccaacttgaagagcaacattgcccgtcttaggcggcggtatcttctgatcatgtttcttacgaagaggtagttgtcatgaatacttctcccctttatgaaagcgctttgattgaccgagatcaactcatgcatgtggggccttaaccgcagctctagcatcttagcgaagatcttggcgatgctatgaattagactaattggcctatagtccgaaacgctttcagccccatacttttttgggattaggacgatgtttgctgagttgagcaaattcaagtgcgcacatctcaagttatagatggagctgaagactagcagaat

SEQ ID NO: 15897 - DNA, 591 bp, Oryza sativa
aactaacttttttacacctatttaacggtcaactagtggtcaattgatggcaagggtatggaagcgatcaaaatctaaagttagggggtatacaaggaagcgaagaaaatttagcgacatagaagggatcgactaaagttttaggggcatagagggaattttctcaagattgtatggaaaaccacttatcacctatacttcagattttgttaggtgtaagagaatctccaacagcctctccaaatgactctccaagccaaattttagccattccagtgaaaaaaacacccttcaacagcctctccaaccggatggctaagccatctggctggccaaaaccctcccttccactagccaaatttggccagccaaaatgactagccaactatgggccctacgcacattaacatccggctattctctctcgttgttgcacgcgaccgcaccgggccgtccgcggtctccgtcgtcccgccgcgaccgccgccgtcgtccgggttgtcgccggccggggcctccgccgccggagtccgcgccatcgaccgccacgaccgtcgtcgccatttgcgtcggtgccgaccgcgacctccg

SEQ ID NO: 15898 - DNA, 2360 bp, Oryza sativa
  unsure (1)..(2360): unsure at all n locations
nnnnnnnnnnnnnnnnnnnnnnnnnnnnnnnnnnnnnnnnnnnnnnnnnnnnnnnnnattagctcacaatactaatccgcaatcaccactagtccagaggagataactgacgtgatcaagaatttggttccagaatggatcagtggaaaattctcacagtatgccacttccacacatatactgcttatttacaatctctcgaaataactagggaacttagcaaacttcaattaaaaaactcaaacaaataatctgctttcctcgaatcagatatctttgaacaggtacgcatagcagaaaccaccttgtctgtccaaatcggaagcagaggaaggaaacaagaggaacgagtaaatgaacccacaaaattgcacctagcacggtcatcatcaagatgcaatatgcatgtgttgatttctcgatccatctacattgtacgctgctcaacaatcacagccgaaaagccaaagaacgcaacgaacaccctgttctgcattacaacagctctgccatttggacttgacttggagaagacagcttcgcctctcttaattctaaagcatccaaaatccaccagaaacagattgaagcagaaacatagcgtggtgaagaattaaacgacacatacaaacgcattgctgcaatcaaattctagaaaattcatcaaagggctataacaatccaacgatttatactagatcatgcaaatgaatcagcaggagaaagatggaagcaagatcggcttggatagctcagaacagaattttcccatcaggaatcaccatttctcaattgtcaaaaatcagaagcagaggacgaaacaacaagacgagcgaccaaagcaaaagacgaatctacacaaaagcgatgaaacaaaactagcacatcgttgagacgcctgtgctaatcacccgatccatctacgctcctcgcctcctcaccaatgaaaagctcgcaaacaacacgaatggcacgtcgcgcggtcgatcagaggcgaacccgatagcccaagaggaagaaggacgtcagccaggtgaagatcctcccgagggcctcgaacgcgggcaccgtgccgccgcgcctcaactcgacgtagacggccaaggcggcggttccggccacgaacgtgagggccacggcggggaggaagcgccgcaaggcgcgcctgatgatggcgtaggtccagatgaagacgagcatcttgacgacttggcgcagctgcctgcggttctccaggaggaaatcggcgtccaccttgatgccgcggtagtcctcctcgagttggacgcgctgcgcctcccgctccgcgtcggtcatgggctgggtcatgagctcgttcgtctggtgctggatatggcggagctgaatccccaccatggcgatctcgtggtcgttctccgcggcgttgaagtgcgcgtcgtccagcagggccctggcgtcgtcggggttgtcgacgaggtggaagtacatggcgaccacctcatcaagcagggggttctccgccattgctgtggtgtgggtggggttctaacttctaactgcgtggctccgtgtccggggaatcggactatcggcgggggggtgcttgcttttgtaggccagaattggggctccgtgatgggtggctttgtgggccagagttgtcagagaatcagattgttatccagagctttggcttgcgtggcaagtttacattctgctccattgctgtgcgttgggttatttgccctcgcagcctcgctcttgtgcgtggctgcgtgttttgggggtgtttttggactaaatatgggtttctttgctagagttgtcagttgtaacagagtcgggtactcgtgttactgtccaagcatggtttggttggttaagtccattagagctcaggctgctgatctgtgagaactggcatgaacaaagctttaacggaatttgagtctaatgtcgagcaatttggttccagaatggacaaggggaaattctcgcattccactttatgagcagaaagctaatcacaccaccaaagaaaaccctgttgcgtccaaattcctgagtactcgtggtcaatagcaaaggggttgcatatgcatctgaaatgggaggcgtgagtccataatccatatgaccataattactgcatacagcataataacaccttaagttgaaataacgagtgaaccacctaacaaacttcgacaaacaagactcgaagaaatcaacagcattcctcgaaagttcgaatccacccagcattgcaggaaatatacaattcagaatgtcacatgccggttaccagcttttgggtgaggagcggtagataacgtcaagaattgcatcttggagaaaatcattggagaaacaaagga

SEQ ID NO: 15899 - DNA, 1812 bp, Oryza sativa
ttgggatgctaccaataagcaaagtggctacatcttgaagtcagactggcatttataatcgcgtatcaaaattcacaaaaaacgtccaaataagacatctacagatggattactactatgtggccaactgaccaccagtgtgcacatagtcatggcaacagaaatgattcaccattgagcatgaaacattgttataagccacagtcgtttattaaataaattatttgaccagctatcactaacaaatgaagtagaaaacagcattcataaaaaaaggttatgtcaaagaaactctgatgataatcaaaacctacaaatctgaaagtgaactatgtattctagctacagaaaagagtcagactaaagttttactgcaagaccgattcactgatgatcagaaatagtcaatcagacgccaggaaatggtaacaaatgacagtgagtactgatcaccaaaatgatcacatactaacagacaaatgagcccaatgagtataaaacaaccagatagtacaactaagaaacagatccgagttatctttagtttagtaatatcgataacctaacacatttatggatgtatggatcaccctaaactcttaacctaaatccaaaaacattcacttgctaaatccaagacagtaaatgtaccacatcacaagatgaaatatgtcgaaatataaactgccaatgcttcctcataggccaaagccaccatcagcaacatgacaaaaacatcaaatgtgatgcaaacagaaagcacggatataaccacataatcaaagtaagggcacaccatttatggcatcaaacggccccagactatttcatggtcattagcatcaatcaatcacatgtacatgcatccatcaaacatttctttccaaactaaagaatatagaagtgcacccaaagcctagaagcagaaaatgaatataatgaaacggtgaaaatttgtcccaccaccatgttttccacaagtgcgtatccacattccatatagccatctatagaggaagcatgcacatgccaaaaggcatatacaggacatatattgcacagcataaaagaagcaacactgaatctaatcaagttatagttcctcggtgactggaacggcaactagaacccgtaggtactattgaacagacttgagcagcagaaaacgcctcgagatcagacagcatagcacattaatcaactgtgacatatggcaacagattaattagctcatttcatccattcattaaaacgggatatctcaaaatcatcaatcaatataagggcacatccagatatgcaaactgcaaaccatcagtaagaagtaatgagaagctcagaatggagaaaaagcataaccgcacagcaaccattcggcgttcctcagttacgcatcacaaattgtttcagacatttagcgtcaccaccgaagaaggtagaatgataaaaggaaaaacaggaatggaacataacaagtgttcagatccctatgtttctgtaggctattaagcaactagctcatagaagtcatactattctcatccagcactctaccatcatcagttcatcaccacaaaaaaactcatcaaatcttccataggctgtcgcagcagagcaaaacttcctgtgcatcagatcaccagtttacctcttgaggcggaggaagatcaccacggcaacagctgccgcggcggcgccgacggccgcagcttcagccatcaccggccacgcgacccgcgctccctgcagggtcccaggtgtcggagcagccaccctctcgtcctccgcagcggcagcggcagcggcagcggc

SEQ ID NO: 15900 - DNA, 2402 bp, Oryza sativa
aagtaaaattttgaatgtcacagcgaaggtttgacgggatatcgaaaggggttttcggacacgaatgaaaaaattaattttagaactcacttgaaaaccacgagacgaatcttttaagactaattaagccgtcattagcacatgtgggttactgtagcacttatggctaatcacggactaattgggcttaaaagattcgtctcgtgattttccccataactgtgcaattagtttttctttttatctatatttaatgcttcatgcatgtgtccaaagattagatgtgatgtttttgggaaaaaaatttggggaactaaacgggccctcattgcgtctcaaaatataacaacttttagttggatatgatatatcctaatactacgaatctggataggaggcatgtctaaattcatattattaggatatgtcccatgcatccaaaaattgctatattttgagacgaacactatattgtcatcttctaatggattatgacagttaattttaatggaggcttcacggttgtaacaccgatattgggggctcgagacccccaacgacctcacggtgaatccgtcattgagtgttactgcgtgaggcctatacggttgcatcttatcagtgtatcacaaagtatcaatcgatgctcgcatatgatcccatcgtttagcaaggaaaaatattggtaaaacttttgtatttactaacttctctctctgttttacgatgtaaatcattctatcattttccacatatatatctatctagattcattagcatcaatatgaatatgggaaatgctagaataacttacattgtgaaatggaggaagtatgttccataaaaattcatcttatgtatatttgtattaaacttactctgtccgtccaaaaaaattgtattaaacttactctctctgtccaaaaaaaggcaacctagtactaggacatcctaatacaacgaatctggacataaagtatgcataaatttattgtactagaatgtgtcacatcctagtagaaggttgagttttttttggacggagggagtatgtatgtacttatgctatgtgctatagaacaccaaaactctgtgttttttttattgtagcatactaaaaaacatgttacgtgtatgtatgataggataaaaaacctgataattaattgttaaacaccgatggtactgtattattttgttacatttgatgtaaatgaagagagaaacaatgtgaaaagtatgaatgtattcttggggatatctaatgcgcactattttttttcccgctccaactcaatatcaagtgatagaggggatgagtttggacgtcggcactctagcgaccaaatagcgacagtggcagctagtactgtcccatagcacgacgctcccacgggaggtggcagttgacgtcgtcccgtcatgccggttcgattgagttgcaacgatggtagggggaaggtaccaatgatgctagtgtcgtaaaaaagatccattactacaataagttttttttaaaggatctatttgcaaaaaaaagattttaaaagatagaatgttaaaaatctaatgaagatgagcgagaagaggatatagagtaagaagatagtgacggtttggtttagaacttttaggaaaatatacattttggagtaagtaatgtcatatattgtgtaactgtgaaatttaaattgcatgactttaaatattaaaacagtaatgatattttttgaaccataaagtcattagcaatagcatttatctaattaacctttttgtattgattattgaaaagggaaagctaggagagcaatcaagcgaaattgacacgtgtcacggcagtggacgaatattccatattgcccttcctttcacccccccccccccccccccccggggggcgtcccgtttctgccatcgagtcgaacaaacaaaccctagaactccaataccccatcgagccccggaatagtactccgcccgccttgcggaaacaaatcgaagaagaagaaggaagacgcagccgcgtgcccccccatccatggatctggagatcgtgggccggcacgcgctgctgttcgacgacgacccgacggcggaggtcgtcaactccgggggctccctcgtcccctgggccgccgtcggcgcggacgacctcctcctcgaccgccacgacgtccggcacctgctcgaccgcgtgcctcctcgccctcgccgctcctactccgcggccctcctctctgccccctctctggatggcgtctccgaggctgaactcgaccgcgagcgcttcctcgacctcaccgcggacgatttcggcggggagggctctcaagatgcggtctcttcaggtatacgtctgttcccgctcctctgacctgcctatgcactctttccctatc

SEQ ID NO: 15901 - DNA, 5043 bp, Oryza sativa
  unsure (1)..(5043): unsure at all n locations
nnnnnnnnnnnnnnnnnnnnnnnnnnnnnnnnnnnnnnnnnnnnnnnnnnnnnnnnnnnnnnnntctgctgtagggatcaaacaagagtgaaggactgaaggtaccagacaatatgttgttgatctgtgtgcaagagttgcctctgcaattgtaaggacatacagcaaagataatttgttatgtcataatgttgtttggtttcagttgtgtgaattttcaccatctcggatttgtttcaagtcttactgaggcttcatttggatgggttcaaatgacatcattctgaacccaccaaatgaaaccctgctgaggttaagtccatgaaatgggagggaacttacatcgttctgacttttgagcccatccagatgaagctaagtacatggactgtagatattcgatcttcttggttagaatattattttagttcaatcttctgaaacatcgcccttgaatggatctcagttgtttaaaagttcttttgtttgaatgttagtagcaaaattaagcttctctctgttgaattcctgcagtagctattcttctagcaaccaaactaggaaatagttacattgttatggagctcgatatagtgagagtgagcaatacttgcacaagtagcacaactagcaatgctaattggacccaaacatttttttgttgtaccttttgtaagtttgcaggaaggatgcttgaatttagttgatgagcatctttaatcagttcaagtaagggacttctatttcttctaagatgcatatttgcatctacacgtcttcctctacattcaacactatattttatgttgcttgtggtaaacaatgttacatctgacatcttttctttatacaggaaatgggacagatacaggttgggctgattataattctgtccctttctcatatgggagtactgctggttcagatgatccaaataatttgagcacatattattgcccatcttttcccgtgcctgacagattgttgaataagctggtaagtacatggactatggagtctgtctgactgcttacattgaacttcttttaataaatcggaattttatttctttatgcatttttgtattaatattcttcagctgatccagccataattatccaaggtgcatatgttcttctaaggattaaatgcctatttcagatggttggagcagagatgaggttcctactagtgatgcacattgtttccttacatatatcatgatgtaaggaataggcaggtgggattagaatgatgtaaatgttacacacaacagaaaaaagtactggcatgggatagctgttcttatgatataccagctaaattcatttgagctttgatcataatcttgtacttccatgcactcagacccttactgagacaatgttttcgcccccatattttttttcatttgcagcctccttctgagaaggttcatcaaattattgcaagaactgctctatttgtcagtgagcatgggggccagtcagagattgtgttaagggtgaaacagggtagtaatccaacatttggtttcttgatgcctgaccatcatctccacagctacttccggtaccttgtagatcatcctcagttgttgaaagatggtctagatgctgattcaaacaagggctgcaaaactgccaatagtgagagtgggcatgatgcatcatcaggcggggctttgtcattgcttggggctgtctatgagtctggagatgaggatgaaggcatgcttccgcctagtccaaaaagcacggttcctggaaaagacgtggttgtgcatgagcaaggtcatgaaagctctgtatctgctatacattgcaacgaagaaacacgggatggtcagaaagcaacggcagcagctactgttgcagctaaagataaatctattttgactaagaagaacccaatgattactggcagcagccttcttgctgctcgcctagagaaggccaaagatgccatgatggcatcaagtacgtcagatgtttctgacacaaaagttgtgattctggaaccaccatctttcttgaagcgtacaatggagaaaatagttgaatttattatcaggaatgggaaagagtttgaaggaaaactcattgagcaagacagaacaacaggaaggtttccatttcttctgccatctaatccatatcacccgtattatctgaagcttctcgaggaaactcaagaggtaatgtgaaccacgcttgtttatactttcagattgcaatatttcctttattatccccctttctgtttgctgtttggtacactaagttttattaatcccttatgatatatgcattgtttcaatgtatatattcattatctttacaagtttacccagtgttttatgactgaacttctctcaaaatttcacgcgctcaatcctttcaattgattgttcatcaataatgttttggtgaaaccgcactaggcatcaactgctagatatgttcatataaaacctcttgtgatgatgggctgatagaaatccaaattttcttcattcgttggttcatttgattgttctttttggacaagcatgtgttgatctaccttatgtttcttttttttttttgctctttttaattcttcagcactttttttgtgctagtgcctgaaatgctaatggcttttctataccaagctttcctcctgtttgtttctttagtgcacatgatgtcttacacttgatctctgaacttcaggtaagttcatatgtggacatatttcattgctgatgcactacctacctttccccccttatttttttgttgataattccagtcactaataaaatatttggtttcattttctagcattggtaaacagcagattaatttaaagtttttcttgttgttttggagagtcttgtgttaccatttccatacttgatttacttcccagtatgtttgtttgtaaattcctagttgctttgttctactttttttctcagtactgattttattggctaattgaaatgcataccatctatgttgatgtacttgcattctgcgtattcttgctttttgagaataaatctcgaacttccagagcgtgtttggttgctattttttatttgcgtggagaatattattatatgtatatgcaatgtttctgaacttgtctgtttgaggtgttttgtaggcctccccataccaataaacaaatggaaaattgtaaatgcacttaactgtgatttaaattctgaatgattttgcagtccaagtcccgtggtggttcttcagagcccaaagacagaaaaagctcttcagagcacaaagaccgaagaagctcttcagagcagaaagacagaagaagcccttcagagcgcaaaggtagtaatcatggtaagggagaaagtaaaagcaagaaacggtcaagtactagcaaggatgccagttctcctgatagaagctctgctgagccgtcagagaagcagctctatgacaaacacaaacaagggaagggaaagttccacatgatcattagtggggccaagaaggaacctcctcggaatgtcactgcagatgaagctgctgctattgttatggcagctactcgtggatttggccctgccaatattcaaacaaacacactgaaggacactagtggaattggtcagacccgtggagataatggacatacttcaagctttggaagtttctcctctttacaggacccagatgtaccatccaaacctgtttcaaatagtgaggcatgtacctcactcacaagtagtggtcagcctaaaaatgaaggcactggaataattgatgatgattggattgcaaacactatcgcaaaagctgctgctgttgcagcctctaaagaagctgattcttctgaagcatccatgacaaaagagcagaagctgaaggctgagaggcttagacgtgcaaagatgtttacctctattattaagagtggtggcagcaagatggctgatttgtcaacttcagctgatcaaactaatgaagctggaagggcctctcctggtgatttgaacttatctgagtctgatccacaaccatcagctaaggaacgtgaaggtagctctgtgccatttgaacgtgaaggctctaatctggccaagcaggagaaagactctgatgacgaacggaacagggcaaggaagtataggaaaaaacatcacccagaatctgacgaggagaactatgattcagaggagagctataaacactctaggaagaagcaccgttcagaggattcaagagctcatactagtgatgttcacaaacataagctcaagagacactccaaggatctggaacccaggcatcataggcaccgtgatagctcttcagaagatgagcatgagcacaggagctccaagtcaaggcatcgtcacagggatgactatcactatcacgaggatgatgagcataggagttcacatagacaccagagggaccaccgttccagttcaaaaaggaaaaaggacgatgaccgagataagagcaaacaaactatagttctcccagaagtctcccagaaccaggaaaagccccctggtgacactgctcaatcctcccaggcaacaactgaagtgccgagtgagttgagagcaaaaatcagagcaatgttgctagaaacactgtaaatctgtaatactggggattatgctagacaatgggataatgtagccaactctccttgttcagcaccgactcagggtatcaagaagtgtacttgttcggttatctctctcatttgaaatatgtgtactgtgtacaggatagcgactgcgttccgcaatggccatattggttcactactcggtaccaaggccatccaacatggggccttggatgagttggatcctattcgtatggtattgtgtattcgctgtttttcctcgcctccccgtttgcatgagccgagcgccgaacttgggctaatgggcaccgttcgatcgaagttcgaacaaatatatgcaaagcacaggtttcaaaaaaaacgaagagcaaacgtaaagcacgtaatatcacacagattaagtaaacaggcatg

SEQ ID NO: 15902 - DNA, 688 bp, Oryza sativa
  unsure (1)..(688): unsure at all n locations
ccctcggatcgggttgcgggtcccctcctcccccccgacccaccaccgctcgccgccggccgcctccgacgaggtcagtccccgctcccttcctcgcccttccccccatccccacgctgcctcctccgcctcctccgtggtgttatcgggtccagtaaccggagtcataaaccctagccgagggcgcggtctacgagctgcttcgtgcccgatttcatgggattcgagtgtggggattggacccatggaggctccgatttagcttgtatcttccagatcgctcccttgtatacgctgattgcgtcgttggtttgggacactggggattcgggcgggttgagccggtgaggtgaggggatttaatgaaggtattttgtgcgtgtttcatcaaccgggcggaatggcagcttgctgcatctccagatgttttaatgggatttgtggattatcagaggcgttctgtagtgtgagtgtatgcttaggatatgagcttttcctgccaatttctacttgcgcgtgtatagttatagcttgtagctacaagtagaagagggcatggagaaaaatagtaacatcaaaggtcactcattgctttccagtgttttggacgcgtgagagtttgtctggaaannnnnnnnnnnnnnnnnnnnnnnnnnnnnnnnnnnnnnnnnnnnnnnnnnnnnnnnnt

SEQ ID NO: 15903 - DNA, 556 bp, Oryza sativa
caactacaaaaataggttttttttattctttttttttgacactaaatgcatcttttgtttgtaacagggctataggtaacgcatcaccctctatttctgctattgcagaaggccaatctgcagctcataggttattcgaaataatcaatagaaaaccaaatattgacatcactggaacttctggaataatattagaagatatcaaggggaatgttgaactcaaggatgtgtgctttagctaccccgcaaggcctgaacagttgatactagatggcttatgtctacaagtacctaatggtactacaatggcaatagttgggcaaagtggaagtggtaaatcaacaataattagtttggtagagagattctatgacccacaggatggtgaagtgttaatagacggaattaacatcaagaccttgaaactccactggataagaggaaaaatgagtcttgttagccaagagccattgctttttatgacctccatcaaagataacataacctatggtaaagaaaatgctacagatgaagaaatcaagagagcagctgagct

SEQ ID NO: 15904 - DNA, 1053 bp, Oryza sativa
atgcagccagtgtagctccagagggggattacctgatcggtgcggtcttcagcaatgacatcatggaaaccagcattctcaagcatctggataatttaccaaacagatgttaccatagctctacactttcatgaaagaaacagtactattaatcatatagagtgtagctagcaaaagcacctgtccgtaagccctgacgtcgtgaaggtcataacccctttgcttaatgtaagctgcgaactcttctgaaggtttcccagggcacttgcagtaatcactaattaggaccttacccccaggtttgagccacttgaagaaacttttaaatagtgagggtttatcctgcaaagagcaaaaacagcactggtcaaaacacagttgttctggcatcaaagaaagggtaaaacatatttagtggcaggtaattcaaatagttccaagaatttatttttcccacaatcccactaacaattactacaaatgtatatacaggttctcagggcttgcctaaaacagtccatttcaagctgaaaatatttaaactgttgtaggctgtagagcaataaaccaggaagaaacaaaacatccaaatgggttgtaaataatgtgtaaaacgtacttgtatgtgaaggatagtatcacgactgtagatgacgtcaaacgtgttgtctgggtatgtctttttggtgcaatcagcgacttcaaactcaactgagcacttacgcccaatagcacgctcaagtgcaaaagaaaccatgtttatcgaaagatcaataccaacaacatgaacatcatacttgtcagccatataaaaatcaccgcccccaattccacatccaacatcaagaacgttctggccaggtttgagatccagcctgtccacaaattcttttgtagtttctggtgaacgaagataaaagaataggcatactacaaattagaacaaattagaatattactgatttaaaaatgacaaaaaatacatgcatttactaaccaattccaccagtgctcacaaagcctacaaaaaagatgcgttcatagcgtaatatt

SEQ ID NO: 15905 - DNA, 5606 bp, Oryza sativa
  unsure (1)..(5606): unsure at all n locations
nnnnnnnnnnnnnnnnnnnnnnnnnnnnnnnnnnnnnnnnnnnnnnnnnnnnnnnttctccaaagatgcgttcatagcgtaatattccactggctttgtactgcacattgtccaaaaatctttgaaacccccgatcttctgttgaatcaaccttttgccatagccaacatatctgcatagtatggcatcaagtccatcagttcacttgatcacaggacatgagtgtgtatgtggatgtgcaaggacaaagaagtacctggttttgatttttcttgcttttcacgtaagctccaacacacttgcaagtaagtacagagagttcaaaggaattcccatcttgatcaagagcttgacactctttaaacacctatttttaaatcaatctgttagccttcaatcatcacaacttgttacaaagtagcgcaaataacattgctcagtgctgctataagcatactgtgtgtatagtttagattcagtaaagtgggtaacatttaacgaggcaagtctagtagaaaaccttgaactgtcaagcttgagattcaaatgatagaagggaaccagaaacaagatagttagcatactgaccttagtgtaaaaccttggctcccggtaatgtgtaggattcactttcctttttgaatctccagactgatggaaacaagattccctaaagaagatatagccgccaacctttagccatcttaccattctctttactagcttctcaacctacagtaacagtatgagttagcaaactcagaagacatagccaagacataccaagtttcaacacaaagtcgatttatatcatccagggttcatttcccaagacatattcagatgtgcaaagaaggatcgcaacagatcttaaatatgcttatttatttgaaatgagacacgatatgaggcctattaagtactatctgctcattacctcctcgtctgaaagatacatcagtaaccagtttgaaaatatcagatcaatggagttatcctcaatcatcaggtctggacatgtgacatccgcacacataaaggatgcattcttgtggtgaccgtttatgctttcattctacaagaaacgacacacaagactaaatgaatcaggcataacattcatgtagagataaaagaagccaatcatagttcagcgaagccaatcatagttcagctaccaaactggttttaaggttttaaatgagatgtgaatgttaaaccttcttaatcacactttcaatgaaatccattgcaagaacatgcccagctgttttcactagttctccagtgaagcgacctattccagcaccaagttccagtactgattttccttcgtaaggaggaagtaaagacaatatctgcagaagtgtcagaagagatacgttagaacataagtccaggaaaacattttccagcatccaaaaaacatgtctaatcaatgtgactatgctaattttaaaaaggttaataattactgtgacaattgagtgagagggaacaatctcattcacctgctaatggtagtattattgacagttacagtaacacattctcgtgcgagtacagtccccaaaaattcttaagtgggtatttttcttgtgaaaagagttttacttcgtacagtcagcaaacaggtctgtgatcattaaagtaaaaggtctagcatcatcttctagtctggaaaaaggaaacagcaaaacagaatttttcctttaagtaaaacagtgacaacaattcagctgtctacctaagaaacaccttatgtaatatggaccctatgtgatgctactatgtcaaggtctgctgtcatgtcaagtgttcactccattttgctaaggccttgtttagttcccaaaacaaaaacttttcacgcatcacatcgaatgtttgaacacatacatgaagtattaaatatggacaaataaaaccaattacataatttgcgtgtaaattgcgagaaaaatcttttaaacctaattgcgccatgatttgaccatgtggagctacagtaaacatttgctaatgacgaattaattaggcttaataaattcgtctcacactttcctgacggaatctgtaattttttttttgttattagactatgtttaatacttcaaatgtgtgtccgtatatccgatatctgatgtgacaaccaaacacaaaaagtttccctaactaaacaaggcctaagaaaaatcacttttgactcaaggattacccaaaaacatacgagtcaacatcagtcactctctcaaaagaaaaacgaacaccaggctctccaacctccgttctcctttgagtacatctgtgttgaacaattctagaaaagcaatgcacgaaatgccgaccagtttgtcccggttcatcatttaccacgcgccacttactaccacgtaggaactgtatttggttgggaaaagtaccaaaaagtgcatgcacgcgccccagatctagtaagcggataagaaaatgaccagtacatttcacagaaattactgctaagcaccagtaaatcactggacagcggagaaggaattaggcaggtggcactgtggtatcacctcggggcgctcctccttgtcgagatcggcggcgcgggagtcgagcatcatggcctcgacggtgaggtccttggagtgctcctcccagtagctcttctgcgccttcctctcctccacctcaagcactcctgcgaacacaaacgcagacgcgtcagaacatcaccccgcaaaaacaacgccctccgcacgaacgagatccgcaaaatccaacacaccaacaccaacacccccacgcccccatccatccccaaaccagatcaagcagaacgagaacaaaacgcagggcaaaacagaacagatcaggcccgatccgatccgtgggggggaggagacgtccttctgcttaccattaacagcggtggcggccgcggcgtccatctcggcgggatcgttcgaccgttcgttcagtgcgattttagaggggagggtttagcgactgagagtctgagagaagggaggaggccggcgagattaagacccctcgatggcgaggcgggcgcgggagaagctccgggagcggcggttgaaggatcgcccacgaggctgcatccaccaccggatcacggcggaggttttgaggggggaggggaggaggtgcgggcgtgcgtgcgacgatgagaggtgagtgcgcagcgaaggggaggagggagggactcttataggcgggagaggggagagggggagaagaaggatccaggggaggagcggctgagcgcgcgatcagatcgaccgcgagatccgagcagatcagattttttttttcttttcgtcgttttgcctgagatgaggtggtgcgcttggcttcattcgggtcccgcgcagattcaaagcggccgaatcacaggagtatttctgcagaaatctttaggcaatgtttagttcccaaaaattttttctcaaaaacatcacatcaaatctttgacacatgtatgaagtattaaatataaattaaaagaaaaactaattacacagttagggagtaaatcatgagacaaatcttttaagtctaattagtccatgattagccataagtgccacagtaatccatatttgctaatggcggattaattaggctcaaaagattcgtctcgcggtttccagacgagttatgaaattagttttctcattcgtgtccgaaaactctttccgacatccaatcaaacgtccgatgtgacactcaaaaatttttatttcgcgaactaaacaggccctatactccctccctctcaattctaagtacggatataagttttcgtgtctaatatttcactctccatcttatttaaaaattttagaaaaaagtttaaaaataaataacacataagtgctattcatattttatcattaatataataaaaatataattataaaaatattttaaataagacggacgatgaaacattgaacacaaaatccacgaccgtggctaaaataggatggagggagtatgtgaaatggtgcagaatcgaagcgctcgaataaagaaattttcctgtgttgtgatgcagcagagagaaaatatgcctttcgttccagacggcgctaatgcgcgctgcctcgtgtactcatgtgctgatatacgacactctatcgtgtctcgccacgtcgaaatcatctcgacaacatggtactactccccaagcaaaaggaaaaggatcggaccacgtgcagctcctcgctgatcgtcgcgtgtaaccaagcgaacgaagcagaaaagttgagagttgcatcccccgaccttgcacgctgctcgttgtggcactagtataaaactgaatcgtagaggaatagccatgttcggttggcaaaagggtgaaaactttgtgaagatcaaagcgagaactcaaagcagtactgccatcgattttggcattttgcccacacgcacgagcgcaatacgagtaagagatttgcttcagttaaaaaaaaaacacctcgaggtaccggtactatcaaagtatcttcgatcgtttaatctaaccatgtccatcctacctagatagattcaacgttcaacgataaaaaacgatttggtactatgagataccgatatgtcacgtcctatgagccaggcttcaggcactgggctttgatccaggcaaacagggtgcatgcctttaaaagagaagggaagagcaacagatgaggcatcgatgaagaaatcaacagaactgaagccaaggcttcttcctcctccaatttcctctcatctctctgttcttccaatcctaggctctgttctcttattcccagtcccctgcttctcttcccaatctacattgctaattcctcttaattgtatccaaattacttgagtgattactgctgtgaattatcggttgcttccggtgttgggcattgatcggtgggtgggttgaggatcgtgacaatatggtatcagagcagtcaattcgtgggattccaagcaaggaggcgtgttgggcgacacacagttgcaatggtgacctttggaggcggaatttgagccgtggaggggttagtgctggtggtgcccgccaggtgttcggtgaaatgccgagctggctaggagatggcgcaggcgctgctcttcgtgtccaagtgagccaagtcctttacccggtgaccagcgaggtgctgcatcaagtttacaacacctatggagctgtggcggtgcaagtcctcaccacgagtcctttgggtgttgaggccttcgtgtggttccggtcaagctgtgatgcagagagggctcgatctgtcaccaatgggcgcaatatctatgatgggtgttgtctacttgatgtccagcacgtgcatcctttcaacgggaacggtgtcaacatgacgcccaccaagtgttcgacgccggtaccaagctgcgccaacatcaagtctgatgccaagagcacttctactactctagaacatgtgttcccggccaccatgagtccatccacgccctcagacgaatcagcagttgtggtgccaccgatttccctcaccgcgaccaaggagaattgggctgacatgggcaaggcggaggataaatcacaaaaaacccttcca

SEQ ID NO: 15906 - DNA, 850 bp, Oryza sativa
ccaaggagaattgggctaacatgggcaaggcggaggaaaattcagaaaagaccccccacgatttgtgtgttgagataaaggacatgatcattcagatactcgtgacatgccgcgacatcaaggttgagtcaactacgagcgttgatatcaccagagttgtggcagctacaagcaccaacaccaaatcagtccccaacacattggaggttagtaatgaggccaattcaatcagcttggttgatactaatgagttgtgcatggtgacagccaccaagtgtttgacggaaggcaatgaacaaatgatcaatgatgatgacgatgacatggccaccgaggatttagttgagctcactgaagtgaactccaagttcacactacagaaaacaggtagctctccaccagtaccaccttggaaagcggcaattccatggtacaaggctgagatgaccttaggttctcggcctttaccatggcctgatccgtggttgagtcaagacagctgaggcgtggtgatgacgaagctcttacatccccggcaaccaccttctcaagcagaagctaaagctgaagttggagcactacaattatttggctgtgtactcaattccattgaggttgattgtcaaggtgaggcttcaaaaacactgatttcagagaggacgtgttctattgagttgaggccttggccaccaccttattttctgttaaatgaggtgatcaaggaagtattggagatatgtcatcaagtaaatatgaattggatttccagctatgtatgggagaatattcaaggactattagtgctggatgatcaagtctttcaaagctcgacacagtggcaatctgctat

SEQ ID NO: 15907 - DNA, 657 bp, Oryza sativa
aaagcctgtttcttccccgcggttgcacgccacaccggggcggcttcccccatggaggagcgcacatgaacacagaacaccggacacagccggccgccgggcggacttgtcgtagcacgtgctctgcgtcctcttccgctctgcatctggccgccggctcgagctcaccaatcgaggagcaccatcgtctcatcgagctgtggcgggacgatggccagcttggcctcgtgggcttggtgctactctggccggatctcgacaagaatattagacggagctctaacgccgcgaggagggtgagatcgagcattgaggccggtggcgtcgcggaagaggaggagctcgcgctctctggctcccacctctcctccatgcgcgggcggccacagcggctgccgtcttcccgcagctcccgctgtcgattccgcatcgcctgggggccagccttcgagactccgcttccgctgctgacgcccagttcctctccgccggtcgccgcagctaggtccacctcccgccgccccctacctcttccgtccatagccgccggagccgagcctctgccgtcgcgcgcgtcgcgagagaggagaggggagagagttgaagagagagggagatggggagaggaggaagaagaggagggctagaatgacaggt

SEQ ID NO: 15908 - DNA, 712 bp, Oryza sativa
  unsure (1)..(712): unsure at all n locations
ggtcatgggctgggtcatgagctcgttcgtctggtgctggatatggcgaagctgaaatcccaccatggcgatctcgtggtcgttcttcgcggcgttaaagtgcgcgtcgtccagcagggccctggcgtcgtcggggttgtcgacgagggtggagtacatggcgaccacctcatcaagcagggggttctccgccattgctgtggtgtgggtggggttctaacttctaactgcgtggctccgtgtccggggaatcggactatcggcgggggggtgcttgcttttgtaggccagaattggggctccgtgatgggtggctttgtgggccagagttgtcagagaatcagattgttatccagagctttggcttgcgtggcaagtttacattctgctccattgctgtgcgttgggttatttgccctcgcagcctcgctcttgtgcgtggctgcgtgttttgggggtgtttttggactaaatatgggtttctttgctagagttgtcagttgtaacagagtcgggtactcgtgttactgtccaagcatggtttggttggttaagtccattagagctcaggctgctgatctgtgagaactggcatgaacaaagctttaacggaatttgagaaaaatgacgagcaatttggttccagaatggacaaggggaannnnnnnnnnnnnnnnnnnnnnnnnnnnnnnnnnnnnnnnnnnnnnnnnnn

SEQ ID NO: 15909 - DNA, 721 bp, Oryza sativa
aatggattccattatcgctaacgggacttgggaggtgacagagcgaccctatgggtgtaaacctgtggggtgcaagtgggtgttcaagaaaaagcttaggcctgacggtactattgaaaagtacaaggctcggcttgttgctaagggctatactcagaaagaagacgaagatttctttgacacttactcacctgttgctagattgaccacaattcgtgtgctactttccctagcagcctcacatggtcttctcgttcatcaaatggacgttaagacagtttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacatt

SEQ ID NO: 15910 - DNA, 1747 bp, Oryza sativa
  unsure (1)..(1747): unsure at all n locations
attcttagaaatatggtgattactatattataaaactataatttccacttaaatataaaaacagttgataaaacaacagtcgttttcgttccatattttaccgttttcgtttctgtcagttaccattttcaaataatttgaccggtaaaaattatactccacccggtgcctggctgactgccgcccgatcgatcagagttgccacaacaggcaggccgcgggtacgtatatatataggctgtgttgctcggtgtgggtcgggaattaatcccatgcaaaaaataaagtggtagattagcatattattaattaagtattagctaaaagtttttaaaaatagattaagatgattttcaaaacaacttctacatataatttttttaaaaaaatatatatcatttaacagtttagaagcgtaaccgcacgaacgagagagtcgtggttagaaaccaccacaaacaaactcagccacagtacgtgtgacaataccttgctgacccggtggagaacggtactgacgtcgtcgccgccgaagcagtcgatgaccgcggagaagacgacggtcatgagcggctccgacatgccgttcgccatcgccgccaccgtgccgaccgccatcagcgccttgtcgacgccgtcggcgtacctgaacatccccaggaacggcagcttcccggcgtcgccgtcgttgccgctcccttccttcttcttcttctccctctcatcatcctctcctctacctgcagtcgacgccattggcaagagttactgtttctctcagctagctacctagctgctgctcctctgaatctctggttaagtgagaggctactcgatctctgcccgtctccgttttataaatttgtcgggtctcttcgcgcgctctcgtggtgagtggccgacaaagacgcaaccggagcggctgcgtgatggatatcaaaagcgaataaataaatcggcaccatatgccctctccgatccatcggttgcctgtgctgtgaggggatgtttagttcgcgaaaaagaaaattttaggattatagggtgttatatcaaacgtttgtccagatataagaagggattttcagacacgaatgaaaaaattaatttcataactcgtctggaaaccgtgaaacgaatttattaagactaattgatccgtcattagtacatgtgggttattgtagcacttatagctaattatggactaattaggctcaaaaaattcgtctcgcaatttccatgcaaattgtgcaattagtttttttatctatatttaatttctatgaatgtgtccaaagattcgatgggacgattttgagcaaaattctcttggaactaaacaaaggcctgagtttgcctgtgtgctctggccctctttagatttcaacttttttctttaaacttttaacttttccgtcacatcgaatttttctacacacataaactttcaacttttccgtcacatcgttccaatttctttaaattttcaattctgacatggaactaaacacagcctctgagtccctccgcatgcagtgatacactggtacagacgtacagtggaacaagggcctagatacaaccacacaaattggcacccgttatttgcttgtgaattaagcgtttataaaaaaatttaaaaaatagttatattaattggattatataagtatgtaaagaaacatgtgannnnnnnnnnnnnnnnnnnnnnnnnnnnnnnnnnnnnnnnnnnnnnnnnnnnnnn

SEQ ID NO: 15911 - DNA, 810 bp, Oryza sativa
gtggcatcctgacatgtggggcctacgtgggtcccacgctgactcagccgccacgtaggataaaatcggatacaaacccactgaaggacctatagtgaacggtttttataagttgagggatgtcatatatctggttttgcggttgagggacgattttgtaactcgatgacaagttgagggaccttcggtgtactttttcctccatgtgatcgacgaggcgttgcgggggttcgcggcatccaaacacctcagccgcagcccctttcccaatcacctaaggccgacggcctgcatccccttctcctgccttttggagggcgcggtggataacctcgtcatccctaccgcggtcttcaacaaccatagggacgtgtgctatctcaggacagtagcagtgcaaggcacgctaccgtgccttcatcccaatccagcaaggattttggccctaaattcatctctaagtcacacaccctacagtgctagtgaccttaatctcgtgaccttccttcttttacgtgggaccacaatgcaggggaccaagagtgcccagcccaagaaattaattctcgcaactacccttctctcgaactctccacattgctcccgttctccttatcccggttgcgagctcgccgagaagcactctgtctcagccgccgctccggctcccctctttcctccaccagcggctagcgccgggtcttctccctccgtcgccggcgccggctttacttctccggcagccgcggttggcggctcgcgcgagttcttgaaccccatcgcccacgaggtggtgctcaagatcaccag

SEQ ID NO: 15912 - DNA, 948 bp, Oryza sativa
gcacgccagtcccggctagatacattccaggcttcatcgcaaccattgcaaagaagtcattgtatgaagaaggacagacgtgcgacatgctaaactgacacgtggtggacaagaatgaccggtctgtgactggtctgacgccggtcacgtcatcagcagacaaaccgtgctcccacgttgcatctgcttccagcgaagtggaggtaggtatgacccatcccatcggagggtcattcggacagcggccattgcaaatctccgcccattaatggaggaatgacagggtgatcccctgtgtcaggcgagtgacggcgctgggcctcactcaaggacaagctgtgatttagcttccaagcaaaggcgcgagccaagttctgatcaagatagggtggatccccacccaaaagaagggtaggtagaagtggtgcatgtggtatccccttgagatataaaaggaggaccttgcccaccgaagaaagagaggggagatctagaacaagaataggggggacgactctgagaatacctgagctcagggagatccagaacaagaataggggggacgactctgagaatacctgagctcgtagaggacagaaagaggaagaggggttctagagcctgaactcttttgctctccagctctctgtaactccttcacacacagatccaccataacacaggagtagggtattacgcttcttagcggcccgaacctgtctacatcgcccgtgtcttttgcattggctctctcgcgaacattccacagatcgagggtgaagaacctcacttagcgcccccggccgaaccggcaaagggggacctgcgcggtctcccggtgaggagccccacgctccgtcatctggcacgccaggtagggggtgcgtgtgactttttaagccctcgtcctctttcgtgtgccccaagcttgagtattctatagtgtca

SEQ ID NO: 15913 - DNA, 108 bp, Oryza sativa
ttgttgaacaactgatatacaatcagcattcctcactgtggtcaagcgatgagcaaccacaagtgtggttctgtccaccatgatcctgttcagtgcctcttgaactat

SEQ ID NO: 15914 - DNA, 723 bp, Oryza sativa
  unsure (1)..(723): unsure at all n locations
nnnnnnnnnnnnnnnnnnnnnnnnnnnnnnnnnnnnnnnnnnnnnnnnnnnnnnnnnnnnnnnnnttaggattttattcccaacaaattataaactcgtgacaatatttgttaaactaatggaattgataacactattagcagtttatatcacattatcacatcaacccaatattaaccacaaatgattgtaaccttgtcttatgggaagcattttttttggcagttcttggtaacatagtttaacagtaaatatcaacaagattcatgaccaaacaagtaccctaagttttccactacttcatcagtataataaaattgaccaaacatttggcttaatacaaatagttttcttaatgaatctcaagctaattaaccagttcgaatgaacgccaagaatatgacttcaactatgcataggatcatcaccatagttctcctatatcatcatcatgatcagcaccagtctttaacatcatcatgagcagaaccaccatcttcatgatttgattcacatgcttttcttttttaggaactttgatgcaccatacattaagcttgatgacggctgcccattggtagacaaacttgtcaatttcgacatgtgtgaacagcaagaaatatgttttccttacataattcatgattggttttacataatctctattttataagaatattttttaacttcttttgtggtactcctacctaatacttcattact

SEQ ID NO: 15915 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnnnntattgtaaatcagaatcagataaatcattgtcatcactttctttttctatatttggtccagccaccacaatcattcctttcgaccatggaggagtatgtgagagaggctccacgcatggttccaattaaggaacctttggtcagttcttagttaaaatgacctgctatttcttttaaaaatgccttctacgtttcgatatgcctcctttatattataataatcaagcagcagccctgatgatgatgtttgtgcaatatttatcttcaattgaaatttgaaaccatagcaaaagaagaatcacatgtgttgtgtcaccacagtaaaataatcacatgttgatttgtactaaaataatcattcgatctataaaacggattcttaaactcttaataattgttatttcaccaggagtttcctgagagactcctcctgacatacaaaccagaagaatcagaagagattcctgagcctgtttctgctgaggaggaaaaaccacaaattgaagaacctgctgttgcagtgccatctactgaagtagttccaccaccacctcctaaacctgaggtcgtagacaccggtgatttattggtaagtagaagaaaccatttactgcatgctgcactggttcatttatcacaatttaatgatatgtatg

SEQ ID NO: 15916 - DNA, 4029 bp, Oryza sativa
gctggtccacatctggagccaattaatgtaacattcatttcatgcactatgtaggttgcactgaagacacttgtggtgatccacaggcttctccgggatggtgatcctacattccgtgaagagtttcttactttcacacaaagagtgcggattttgcaattatcaaacttcaaggatgactccacccctgttggttagtagagcacatcaattttctttagtatcacctcctaaattcccattgtttctaatacaactttttatccagcttgggactattcttcatgggttcgtacatacggtttgtttttggaggaaagactggaatgcttcagggtcttaaagtacgatattgaagctgagcgtttgtcgaagcagggtcaagggcctgaaaaggtttggttattatcaatctcatttggttattgtagtcaaattagctaccatgattataattagagttacaacattttgtcaattattggtttctatcttgctgaattcttcatattgtgactttttcagggccacagtagaaccagagaattagattctccggacttgctggagcaattaccagcactgcagcagttactctatcgacttattggatgtcgggtgattttctcttttgccagtttggactaatgggggaaataaacattctaaaatctaattttccagtctgttttttgtgaagataacctgacagctttctttcttcttatgcagccagaaggagctgcaaatagcaattatttggtgcagtatgctctagctctggtaagctatgttttttcttttacaccagtgtttttcttcttgtggatgcagatgtgtttctttttattacccaatcgctccattgcaaacatcttggttgccttggcacttcataatttgtcaggatgaagagccatatcctgctattactgatataattgagcagttccttctctggactagagtctattcttagaataagggcatcttttgtgcaacattgtatctgtgctatctttttgctcatgtcattgcttgcttgtacagatcttttgcaatattttgtagagcaaactatgatcaggtggtgatgccttagtagagtacattcctagaaattttcctttgttaaaatggttttatatctatatactatcttaggacatttgcacccagttcttttttcagaatttcccctttggggcattctattttgtgttgatatccttagtcatataaggaaataaaagtttctttggtgttttttgtaataacattctggtcataagaaaacaaaaacgatcactgtccttttatgaattaaatttccagttagtgttatgaattaaatttcttgatagttttagtaatttaattttatattagtttaacttggtaagttgagtgaatctccttgctttgcacaggttcttaaagaaagcttcaaaatctattgtgcaataaacgatggaattatcaaccttgttgacaaggtaatttgtttttatattgacagcactatactgtttatttttgttctggcaagttgtgcatactaatattttcttttgttgctcgaaaatgatgcagttttttgagatgccaaggcacgaagcactcaaagcccttgaaatttacaggagagctggacagcaggtgattctaagattctgaaggatggttatctgaaatttgtggtatttcaaagatgatgataatggtagaaataacactgttatgctctaggctggaagcctatcggacttctatgaaaactgtcggggattagaacttgcaagaaatttccagtttcctactctgagggaggcaagtatttttgtgctaactgtgcaacttcttgtattgtaaatcagaatcagataaatcattgtcatcactttctttttctatatttgttccagccaccacaatcattcctttcgaccatggaggagtatgtgagagaggctccacgcatggttccaattaaggaacctttggtcagttcttagttaaaatgacctgctatttcttttaaaaatgccttctacgtttcgatatgcctcctttatattataataatcaagcagcagccctgatgatgatgtttgtgcaatatttatcttcaattgaaatttgaaaccatagcaaaagaagaatcacatgtgttgtgtcaccacagtaaaataatcacatgttgatttgtactaaaataatcattcgatctataaaacggattcttaaactcttaataattgttatttcaccaggagtttcctgagagactcctcctgacatacaaaccagaagaatcagaagagattcctgagcctgtttctgctgaggaggaaaaaccacaaattgaagaacctgctgttgcagtgccatctactgaagtagttccaccaccacctcctaaacctgaggtcgtagacaccggtgatttattggtaagtagaagaaaccatttggggatgctgcagaggttcattgcaggcatgacaatttaatgatatgtatgctcctagggattaagcgatccaacccctagtgtatcagcaatagaggaaagcaatgctttggccttggctattattcctacaggtattttgtcatccttcaatccagtgatgcctatcatgaaccttgtgttagataattctgaaaattgtgtgcaatataacaggtggtgagacgtcaacaagtggcacagctacactgcaagataaaggatttgaccctacaggatgggaacttgctcttgttactaccccgagcaccaacacaaactcaatggccatggacagtaatttggtgggttttcttactctttctctgaggatatttatggttagtataatgtcccgctttggatttggaaactgttattctgctgttagtggctcctgccagcttgtcttggttttggatcggacggggttttagccatagctcccaaatcaatctggctggaaaagctttgctggttcattgttggtgaaaacagggagcacaactactcatatatatctgtttatcagaaagcatttaagtgagaaaaaatgataactttgtaattggtgtgaattgcaagtaaatgatttatttcctagaattaatggacctcatggagtcttgggctaatctagaaagtggttgtaacaaacttggttaaggttaagtccatgaaagacctgctgacatgctctgcttctcaaagaaaaagttcattatgctagcaaattctgcaatatctcatcctaatagtgattaactttgagcttggacttttccttttgcgttttcaatttatttgggcaaaagtgtccccaaactcaactttcaggtgaaaatcacgcttttcatagacacagtctttggatttgcttctaaattttaatgactgagctgatagttggcatctttacaatttgttctacttttatacttatgatctcataatggtaatatttaaaattttgaactgttgagtgattcgggttgggttcagtaaccatgtgattttttactccatatttgccattattggtctagctgatcagcccaaaatttattctcttgtttttgtctgcagggtggtggatttgacaaactcattctggacagcctatacgacgagggaacctacaggcagcagatgcagcagcagcagctgtatggttcagctgcccccaaccctttcatggcgagtgatcctttcgctatgtcgaatcaagtagctcccccaccatcagttcaaatggctagcatgactcagcagccccagcagatgcctatgatgatgcagccaaatcccttcgggccaccactacagccgcagcatgcaggcattgctcaggcacccaaccccttcctcgatgctgggttcggccctttcccagcatcaaatgggatgcacccgcaagccaacccgtttggaaccgcccaacttttgtagggtcacagttaacacacgagatgggcacttgggcagtgcaaattcaagtctattgagttgcatattgc

SEQ ID NO: 15917 - DNA, 634 bp, Oryza sativa
  unsure (1)..(634): unsure at all n locations
nnnnnnnnnnnnnnnnnnnnnnnnnnnnnnnnnnnnnnnnnnnnnnnnnnnnnnnaacctatttaacggttagggtatggaagggatcaaaatcaaaactcagggggtatacaaggaggtgaataaaaattcaaggacatagaaggaaattcagggacatagaagggatcggctaaagtttcaggagcatagaaggaattttctcgtgctttaatgcataatatttgtgtgcatttttccagcttgtagatgaacaacgctagggtaaaagaaattacatctctttatgtcgtgtcatccaataccctgaaactacgaaaacaaattattgtgcaattttaccttggtgtcttaggccaaacaaaacctaaagtataggcaataagtgatgttccatatatctttgatgcataatattgtgtgcattttcccaccttgtagatgaacaaacctaggggagaaaaaaatacatctctttatgttgtctttgagtgtaggtctaccaacgatgcatagactccaccattgatcctcatgagagagtcatgttgtcccttttcagcgattgaaccattcttgatgactgcaatcacatctgcccctttaatcgtggacagacggtgtgctaccacaa

SEQ ID NO: 15918 - DNA, 1326 bp, Oryza sativa
cgacgacactgacgagaaggagaggatcccgtcgggagtagcgagcgcggggcacgctgacgccgacgaccaccatgccaaccgctagggggctaccgcctccacaggctccgcctccgccaccgctgcatactggccgccacgcgctcgactgcccgccgccaccgccgcgcatgtgctccactccgcttcgctggccgtcgcgcttgcacgccgcctccgcgaccgccgtccttctctcccgcctcgcccctgccaggttacagagaagtgagagagaggagtctaacgtggataaccctgacatgtggggcccacgtgggtcctacggtgactcagccgctacgtagaccaaaactggggtcaaaaccaccgaaagacctcgggtgaccggttttgtatgcttaaggaaccccgcatatctggttttgcggttgaaggacgtttttttatcccgatgacaagttgagggaccttcggtgtactttttccgatccataaccataatcataagagcaggtataatagcaggctataaaccagctataaacacatttcaaaaagataaaagaggagagagaagggcagcgctccgggttacagatttgtagctagctgtagcacggactctaaagtacatatgtgtatgacaaatgggagcagatattaattatgtagtatatgtttatagacaactattgtataaattagctatcaagttgactatagatgatttggagccagcaattgactatactattaagcttgctctaagcagaaggcctaccttcctttgcggcttcgggacgatacgatggttacgcgcagaccggcatgacgccccgtttgagaggacggcaatcggcacggtggaaaacgaggctgaaatccagacaaacctaagctcctgaacgcaccaaagccaagcgttctgaacgcaccaaagctcctgttcaaccgagtaaccaaaccatacatcaatcagaagataccacggtaccaacaacaaaacaaaggggaataaccagcaaccgtgtcgtggcgagctcacaaatcgtgtcacatcatgcaacttgcaaaacaaagtagaaattcagaaataactggcagaaagactagaggatttcttagaggaaggtcgccacaaatacctctgaacatgcaagcatgaagcagtggcgcacccagttcagatgtctactccataatgggcgaaaagccgagtaaacaagagaaaatttagataacaatcagcgatcagacgaagttaatgacatttgcttacgacggtgcagccagcacgcgcctacttgtccgagacgcatc

SEQ ID NO: 15919 - DNA, 1110 bp, Oryza sativa
  unsure (1)..(1110): unsure at all n locations
cggtggagaccatcacgaagaccctcaatggccccagcgccacgccgtcccggacacggcgaacgcgagcgcggcgaccgcgaggagcacgctggggaggcggcgcgcgcgccgctacggtggcgacggcccggaccacgacgagcagcgtgacgacctggacgagctgcaggcgcgcctcagggcgcccacgacggcctctcgagctggtccatcagctcggccgcctcggcgtcgacgcccgccggcgccaggcgcctggctcgcgcgagcaggggcaccagcatggcgaggcgggcggcgttgtcgcgcatcctggcgtgggcgacgtcgagggcgaactgcacggtgtcgacgtcgcggaggagcgggaggaggttcggagcaccaacgggaccatgggatgcgcgttcgccattggggctgggtgggagggggcgatccggcgatgcagctgtgggttttgcggtttggagctaagaccaaaagggggttttggtcttggggtttttggcattttgcagtggaaagggagaaagaagatgaggcgagtccgcgagtggtgcagggatgtcagattgtcagagtactttgtgtgccaggcttaacttgcgtggaacgttagcttaaatcagcaagtgcttcgtttaagagctgagaatcacaactagctctaccgtcacatggtttcgattccgtttagtcatgccattttagagtggtgttaacataccctaaaatgtgtttagatgccaatttacttatccaataaagggtgtgtgtagttcacgttaaaattaaaagtttggatcaaattgaaacgatgtgacggaaaagttagaagtttgtgtgtgtaggaaagttttgatgtgatgaaaaagttaaaagtttgaagaaaaagtttggaactgaacaaggcctaaacacggcgaaagacaagtaattctttcaaaatttgttctcctttccctcgagtccaccggaggtccggactagtatactaaagagttcattcatccattgcaatggccaatggcaatatggnnnnnnnnnnnnnnnnnnnnnnnnnnnnnnnnnnnnnnnnnnnnnnnnnnnnnnnnnnnnnnnnnn

SEQ ID NO: 15920 - DNA, 1965 bp, Oryza sativa
ttttggatgctttagaattaagagaggcgaagctgtcttctccaagtcaagtccaaatggcagagctgttgtaatgcagaacagggtgttcgttgcgttctttggcttttcggctgtgattgttgagcagcgtacaatgtagatggatcgagaaatcaacacatgcatattgcatcttgatgatgaccgtgctaggtgcaattttgtgggttcatttactcgttcctcttgtttccttcctctgcttccgatttggacagacaaggtggtttctgctatgcgtacctgttcaaagatatctgattcgaggaaagcagattatttgtttgagttttttaattgaagtttgctaagttccctagttatttcgagagattgtaaataagcagtatatgtgtggaagtggcatactgtgagaattttccactgatccattctggaaccaaattcttgatcacgtcagttatctcctctggactagtggtgattgcggattagtattgtgagctaatgtaaaaacttgccacgcaagccaatgatctgtacaacaatctgattctctgacaactctggcccacaaagccacccatcacggagccagtgagccacccacacgacagcaatggcggagagcaccctggccctgctcgccgaggtggccgccatttgcgaacaactcgtagacgatcccgacgccgccaagatcatgctggactccgtgctctccggcttcgcggccctcgacggccacatcaccacgttgaagaatctgctcgatttttacctgcgtgcggcggacgaaccgatcatggactggcccatggccaaggtggagcgggagaaccagcgcgccctcgaggaactctaccaggatctcagggcggacgccgatgtcctcatggagcaccgcaggcggctgcaccgaatcgtcaagctgctcgtcttcatccggacttacggcatcatcaagcgcgccttgcggcgcttcctccccgccgcggccctcaagttcgtggccggagccgccgccgtggtcgtgtacgtcgagtggaggcggggcacggtgcccgagttcgagaacctcggggggatcttcacccggttgatgtgcttcttcctcttgggctatcgggtgcgcctctgatcgaccgcccgcgtacgcgacttgccgctcgtgttgttcgctggcttttcattggtgagaagcgtagatggatcaggaggttagcacatgcgtcttgatgatgtgctggttttgtttcattgcttttgtgtaggttcgtttgctttgcttgctccgtcttgttgtttcgccctctgcttctgatttagaaatttgagatacggtgattgctgatgggaaaaattttgttcagagatatccaattcgatactgttttccatcagtggggatcctctagattcatctgcaagatcaagcataagttcttggattgttataacccgttcatgaattttctagaatttgattccagcaatgcgtttgtttctgcttcaatctgttgttggtggattttgcgcgtgtttaggagtccactacggccattcccctgttcggtttggcaaatagatggtactccctccgttccttaatataggaaaggctgcgaagtttgcagcgcaaaatttctctgttcatgtctcggttcttcgcgtgcggggtggagtactccaggagctgaggctgagcaatccagttcggagtggttaacgaagacgatgacgtggagttgcaggcgttcaggagatctctatcacctcctcgccgacgtcggccgcgccgaggccgtcctcgcaaacgccatggccgagctccacgagtggacaacgcggggatcacgaagtagtagtacttaattagtgatcatgagttgctgacgctttccagatcaatccccttgttacaacttacaacttcggttggacgagtggtgtcttgggatt

SEQ ID NO: 15921 - DNA, 542 bp, Oryza sativa
caggaggaaaaatcatgactatcttgtttgccgtgttgaccggtgcatcgtaagtttcagcaaatcctccactgttgatatcaaaatacatgctgtttagtgcactacaataatgaacccccaatctattcatgtattatttggattgatggaaatataacaagaaatttatatatattacctcaaaatcaagaaggctggttagcatgcaattttagaagtgcaaatggcagttttgttcatttctcaggtgttttttagaaaacttctcaggatttcaagatgattttcagaattaccttaaattattttcaatattttcttgattactatttacaaaaagacaatgctaattgccaatgcatgaaagtaacttgtttcttgtaaacagaatggaatgaacttaaagtttgatggtcaagtcaattgcttgactatacataatccctaggccctattaccattttaggcagacataccaattgctaaggagtagttattaattccagttagtaaaaggggatcatgaactgagatataga

SEQ ID NO: 15922 - DNA, 242 bp, Oryza sativa
cagtaacacagggacatttctatgtggacaagttaatcctacttgacaaaccttgggaagcctaaaccaacagggttttcctcgtcgagtttgtgagttatccattatatcatcaagaaccagaaaataggcctgaagctgcaggttactcaaagaacaaaaaagtttagaaaatattttgctaatattgttgtttcataatcccaggtcactaaatcatacaagtatcatgtacccattcg

SEQ ID NO: 15923 - DNA, 2793 bp, Oryza sativa
actgtttctttcatgaaagtgtagagctatggtaatatctgtttggtaaattatccagatgcttgagaatgctggtttccatgatgtcattgctgaagaccgcaccgatcaggtaatccccctctggagctacactggctgcattcccatattctcttcaactgaaatgtagatatgattttctgtggtactgatcatattcaatcttgtattgcagttcctcgatgttctagagagggagcttgctaaagttgaaaagaacaaaaacgagttcgtctctgatttcagccaggtaatttaggcaaaactgcgagtttagtagctgccttctttccatgttgctggtatgcacatcaaattctttgtttcacttattttcaggaggactacgacgccattgtgaatggatggaaggcaaaacttcaaaggagttctgctggtgagcagaggtgggggctgttcatcgcgaccaagtgatgaatcaagatgcgcagcgtgggggggactcgcaaataaattggtttcatgccgtgtgtccatcatattacatttttgttgtcaagttatttaatttcgaattcggtgtacttcttgtggagcttttgatgttgttgggacaaaaaacaaaaataaccagagttcagcccgcgttgttttcgacttcttgagctggaaagttcagttgcataaagaaaattcaggtgtactcggtgtgaaacttttgatgttgtttggatataaacaaaaaccaaagttcggcccccattgttttcgacttgttgtagagctggaaagttcagttccttaaagcaaaagcgttatccgtgggcaattgcagaacagcaagccggaataactagcggcgtgaagtcctcgcacttcatgcatctcccgtcgcaggctcgcagcttcccgcgttagtttctacagggaccgggagggaagccgaaaccgcaaaacgagccaacgacgccacatccgtttctcacgagccaagtagtcaaccaggaacgggtccagatcccccacgcgcaatgcgcaaagggcgtggacgtggcggagagagacgagaggcaggtagctgaaaggaagtagcggcaaccggcagggcaacacgggtggcatggacgatgacttcagtcttcagagtttggccaagacacagactctcttcctctacaaggctgcccctacctgcctgtctgccttgcctgtaccgctgtacgcgcgtgatggcgccatgtgcattgctgcatcttctcctctacaaccatcgccgcattcctgcattttctctttttagagaatgctagacaggcgggcttccggagttttagagaatgctaatcagctccctttttctttagaaaaaaaaataatcagctgcttttatctcaggtgcagactccagaggtcctactggctactgctggcgtggggatgcacagttctcaccgcggtaaacgacgaacttggtaaacgaacttgcaccgtccttggatttgttcctccctgcaacgtttgtcttctcttttgatttgtaaaccaaagattcgagagggactgtggtgatatatattcttctttcttacgatggcagatgatgccgttccaaccgtccacatgccattgatttttagcgtcgaatggacagtgtggtcttgaaggtaaacgccaacattggttctgtgtggtataaaagtgacccaagggctgcacacatacacaaaaaataatgacatcaagaaagaaaacaagtggcaaagctccacattatcatgctcaaaaccaatgataattttcgatggtcatcggtgaaactaaaaggttccattaggacacagaaaattttacaaaaagaatcatagaatatagttaatttcttaagtactacttaatacaaaattccactaaatttactcagttgaaaggagccaaaactaccacccgtcttaaaatggaggtacctaatacaatatatgagatatcatctgatactatcaatcactatagcttatccatagtactatatgagccatattgtaacttgtctaaattcatagtattggatatgtattacagtattaggtagctatatagcaaaacaaaggtagtacttaatactccctccgtccaaaaaaaaacaaatttagaactgaagtgaaatctggataaagatatatctaaatttatggtataaggatttattacatttagcactaggtatttttttaacagagggagagggagtactctgtattttagcctagaggcagtaacaccttgcccttaacggaagttccgtcataactgacgctgatcccgcctgtcccacctgtccaccacgccgcgaaatcgcgaatcccccaccggcccgagccacgactggccagccactttgcacgcccgtgccgcgcctcgcctcgcctctgtgcgaccggcccccgcacccacccgcgcacgacgcagacgccgcgcgcgtcacgaggcccaaaaatcgcaccaaaagctacgggaaaacacaacaccaccaccaccaccgcccccccacgttttcgtttctccgccgccgcggcgatcacaaggagatctcccctctctctctctctctctctctctctctctctctctcctcgcgctcgcttttaaatgccaccgaggcccacggtgtgggctggtccaccggacgccgcgcccgcgcaagacgccgacgatgccggcgggccgaagggggtcggcgtcggcggggtcggtgctggccctcacgggggccggacgccgcgccgcgcgggc

SEQ ID NO: 15924 - DNA, 4672 bp, Oryza sativa
ttgtagacaggtaagagtaaaaagatcatctgaaatcttgcaagttcatgtttgttcctataggctacatgccatatttcaatttttatttctcaaaattagtatgttgatattttccagttttgttgacaagaccgagaagcgttacaatccaagcatgtctcctgttatcctaaaggacaaatggaggaaaggatcacaggtttctgtaatttcttgccattcttgttcttgtaatcagtatttcatttttattcagagttttacactgaaccatctatcctctcatttcagtgggtagcattgaccagaagacatgcagaagtagtcgttggcgacaaacttgtcttgcaagtattcagaaggcattgcaaggtatattgccttttgagtttattcttttcgacattggagtacttgcttagcttgatttagtccttttcaatccttcacatgttaacccatttcaagaaaattagttattaaccaggttactagtctgttccaagtatccttttcaatttccctcaaatttctgctgtaaatgttagaacctttgtgacttgaacttcaacttgtttagcaaacatgttagtaggtatgtggcttgcttatatgggatgtgaatgtgagactagttttctgttcccttgtttgtagatatttgatgccttacagtgttaaataatcaaatgatactatctaatcaattaagaacgatagtatcctagtgctctgctgcctcgatggcaatgctttgtctgtatatatatgctattttttaggggaaaaaaatgccaaccaagttgcagcataattgtctgagaaaagttccatcaaatctatatatgttcagttcagtcaaaaaaaaaaatctatatatgttcagaatgggggttttgtgctatacatttacattttatcagcaatactttttctgatagcctatatcatccagctacataattactgcatgataagaatatatatatttatcttagccaattgtttgttccttgtagaattgtccttatgcacaatgcgaactgattatgttctcattagattaatccaacttctaaaagttgtgtaaaactgaaaaaaaaatgaatggagttaaattgttcttatgctgaattaagacaactgttcgtatttattttggtccattaatcctacatattcttctatatgtagcactaacgattctattgaatttgacctgattgttgcagatggtagtaactaaggctttgcttggacagaagcctaattatgtaagtgtttagtttaatttggattccttttcagtctagtttgaagagaggatcattttaacatacattggctaatatcatgtataataacaatcattgactttgtcttccaattcttaagtgacaccatttctttaccgtaggtataaacaacttttcatatgtaatactatccttcgctcaatgataactaaagcgagtttttattctgctgtctgacatgtagttttatatgatgtgaatacgaatagtcttttttgttttctcttgatcaccaaaatcaaatgatttatctcatttttacacccttctaaggaatgtttcattatgtacccaatagtactgttgttccctgaattaattatatttatcaatacctacgattgttgcacttattaagtattatgcttctcttgcagcgaagattaggatttggacttcgtcgaaagcagatatcggtaaagtttcaaccggtcacattctcttttatctattctcaagatgtcaagcacgcattcagatggaactttcatatatttatttgacaaatggaagttcagattgtcaaacttgttcatatgtttgcatatgaaatgctaccgtcaatttcaagctgttgctcacatcacaaaagtttcttgcaattgagctcttcactgagacatgatatccatgctaaaccttgcagaaaggatctactcgaatggagcatgattgcattccagatgaacactatgtgcagacattattttcagtaaggcttgttattgttgatattgatttgcagactgcaggacataatcgtatgttcttcacaacaattcataatgtttcccattcttttaactttgtagatcaatggacatgaaaatgaactggaaagaagaactttgacatatacatcatggaaccagtcctcagatcctaaagacaaaatgacttggcatccaatgacatttgagtatgagtcagcaagtcctgagcaaatcaattcaattaaggtaatatctgtggattttgttttgtcatctttttttttctttttcagttggcttgtgaatgataaaaaagctctagtgttctatctcacttgtttgcctcacaacctgtccatctcgtaggaaattcaatttagatagtgtaatcaattctccttgttttgtcctgaataaagaactaatctactcagaaacatgtatctgcatagcagaggtcctttccagtttgcgaactccaacctttgttacaaggaatgtgtttccatgtttatgttgactggtttccctgtctatactacctgatgttaaattctattcctaagaataaagtcagacaccgcatcctgtagtgcaggacctctaccttctatggcacgttattctgttaattgattctcacttaaagtttgctgcattttacagggtattgatcatgtgaattatcagatggagcacagaactgagtggtgccaatgcaatactacatccgttccatgtttcctatttgccaggaagttctcctacagtgcagccatgcatctattagaggctgggacggtcggtccactaaaatctgctctactggcttaactattactacaaaattttgatcacacgagttctcatttttagtttatcatggccggccatagtttatagtccatcagcatcattaggttcagtagcatctgcagctgaatctgcggagcgaccggagtaccatagtgtattattattgatagtgttcagatttgtgcatagaccactgggacagaagaggtttgatgtacagagcatcagttttggagcttgtcagctcggctacattgcaatatccaacgacagaatgaggcaggatcagatcaggtatcttgtgacgaagaatgaagaatgctcaacccttctcccgatggtatttactaattacaggataggaaagctgtaacaatatcttgataaatgatcatatacacattaacaaatttaataaagtacaaagaaaatattttttgttattccatttttccgcaagagaaaaacatcccagcaatttatctgttacaagtttaatctcatagtattatgcaacttatgcaagcagggaatagatgtaatcgccgaataaaaattgaaaatatacctttttatttaatattttatgtttatatatatgcatgggaatgatttgtaaaaatatacctctcccgcatgatgggaacgtgggaccgttacaaacacgcgacatagcttcggttccgcaggtcggaagcgcggaatagggtcgatcgcgctgccctgtcacgcgggagcgtggtggagaacgcggtcccgcgtaaccatggcgcggcaccggctgcttagcagaggaagctagcttgcgcagctgcttagctatatatattatttgctttgatttgctttgattaaggccagtgtgattaattaggttaattaagtaattggtgccgcaccactggcatgcgggagcgctggtctgcgccggtgccgcgggatggttctgcggtaccgctcgtcggtgccgcactatggttccgcgggaccgcggttccgcgcatccgtcccgcgggatcgaagccgtgccgcgctgaacgatctgaccgcgtattgatgctgtgattacatagcgatcccgcgttaacactgtgcggaagaggtatatttttacaaattattcctatgcatgtatataaatgcaaatatttaaaaagaaaatatattctcaaatttttttctgtaatcgccaagctgttcagcacactggtcatgttgtgcaatacgaaatatcctgctagccatatgatccatggaacatataatgagaaactatttttcttatttatcaggcacgttcctcgttgcaaagtcccagaagttagaaacctatcacacctatgctatacatcccaacaagaagccaagaaccagaataatccacgagatgccaaaattggccttatttttcagccgtgttctacttgctcctcttgtagatcttgtgcagaaaagatttcagaaccgctcgtactgcttcattcggttgtgcttcgatggctgagatcagcttttcatagctctccctttcatactcagaaaacacccgctgaaagatttaaaaaaaaatcaggtatgataaatgaatttgtcatggcaggaaagcacgcggcaactgcagaaagaaatgagtaaacagatacagatcacagcattttttgggtaagcgtctcggttgcatataatatcaaggcttcattgcatctttttgtaaaaagtcgaacattcaaaatcaaggattgaaggctgaaacttggctggattataccatcttaagaaaaaaaagacatattttcaacattgaacgaccaaatggaaaacaaa

SEQ ID NO: 15925 - DNA, 1939 bp, Oryza sativa
  unsure (1)..(1939): unsure at all n locations
catcagcgcgctcaagtgcttgaacaaatagccaagaacacttgaaatcttcaatgtcacttcctatctgtggtaagattgcttggggatcaagtccaaagaacatttgatagtgtactatgaaacttgtgatagtactgcaggagtgtacttaccttgccaataatttctggttcaccaaaacagtccagataatcatcctggaaagaaaaccttactagcgatactgatatgaatgaaaacagaaaaaccaagaagagaagcattcaagtggaaaagagaacgaaacatcaagatgatcttacctggctttgaaagtaaacacccatctcaactaggatatgcttcacttgagcataattgtccaaactctcatcaaacaacagcagtgcgcatgcaaccttgtaaggttgaaaaagttttgcttgtgaataccaaacaaaaacaaccacaaaactcaacctcactacgacatgtgcacaagcatttttccacaagatgaattacaagaagttgtttctaggactatcaagtttcattctgagctatatgtacccctgtttgtgaggaaccatgctcatgagtcatgagtcatggtacagcgaaagctgatcatttgaattagatttctaagtttactttgattagccacatattggaacagtgtaagtattcatgaaaagtataaaacatttccccaaggggcagcaaaagcggaaacattttctcagtttgaagaaatcgacgagcaacagcctgaattgatgctataaaagtttcaaaatattatatgggagtcattcatttttaccggcaaataaaatgaatagtaagctgtcttatattccacaatgcgcctatatctgcataaaattcaaaaatgattattatcaagcaagaagagtaaaaatgaaactgacaaacaactgccttctagggcactaagcaagcagtatgtcagtatgacaccatggagaaattcgtaattcagtggcatacacatgtacattatacttgttcagatctttccttccttcatttgttgtaatttgatctaataactggcctgaagttgtctgaatttcaacctagggaggaagcaacaaaattatgcttcagtaatgaaattggttctcaaataagagaaatcctaagaatgtaaaactacctcattgaataaatctaggagatcaacatagtaactttttccacgaaaatagcgcctaaagatccttgaaatttggctgcgaaggacgagtccatcatttatagctatgaggccgacctgctcaaggtagaaaatatgagctaaatcaccatttaaccaagacaaggaaaggactcaaattgtaaacagcattaatctacatatctatatcattccttgcatcttatgctagttactagataatcaagctaataccatgatcaaacctatccctagtgtggagctgccccttgctatttagccaacagtagcatctgagaacaatattatcatccgttattatttttaccttttcctttgtttagttggagtacaatcataacattttaacaacactcgagaatctacagtaacacaaggacatttctatgtggacaagttaatcctacttgacaaaccttgggaagcctaaaccaacagggttttcctcgtcgagtttgtgagttatccattatatcatcaagaaccagaaaataggcctgaagctgcaggttactcaaagaacaaaaaagtttagaaaatattttgctaatattgttgtttcataatcccaggtcactaaatcatacaagtatcatgtacccattcgatgccccaaccaaggatgcatgcaagaaacaattcctcctcgctcggttctgttgcgctagcagctttnnnnnnnnnnnnnnnnnnnnnnnnnnnnnnnnnnnnnnnnnnnnnnnnnnnnnn

SEQ ID NO: 15926 - DNA, 4838 bp, Oryza sativa
  unsure (1)..(4838): unsure at all n locations
ccacggttcaattttcctgtacaagagcagagatcttaaatgactaaatcacttgccaaccatatcgcaatgtgccattgtttggtttggtcgcattgtttctgaatagcatgtttttctcaccaccaagcacgttgtagtccagcatctgttcagagataaggttcagtgattttttttttcagctaaacattgacaaattgcatttaatacccaaaaaaaaaaacaatgaagaagttgcaacttgcagatcgtaccaaagctaaagagacaaaaaacatcaaatatttcatgtattgtagtttatctaattaaggacagtgccccccaaaaaaaaagaaaaaaaaacttgaggagttacgagttgcactgacgctctcgagccattggatggcgtcgtcgttgaagtcgaaggaggggtccttgagaagctctgccttgagtgtgccgtacacccgccggaacgtcgcggccgctgtctccgccgccggtccgctcgcccccgcacccgcggcggccatagaccccagacccccactccgccgcgccgacccgcgtccgcgtgcggcaggcagagcagacgagcggcgaaggaccgaggagcagcgtgcggcccagccgtcccgatggcgacgacgagacggggcaggcggcttccgttgcgttgcgtccggtgtgcgtgcgtggcgcgcgcgcgcgcggcccaatcgatctcgcgcggtgggggtcgtgacgtatacgtcgtgtcgcgttgcgtcgagaaatttgctgcggtttctccgattcgtcacgccgtgcgcgcgccaacgtgccgtgcgtgcgtgcgtgggtggactggagcgagcgacaccggcggccgcgctctcgtggggtcgtcgacgacgtcgttggcggcgtcgtcgttctcgacgcctcgcgatcagacggcgacgtggtctgtccccgcctgaaaggactgtctgtctcgaccccggcgggaaaaatcgcccgcgtctccaccactactttccctgcgcgggatccagaggcggtgaaggaccgcaaggatttcagacttcagaactatacctgcactgcactaccatcagagttacggcgtttcagcgtgcgtatgtttcaatcttcagatgaaaatgggaagcagattcagccaaagaccatgaatttgatgggtaatcacaatagatcagcaggatgaaattgtctgttctggagtgtggcttaggcaattcaattcagagtttcagagttctgactattcaagcaattctgactcgtatacaaaagtagtacctctctagccctgggaagtggcaaaaggacttaaaaaaggaggataaatagaggtaaaaatgcaattgcactcttgcagtaaggttggcctggttaaggccctgtttcttttagcttgggattattataatctagattattgagtcagattactataatctagattgttataatctgtagtagaataagtggttagttgtttctttcctagattattagagcctagattattgggtttgcaagtctaaagagggagtggggtggcatgatgggtaatttttcacccaataatctagaaaaagctcacctaaatgagcttatcagattataataagctatcttttagcttactcctaataatctggattataataatcctaagctaaaagaaacagggcctaagtttgctcatccgaggtgaagtgcgatgagtaccgctgcgccaatccgcagaagccaagcgttcctcccgtatggatcatcaccactttggttctactgtctccaacacatagatccacagcttgctcccaaccagctaaggtgtacattggatccaacaggataccagtttgctgcgcaatctggcggcataatgcaatttcaccgttcagcaccttgccaaatctgaacaaaaaaaaaaaggccccaagaaaaatcagtattcgaacgcaaattctaaagattctaatagcaagaactaaaggcatgagaaggacataattattcaccaaaacaaataataatcagaacatcaagtccacttcaaccgccgactataatattaccaagaaaattactagatactaataaggaaactagtacttagtaaatgaacaccctcaaattacaaaatcatgaatacgtccagaatgttctgtaatttatagtgacatgccttgaaaatgacccaagacaacattgtattgcagaaacacttgagaaagcagcatgtattgaataaaatgaatgctcagtaaaatgcagcatattaaattaattgattgaagcataccgtcttggtgaaaatcgttccacccattcaactaaactgtcaccaatatcattttctcccaccatttcatggtagttgttatggcaaagcttcttaaagtcagatattaaggacttctctcgttctttatatctttcgagtgtgtcagcaagcatgacagcagttactctccaatgcaatctgcaaggatcgtgagaaaaactgtgatctctagcaaagatggatggagaaagcaacaacatagacatggaaatactaggtgatgaacattttgattgacacgatttttaattagtattgcttgaccaagttaaaatgcaccacatttgtcatcagagacattaatttatcccaatttttctttgatagatcaagtgcaagaactgttctcattgttgtgctttagatattccaaaagtatctccaacaacaaagcctttatataaaagaaatggaaaatcatgatacctgtaataccattagaaactctcaaaagttcaaagtgtacaaaagctgtaatgataactctcaatttattctggcagcataatatgcaagtagtattaacaaacgcaccctagacataccgctccaagagctaaccccacagctgttgtgcctgtcccagcatctaccacgacatgaacattctcatgtttatgaaatgacgacagattgtaaaggtactccactagccgaataacacctgaaggtacaacaaagccatgtgaaatatgcaagattcccttttctttggggcccaagttaaaggtttcagattaacaagtgaataagaaaacaacatactgtgaaagcaaaattgactgccctgatcctaatactcaaagtgaaaattttcaacctataagcaaatatagcaatacaaggacacatgcattctaagttatgggtattagattattctgttgtcgaaaatttatttttactgatgaacggaactaaaatcaggagttcagggcaaaaacagtccattacttacctagcaatgcttggacgtcaccagccccttccttaataataactactcttctcgaaccaatttcacaaccattatcttcatctaaaacaaaatcctctttgctaatatcatcagcccacaacactgtaccacctgtgcctgcaacttttctggcgtgattgtaaagcatttcatctctgtgtgcgtacactgaccgagaggcataagccacattgccaaacatcaaagagataagattgtagcctgtcgggatatctggctgttcacctctcagcaatatgtgtggcctcattccccactcagcacagtggaccgctaatgcagtaaatgaaaaaaaaaaagtgaatgctatgagcaaagcaacattttcgttggactcaaccgaattcaagaaagaaaagcagcacattcactatatcagcgcgctaatcaagggacaaatctgcatgacctagagagcaattttgcagggatgcattgggatcgtttaccaaggcttataaggtcatagctcatgtaaagaatgaactggaaattacacacagattcaagtggaatgaagaaaaacaaaatgggtaatccatatctcaccagtggccgcagcatgggcgctctggcaacccccacaagtcacctgcaatccgaagtccagaacagtgaagataccatcagatttgaaaaacaagatgtgatcaaggctgggtgaaggggaatgcaacggtgagcacggacaacgtcagtagcgccgcggcggcgcaggagcggcaggagggcgtcgagcttgcgggccttgttgccattggcgagcgggtggaggagatcgtcgcgcaccacctcgaaccttgggcggccctcctcttcccccttgcctccgttgcgcttaggcgcggtggtgaggttggagaacgcgaagtggtgaggaggggacggcggtgagtgggaggggaggacggagatggtgtggacttgggtggccggagaaggaagcatccactccgtggcggagagaagatttgcgaccgtcctgccgccgccggcgagcgccggcgatggccgcatgaggagatgggcagatggcggccggggacgggtcacgtaaagtcaaagtacgccttcatgaagcgttggcggagaacatggagtgttggtacgtgagacattacggtcctgattgggtgttgttcggagtagcaactactaattgataaccagtttacgagaatttggagaagctaaaaaataactcttagtttcttttttaaaaaaattctgtaaatatatttctcaagatctggatgaaggttttgattataagaagctcgctaaatatgtctgatatattggtatctcaggtctcacgatacaccatattttttttcttttcggtgagtggataaactagaaaatttggaaaccattctcttagacatacaactacaagtctacaaaccatggagctaactagggatgaaaacggttggaaaaaccctatnnnnnnnnnnnnnnnnnnnnnnnnnnnnnnnnnnnnnn

SEQ ID NO: 15927 - DNA, 735 bp, Oryza sativa
atggtgtggacttgggtggccggagaaggaagcatccactccgtggcggagagaagatttgcgaccgtcctgccgccgccggcgagcgccggcgatggccgcatgaggagatgggcagatggcggccggggacgggtcacgtaaagtcaaagtacgccttcatgaagcgttggcggagaacatggagtgttggtacgtgagacattacggtcctgattgggtgttgttcggagtagcaactactaattgataaccagtttacgagaatttggagaagctaaaaaataactcttagtttcttttttaaaaaaattctgtaaatatatttctcaagatctggatgaaggttttgattataagaagctcgctaaatatgtctgatatattggtatctcaggtctcacgatacaccatattttttttcttttcggtgagtggataaactagaaaatttggaaaccattctcttagacatacaactacaagtctacaaaccatggagctaactagggatgaaaacggttggaaaaaccctataccgttttcattttctttttttttcttgaaaacgaaatcggaacggtagacccggaaatggtaacgatatcggtaatattggtatatcggaaacgggatcatcggaacggaatataccgatattggtcgaaactcgaaagtcaaaaattcatgtcgaaattagcggagtgtggcatagcacacatttaactatgcacg

SEQ ID NO: 15928 - DNA, 1108 bp, Oryza sativa
ccccttccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgtccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgttgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcaccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaatctagc

SEQ ID NO: 15929 - DNA, 1365 bp, Oryza sativa
  unsure (1)..(1365): unsure at all n locations
nnnnnnnnnnnnnnnnnnnnnnnnnnnnnnnnnnnnnnnnnnnnnnnnnnnnnnncactatgtgtatccttcattggaaaaaagctctcaaagaaggtggcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtttagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaataatggcacttagaacctttgacaatggaaaacttacgaattaaacacatgctggaaagcccgagaccatcaagcccaaaattaatatgacataaacgtgaatgccaaccattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagat

SEQ ID NO: 15930 - DNA, 1290 bp, Oryza sativa
aattcgagctcggtaccctgcacttgttggagagagtggtagcggaaagtccacagcaatcgctttgctagagcgattctacaatcccgagtcaggaaccatcttgttggatgaagtagaaatcaagaacttaaaggtcaattggttgagggatcagatggggttggtcggccaagagcctgtgctctttaatgacacaatccgtgctaacatagcctacgggaagcatggggatgtcactgaggaggagctcatcaaagctgcaaaggcatccaatgcacatgagttcatatcgagccttccccaaggatatgataccaccgtgggggagagaggggtgcagctatctggtggccagaaacagcgggtggctattgcgagggccatattgaaagatccaaagatactacttctagatgaggcaacgagtgccttggatgctgaatctgagcgcattgtgcaggatgcgttagataatgtgatggttggcaggactacgattattgtggcgcaccgcctctcgacgatcaaaggtgctgatatcattgcagttctgaaggatggtgcgatagcggagaaaggaaggcatgaggcattgatgaacatcaaagatggtgtctatgcttcacttgtgaactccgttcaggctcatcataatactcaggataagatttttgttttttatttaccctctctggggatgtaatatatcttccttgacccttttttgttttacaattgagggttgtagtagtattaattatttggattttaaagtgggatttgagaaggtgctctctgtatgtatctacgcggtgtcggtttattaagcaacgagaaagaaatattgtcctacagatgctgatatgtgggattgtccatgttcgatgtgcatgactgcaaatgagctcatttttgtgctgtacgtttatacctatgtgggtatcccaagattaccgtatatgatatgtaaattctgcacatacattttcatatgcagcaattcaaatgctctacctatgtcattatcgggaattaattaaccagatggggagaagcaaaacataccatgataccgacgcaactgaagatcgtgtttgttgccgttggaggatcagtgaggcacacgcacgcgccgggatccataccgccaacggggccaccgcgcgagcagagcggagatctcgacgaatcccccccgtacagcaagcccagccacggccgccggcgaccctccccgagttccgaaggccgttcgccgccacccgaacaaccgcgtggtcccgtggg

SEQ ID NO: 15931 - DNA, 1527 bp, Oryza sativa
  unsure (1)..(1527): unsure at all n locations
tgcatgcctgctggtcgatgttgtccgggaatcccagtggcgaaatacatagcgactgtgccactgccactgccagccgggcgccggccacacccgccagccgtctgggatctacggtggttatggtcgcgagagctcgatccagcggctttcgacggtagactgtagagagatcgattggtgtcaaactgtcaataatgaagcagtggagcgctggatccttgtgtctcactcagtcattaatttggtctaaagatttccaaactgtcaataatgttctgggtcgccaagaacatcaaaatgtcgtgtatgcgacgattagtctcgcttggaaagacttggacggacaacgggtcgatggaaacaataggacgcaaggcacgatcaaagaagtttcttctcgatcgaattaacgcagagcctacttgaggacgagaagatcatgatgtcgtcgtggatatataccttaccatggatacaaactgcgtccaatacttgacgtcaacacgttaagtccgcagtcttaccgcactaaccaccaaattaagtggaaattaatttgcaagctgagaacgatgccacggactaactgtatcgtgccaaactatcaaacgactcacgttatactacaatgttttggaaactgttttcattccatgggaagatatccagtcttttttacatatcatttaaacagttatcatttttttaaaaaaaatgacaagattcttactataaaacatataccgctccacaaacttgcaaactaaaatttaatttctataaattgtataaaaaatatactaactacgaatatacgttaattattttcagtttatttcatgttttttacaatttgtagaaattgatttcagttttgtatattcatggagtgatatattttatattaatctgtatatgttgttaattttttaaatttaataactatttagaagacatggaagaaataaaaatccatgccccaatgtttatataaacgatcgaactccattcgtccagatcacctcatgcataacacattacatgcatttgcaagccatacgctctctgtaatatggataccaaattgggagcgcttgctctcatgctcccgcttctactgctgatttccgctactcgcgtagcctacggcggcatccaacccacgccgcctcccgcgagcttccaagccgccttggtccgcatcgagcccgcaggcatcaactacacgcgcgccgtgcagcgctcccgctcccgcctgtccatgctcgccgccagagcggtgtccaacgcgggggcggcgccgggggagagcgcgcagacgccgctgaagaaggggagcggcgactacgccatgtcgttcggcatcggcacgccggcgacggggctgtcgggcgaggcggacaccgggagcgacctcatctggaccaagtgcggcgcctgcgcgcggtgctcgccggggggcttcccgttctactaccccaccagctccagcttcgncgggttcgtcgcgtgcggggaccgcac

SEQ ID NO: 15932 - DNA, 2048 bp, Oryza sativa
atatactattataaaaattaaagatgtttccgtcagactttcgacacgtcatccatgttagaatcggttttaattttatgtttgtgttaagtcctatctctttttcttacgccaaagtgtctatcttatctaagacgtgcgcgatttaattgggccccgcaccttttcacgcgtccattgccgcacgcaacaattgggcccgtgcccgggcctgtttttcacacgcgtctttgcgtgccatggcgattgggcccgcaacacccttgcgcccacgattttgtcgtttctgcatgtccgattgggactgcgtcaccctcgcccgcgatttaaaaattgaagatgtttttgccgaaactatagtacgtcatctgtttccgattcccgtcacgtgtaacattcattgcgaagtcacgactcgcgagcgaactacgagagagagtccgtgtggatatcatgtacgtcattgtcctaattatccgattctattcgtattacacggcacgtataatatgttagcatgatttcaagtcagtctccacacatgctcgtatgtactaccagggccgttacaacgatccataagaatacaacgatccataagaatcagttttactttcgaaaataacatcctaactaaaataaaggataatcgaagttgcagattccgtctgccattgattctctgccggacttgagataaagctacgcgataaatcgagctcgtgttttgaggcctcattgtttggcttatgcttattcctagccaaattttaaattttagaacttaattttaaaattaacttttgatttttttatcgtactttattttatagcatttgcttttgagtcactaagaacatgcatataaaagatttgcacacaaataggagatggattctaatctctcgggtggacgtccacccgtttcttgcatgccacctaaatgattataaaaaaattttccaaaaataattataatataggttaatatgtaatgtatcatatcacaaatatgtaagttcaaattcgacttctataagttgtaacagaaataacaaattaaactctaactagtatacacatattcacagtccaatttgttatttttgttacgacttgtagaagtcgaatttgaacgcatgtttgtgagatgatatattacatattaatctatcataataatttttttaaaaaaaattataactatttagatgttatgcaagaaacgggtccacccgagtgtttaaagcaatttcccccacacaaataatctttttttttagtaagtgattcgaataagcacatgaataaacgaaataatgggctttgattatttatccaccgatacatatgtacaaattaaattggttctagccattgcaacgcacaggcatctttttagttactctaaaaaaatacaagttaaaatccaacttttataagttgcaacaaaactaaatttaaccttgcaacatgtaaaagttcaaaattgaccttgcatgtgttatgaagtgatctatcacatattaatctatctagttaatttttaaaaaatatttttacaatcatttaagtaacatgcaaataattaaggtcatctgttttgacaagatgagggcatgtttggggggcttctgacagctgcaacacttcctggaatcaaaagctctctcacaaatagtctagcttttcgtccaaattctgaaaagctagttgtcgaatttaaagaaatgagctagaatttagaaggaaagaaacacatattttttagattttcaaaaattagataccaaccagtaacttatcaaaatcttttaactccaatttagtcatggacactagtgggccttgcaggctgcaggtgccgattgtacgtacagtactacttggaataagttcatctaaggtcccttaatttgtcaacgaatccgattttcgtccttcaaccaaaaaaccaattacaattggtccctcaactatcaaaaccagtgcagatgaggtccctcagcggtttggatggtggttttggctgacgtggcgtcttcgta

SEQ ID NO: 15933 - DNA, 2378 bp, Oryza sativa
ctgtggaattgggacttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactcttgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccattcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcctggcagggcaaggcaagcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcgggcaataaggtttttggaaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacactgctgaggtactggcgtactactctggcgacatgtaccagagcgtgccgactagctgcgtccgcgacggcggcgccgcggccgacttgctgaggcccaagtcgcagatcctgacgcggccatcgacggcgccgacgaggacgttgcccggcttgatgtcgccgtggatgaccccctggcccctgcgcgtgcagttgcttcacgccggcgagcagctgcttcacgccgacgtagtccatgacgaggtggagcttgctggtctccgggtggcaagtcatctcgcggagcctcacgattgcggggttcccggtgcacgccacgagca

SEQ ID NO: 15934 - DNA, 4791 bp, Oryza sativa
ccactatttttacttttgtccgactgacttgcgggccccatgtttttgtttttattttaaagttttatattttgcttctagtgccacatcatcgctacgtaagacgaggaccaactcaaactagccacgtcagcgccacatcagccaaaaccaccatcgaaaccgctgagggacctgctttgcaccggttttaatagttgagggacctgttatatctgttttctgatcgaaggacctaatcgaattcgttgacaagttaagggatctcaagtgaacttattccgtactactttgggggcaggcgagacaaaccgttccagaggcccatcgttgactcgtggtaggcttgggactaggccaggtcaagtgccgcacatggcccagagcccagacgaaccatgagtcgcgcgtgaatgttttttttaattttcaatttattttattaaaatatttaaaaataatttttggttttaaaattttacaaatctacagcccaacgctttctgagagggcgtttttaagaaaacaccccttctaaagagcgttttatgtcatggcacatatccgttgactcatggtaacgtggaggacacaccattttgcaggtagcctcctccctgcccttgccttatcagctctgagcccgagatcagtcaagccggcatgacccgacttacacgccaggctgagccgggctcgccacaggatgcactaacggcccatgcatgacccaataagattcgggccgtgctgagtcggtccgaaggcacagaagcccaccgaactcctccttggaataagtatattttttatccctcacctttctgggccatttccaaatggttagaataagtctatttttcattcctcatccctcatcttgtttgtgtcatgggccgggccgtcggttggccatctatacttgtcgggatagatcagtagctcatgtggctgtctgaaaccatgagaccggaattgatgggcatcaaagataagctttcacggtagagctcgataaatcgtgcgcttcgacctcggaagacactcagaaagctagcaatcaatcacagatgaaactgaaatcatacgtttgtctactgctctttttaccccaagagcaaggaaaacaattacggtgtactcaagacagcatatagtacgaaactgaaatcacccaaagtcccagtcatgaacgacccatctctgtggtggcccaactcggtggttacgtgcgtcactttaatctccacccaacaacacagcccaccacctcattcaatcatccttcaatcatttcccacgtcatgcgctggccgcttccctccacgactccaccagccgcgccaacgtcacctccgactcgccgccgtcgcgcagcgccgccttcgcccgccgcatggccgccagcgtccgctccaggagcgccctcccgccgtcggactccatcagccaccgcaccttcgccgccacctcctccgccttcacggtcccctccccgacgtcgtcgtcgtacccttccaccgccacggccagccgcatctccttctccaggaacaccctgttcatccgctgctccgcgtacagcggccacgccagcatcggcacgccggccacgatcgactccagcaccgagttccacccgcagtgcgtcacgaagccgcccaccgccgcgtgcgccagcacgtcgcgctgcggcgcccacgacttgacgacgagccccctgcccttggtccgctccaggaaccccttggggaggagcgcgtccaggtcgggctccggcggcttgtcgaacttcttcgccgggtcgtcgctcggcgggctccgcaccacccacaggaaccgctgcccgctcgccttcagccccgccgccaccttcttgatctgctccgcgctgaacaggccgatgctgccgaagcagaggaacaccacgctgccgttgggctgcgtgtccagccacgccaggcactcctcgctccggttctcgcccacctccgccgactttatcagcgggccgatgcagtagacgggcggcgtcgagacgcccggaggcgcgcagctccccgcggcaatggtctcgacggcccgcggctcgagcgagcggaatgtgttgacgaggaagccctgggtgcggcagaggtcggcggacgctttcagaaattccgcgtaggccgggtcgtcgcgttccatgagcggcaggacggagtgcgtcgccgggaacgaggggatgccgggggcgtgcacgagctcttcgcccatctccccgaagttcgccgtggtctgagcgtgcaggaccgggaggtacaagaagaaagccaggatctcggcgccggaagtgtagaacatgtaggcggggacacccagctcgtcggcgacgtcgagggcggcgttgcagaagaagtcgatgatgaggacgaccggggaggcgccggcgaggaagtcgcggaggccggggttggagaggcgggtgacctcgaaggtgagcgactcgtggtgcttggacgccactggcggcacctccaccttcggcagacggtggaacgtcatggccgggttggccgcggtgacgccggcgaggaaaggccccgtcgcgccggtgttgccgtacggtgggtcgacgacgacgacggtgacggcgaggccgcgggcggcgaacaccttgccgagctcgatcatggagaccaggtggcccatgcccggcgacgggtagagcacgaccggcttccgggccctcgtggtggctgcgtcgccggcgtccatcagtccgtgacggatcgagcactcgagcaggtatagaatctcggatgcgtcgagacgagtggagatgggagcgacgacgaacgaacacgtaaatagaggcgcgacgaacggttgctgcgtcacgagtcactactccaacccccgtggtccagtggtagtggtccagtggtgagtggtgaccggtgagtggagacaggatttataccgccgcgatgacgagacacagactgaaaggacacaacccccatttccgggaaaacccccacaacccccatttttggctacaggtattttaggtgtcacgccaaaattataagtttaattgaaattaaaacgatatgttggaaaaattagaagtttatgtgtgtagaaaagttttgaggtgtgtttaagccgtgtttagttcccccaaattcccaactttccatcacatcacatcacatataaaacttttctacacacaaaactaccaactttcttccaattttaaaacttttccaccatcaaatacagccttagttcacgctaaaattggaattttggttgaaattgtgacggaaaagtttgaagtttatgtgtaggaaagttttgatgtgatggaaaagttggaagtttgaagaaaaattttataactaaacacggccttgatgtgatggaaaagttagaagtttgaagaaaatttttggaactatgtgtttagttcacgctaaaatttaaagttttattaaaattggaacaatgtgataaaaaagttgaaaattttaagaaaaaacgagcatggtggcccgcgcagattgcacggccagcatcattatattttctcttatataatagcatatatgttttttcaatgtattattcaaatatattaaaatgacaacataattttaaattttatactaactttacgaaactactaatatgtaatattcatgttgtattttataaatgtattagttgttaattatttttaatatcaaattttagttatttgtaaattatatttctatatggactctagtctcgtctttcaatatttctttttctaattccgaattttcgttatctgtaaattgtatttctatatagactctaggctcttcttacaatattatttattttttaatctgaattttttattatttataattgtatttctatgtggactctaaacttatctttcaatattctttaatttttaatttcgaatatcagttacttttaaattgtattcctatactgactttagtttcttcttcccatgtttttttaatttcgaattttagttatctgtaaactatatttttatacaaactttaaactttacttttaattttatgtttattctgaattttagttagttttaaattcctatatagactctatactctatttctaatatttcttatgtttaattctgaatatctattatttcttaattgtatttctatatagactctagtctcctcttctaatattccttattttttaattccgaatttcaactatttctaaattgtatttctatatggactctgtttttctttttctccaattaatataagaatttctaagccgtgagagcgaacgtggatgttactttttctattcttttaataagttaatagattgggaactaaacaaggcctaaactcggccttactctactccatccggaacccattgataatccaccagaactgctcgccgaaaatacagacggaaaaaactactgttgtcgttaagactggtcacgtacagcggccaacaaacatgacactgccttgaagtcaggaaaatgaaaaacgcctataagtccttccctcgttgcgccagctcagattttcaccgatgtgaagcgggcgaccgcgctttgctaggtttctcgcttcctatgtgagcgacgcagaacctcgccaaaacgaggacgcgcagcgaggagaagacgagggtcgcgcacgctgtggacagcgtagcctcgtgctcgtgtgccctagcgcccaaaatccccttccgccacagcaatatccccta

SEQ ID NO: 15935 - DNA, 6182 bp, Oryza sativa
  unsure (1)..(6182): unsure at all n locations
tgggaaggaggagtagaagggggccggcgcggctaagagaaagagaaggggcgaggtcgcgagaaagagaagggtaggtgaggaattaatttccttcacctgcccgtgtcccccgtgcgctagggtacgctcactatgggctttgtacccttcaacaatagctttatcttattaggtcactcaataaggtacttatattgtgagcttgagtgactttggaccattttcttaggttaagtctctcattacgtgccttacaatatcaataccttaaggtggtgggctatacgatctaagtttaaaatcttatcccttataattatttgtattaggttatttcctaatattcttgtttttttaagtaaggaagacacattcgaatcgggtagttggatcgaaggattgtcggcttgtcgcaatgtcatcgattacgaatggaaccacgtcacccgttcacatgtttctcccgaacctgcatgacaaattaaatactagtaggttataaccaacgccgagtttatatactggagtactactccatgcatggttgatggctgatgtcattgctaccgtatgtgtgtgcatgtactctctcatctcaaaatataaagcatttttagtatagtgataatttaaataatttaaactttaactattaatagcaaaaatataaaaagcatcaatcacataaatttgatattaatagatttatccttaaacaaactatcataatatgcatatcttttttatttaaaacatattaattttatagatattattgattaaagtagtatctcgaagattgtatcaggtaaaaaaatacttatatattttgaggcgggtgagtatataattcgtgttatgcatggccacatgggcatatataggagtataatcctagggggtctgtgttatgcgatggcaatgatacggcaccgtgccgatagccaaacttaagatcttcttttgatttcattcgctatttcacatgatttctatcattttcatacttggtattgccaaaatacccctttggttggttaaatcaagatgagctggtcgttagattctaatatattgacgtgtaattttttttcgcgttcgtgaaagctggttgttagattggcgcacgttaaggcccaaagtgatcgaagcggccgatgaatccgatccataaggaaaaagtacacagaaggtccctcaacttgtcatcgggataaaaaaacgtcctcgaaccgcaaaactagatatgcggagtcccttaactatacaatgccggtcacccgaggtcatttgatggttttgaccccggttttgatctacgtggcggctaagtcagtgtggtacccacataggccccacatgtcaggtgtccacgtcaccctctctctttcccctctctttctctgtttctctccttcctctcactctttgctctcgcactcgcagggcatggggatgccggcgctagggcgcccatggcagcgcgcgcggccggaggatggtgcggccggtgacgggggctcctagggcggcgcgagcttcccccaggtgacgcacaggctcagggagggagcaccgagaaccaatccccactacaagaatcctgttaatccatgatgaaaaatatccgtcacggatcactagaaaaccatcactaaacagcatctgtgatggtttaagaaatcatcacggattgagagtcatggattgacatgcgtgacggtttgtcgaaaaccatcacagagtactagaatcagtgttttaaaccgtcacaatattgcccaaggcctagttagtccaccccaagcccatttctgtgacgaaaataaccgtcacggatgaattgccacatcatcatagatgcttacatggttgcttacatggatgatgacgtggacactacctcagcccatttgttaacaggccagaatcaaagatgggccaattttggcccaatttcagccattttcgcagcaattttccagccatttttgcaagcccatttcagcatattgcagcccaaattcgtcactaatttttagcccactcttcagcccactactgcagcacatatagcccatatacacagcccattgttaaacattcagcccacacacacagcccacaaggaattaatgtagcagcacattaaataaaaaaaatcttatgtttccatccaacaacatatcacatgaattttcatccagcatcacattacacaagtcttcatccaacaacagttaccatacaaaagtgcacacaaccttatagtttaccatggcacaagccaataacacagactcaagaaatgcatacaagtccagcagcttgattcatgcagcatgcagcagcagcaaaatgcaagtagcagcaacaaaatatataccaccatgtatgacttaacctggtcgaaattgacttcacacaagttagcagcagcaaaatgcatgtagttataggcaaaagatatgcaccatgcatgtcttaacttggtcgaatttgactgagcaaaagattaagttttgcttccatctcagattgactcctcttcatctcctctcggtctttaatccttgcctgctcagattcttgcactttgtttgacaaatcagccacctgtgcacgaagctcagcattggccctttttctccgcttctagttctgtctcagtgctctgcttcactgaatcctaagcctggggcattaattgaaagcccaaatttctgcaaagaaaccggaattttttgggggttttaacaaggcccctcagcaacaactggaagccgcttgaactttaaagttcttaaccttctggggttgtagataggcttgtttttcattcttgagtctaagcaggaaagtagcaaaaccatggttgatgtttgagagaattaaaaataagcactacaaagatcaaagtctgaaaattatcttacaatagcctcctgtacaactggggtgtagcattttttttttcttgctgtagtggaactccttgaataaatcaaatgcattaggttcttcatcattgtatttgtcatcctgagaacaacatatatgcattaggtccagcatgaattaagatgttacaaaaatctggacagctactgttcaactgaaaatctaaaagaacatgttcaactaatttctagcctcattcgttgcacacagtcactatgttttccacttagacaaacaactgcaacagaggtctttcactgcatacacatagacataaaaacaataacttttaatctattaacacactcaacttagatatagatggaaacctaactcgtcacctgtcacacaatcatgtattggcataatgtagggcggcggtgctgcagatctacaggatggcgttgtagggcggcggtggtgcctgatgtcgttggtcggctggtgtgcagcggtgatgcgcgatggcgcggcaagcaaggaggcggcgttgctgaactacgcggcagtggtgggcagcggcaacgccgctcctgccaaatttcgccgtgggcggcggcggcggtgtctcagattggtcgcggctggatgtcgaacattacggttggtctgtttggttgttgcctaacattggcataactcaatttgttataggtgtggcatggcaaacaaattgtggcctgttggccacaagtgtggcaatgtttggctagaaaatgagtatatgacatgtaggcccatgaaacaagaaagtatggcttgccataactgaaacaagcaaccaaacactaagctaacaatctgtggcatgcctaacatgtggtgtggcaatgtgtggcatcaaaccaaacaacccctgaggggttgaggtaaccttactcctccgtacatacacagaccaaaattagtacagaatcctacaataacacatcaaaccaactatcgcagtggtaggacggggtgccttctactggcaggtcatgggttcgattctcgttgggcgcattttgtacttctattttaccaattcgagttcttttttcctttttttttgaacggaaaaaacagcacagtagtgctttttcattgaatatagaaggagaaaatacaacccctaggggtaaaacaaaaagatctttagactatacactatacagagtgcgggatgagctcgcgcaatcttttagccccagctaaagcccacaagctggcctcctctttgatttttgctaggagaacacctgttgccatctctttgtgatcaaagattcgccggtttcgctccttccaaatttcccaaactactagcaggataagggaccgaaggcccttctttggaatgccgggtgtattagctaggctctcccaccactgatggactgaccgggcttcctcccattgggccggttccaactgctgatatcccgcccatgtagcaacgaggcgccagattctcttcgtgtatctacacatggcgacgaggtgcaaggctgtctcggtgtcacaacgacatagggggcaatgtccgttattccgccagccccttgtcgcgagtcggtccgacgtccagactctattttgaatgatgagccaggcatgaaatttacatttccctggcgcccaaactttccagattagggagttgaagtttgtgtttggcgcccccaaacattgggcatgataagccgagaaagctgtatagtggccgctgcttgtgaatttccaaacaatctgatccggctcctcgctgtctaagtgcacattccgtaccgcctcccacagccggactagctgatcgaggaggttgattgtgatagatgaacccgcatcgagggtcaggtcatgcacccaggagtcgtcttctttcccttgccgtagggatttcttcctatttttggagatctcatagaccaacggcattaggtcttttggtcttcggccattaatccatgcggagtcccagaagcgcgtcgtattcccatcgcccacagttatctttgttgaggcggcgaagaggtccctatccacaccatcacaaggcgtttccaaacccacccaaggcttgcttggatctctccattcgttccacaaccatcgcaatctcagagctcttgtaaatttctccaagcttaggacaccaaggtccccctggctggtcggcaagcatgtctttgcctagttgaccttgcatttccccccggtgatatcccccgtaccagcccaaaggaagcgacgtctctgcttgtcaagctgctccagggattccttcatcaccttcaaggcagtgaggagataaattggctgtgctgaaagcacagactttacaagcgtggttctcccggctgctgccatgtttttccccctccaacttgcaattctccctgatattttgtcgaagaccggttgcaagtccgtttttcgcagtcttcccagaacaagcgggaggcccaagtattttagtgggaaatttgctcgcctcgccggaacgccttggaggacctcttccaggtctatattgccgcatcttatggccgcaacctgggatttctgaaggttggtgacgagtcctgtggctgtgccaaaacgatgtaggatgttcgcggaagtcgcaacatcgttctaggtgggattaatgaagatcacagcatcatccgcatacattgagatccgcagccgagttgttcttcctcgtaattttgaaattgcacccaactctgttgccttggaaaggatacgctgtagaggatcaatcgccaagatgaagagaagcggcgagagggggtccccttgccgtagtcctcttccatgtttgatccgttgccctggcgagccattaaggaggacttgggatgtcgaagacgacagtaaagcccctagccagtctatccatcttgtcgggaagcccttgcgctgcagcaaggccagtaggtaatcccatcacacggagtcgaaggcttttgttatatccaacttgaagagcaacattgcccgtcttaggcggtggtatcttctgatcatgtttcttacgaagaggtagttgtcatgaatacttctcccctttatgaaagcgctttgattgaccgagatcaactcatgcatgtggggccttaaccgcagctctagcatcttagcgaagatcttggcgatgctatgaattagactannnnnnnnnnnnnnnnnnnnnnnnnnnnnnnnnnnnnnnnnnnnnnnnnnnnnnn

SEQ ID NO: 15936 - DNA, 778 bp, Oryza sativa
  unsure (1)..(778): unsure at all n locations
nnnnnnnnnnnnnnnnnnnnnnnnnnnnnnnnnnnnnnnnnnnnnnnnnnnnnnnnncaactcatgcatgtggggccttaaccgcagctctagcatcttagcgaagatcttggcgatgctatgaattagactaattggcctatagtccgaaacgctttcagccccatccttttttgggattaggacgatgtttgctgagttgagcaaattcaggtgcgcacatctcaggttatagatggagctgaagactagcagaatgtcatccttgatgatttcccagcaaactttgaagaaggccccagtgaagccgtctggtcccggtgctttgtcggctggcatttccttaattgccctatgcacctcctcctcagtgaagggttcccccagcgtggctagatcaatcggtgtgatgtccaacgtctcccagtttagctcttttggcctcggccccggcctccctatgaagcttgcgaagtgatcatggatcgtcaattccttttcaccgtgcgtcaccgcccaaccactgtcctttttcaatctttggattgtattccttctccttcgcgcattaaccctgaggtggaagaacttcgtgttcgcatctccttcacggatgtgagttaccctggaggcttgctttttccttgccctttctatagaagcgagtcctaggactttccgcttgagagccgccctcagtcgcgtttccgggggggagagttctctgtgctcttgtgccacgtcgagtctttggatgacattgagtgccatatggaat

SEQ ID NO: 15937 - DNA, 772 bp, Oryza sativa
  unsure (1)..(772): unsure at all n locations
gcatcatcagtcatttccaagttgacgcccccccttgtggcaacgggagagctcaacaccgggcgttgggctaatgccggcgaggtgacccgcgggggcggcgagtcaatctgcgggaatggctctcccacaggggggtcggtcgccgcagccgccagctcaatccgcaggagcgcctcctctacttgttggcaagtagtcgtcgaggtaggcggcggcagcgccgacttgatgcgcgcgaaggcgtgttcgaccgggatcggctcccaggccgcgttctggaaccaggcttcaatcctcggtttggctgggcgacccgagagggctggcgtggcagccttgtctgcgatgatggagagccgctgcagttggctcaccggcgacaacgcgttcgtctggggttcctgatacaagaagctggagttgtgcagtgcgtggagcaaacgaaattcacctacctctgcctggttcgcggatttgtgtagaaggggaatgttcatcagtttgctcgagtcgtagaccggatcagccgtgcgccgcgtgccgccgccgctacggttggcgcctcccctgtcccggcgacgcggggagcgcgtgcgctcacggcggtagtcgttgtcgcttccccgcctatcatcccggccacggtcgagatcccggcctcggtcatcacgatcatcatcgcggtcattgcggcgccagggtctcgggtggtcattgccagacccccgacgacgaccacgcccgccgngccccgccctgatcgcgggca

SEQ ID NO: 15938 - DNA, 1292 bp, Oryza sativa
  unsure (1)..(1292): unsure at all n locations
nnnnnnnnnnnnnnnnnnnnnnnnnnnnnnnnnnnnnnnnnnnnnnnnnnnnnnnnatgtgatggaaaagttagaagtttgaagaaatattttgcaactaaacacggccttctaacttttctatcacatcaaaactttcctacacacacaaactttcaacttttccgtcacatcgtttcaatttcaactaaactttcaattttagcgtgaactaaacataccctagaatgtttactgatgccaatctagctatccaataaaggctgtgtttatttcacactaaaattagaagtttggatcaaattgagacgatgtgacggaaaagttagaagtttgtgtgtgtaggaaagttttgatgtgatgaaaaagttaaaagtttgaagaaaaagtttggaactgaacaaggcctaaacacggcgaaagacaagtaattctttcaaaatttgttctcctttccctcgagtccaccggaggtccggactagtatactaaagagttcattcatccattgcaatggccaatggcaatatggcatgcaaacggttttagttgtgtagtatggtaatttacttttttttatatggactagttatacaatgttattaggtggcttatggactatttttatattatatcgtggatgtcttaaaggataactaatttagaatggagggagtaaagttgatcaatgatccctatgcatgaaaaaacaaagcggaaaaagagcagtacactactccagtcagcacaagcattccagcgagcaaacgtagggtgtgcttggtttgctaccatgttaaaatattggtactatcaaaacctagacaagttttggtagtgccaagatttcggtaactttttatgtgctattagtagcaaaccaaacactattaaaatactgttcaaaatgccaaacaatttgataaggcatattttagcttcaaaccaaaatggccgtactatcactccgatcaatgcatttgtagcacaactgtgcagaacacttgcagcagggtgcaggcgttcagctcaccacgtttcacggacaccatcactccgatcaatatactccatcagtgccgggaggtcagctggacaggttatgaagggctgttttggatttgcccatattttggtagcttgaatatttggagccaactaatttggttatgcccatattaaatttggtagtaatccggaatattcttcactatagtatcacaattcggctctagttggaagtaaaccaaacatgagtacatgacattataaacttatggtagtgccaaaat

SEQ ID NO: 15939 - DNA, 3358 bp, Oryza sativa
  unsure (1)..(3358): unsure at all n locations
gactctcacgtagcttgaacatccaaacgcatcacttttgggggcccccgcgtcgctcccagggcaggggcgacacgggaggcgactcagccgctgccgcagcaccacccctcgatgccctccttccgcctcgccaccgcccgagcgggctgacggaaaccgtgcggccgcaaggacggcggcggcggggcctactgccccaaggtcgcggcgttagccttagccctgacctatcttcggggcggcgacagcggcgctgggcgacggcaaggcggcggaggcgcttggcgacggcgagcgcaaacgacatggcgaggcggcgctgctggatccggcgtctgctgcgcggatctggcgcgagggttgccccnagcccgcngcggcccgcgcgggggcggcgggttgccagatccggcccccttctggtcggatcccgagcaagaagccgagccctgaccccaagccggaaggcggctggtgccgctgtgcaaaaccggccaggccaaggctgggcgccgccgtaccgaggcgaaggcggcatggcttggccgtgcggagacggtggtgcagctgtgcggaagcggaggcgcaggcgctgaggtggaggcgcgggaacgagccggctggtgcggcgctggcgggaggaggagcgtcggctggctagccggccggccggcagcggcggaggcagcgcgtgtacgaggtgcgactggcgagagcagaggccagtgaggctcggccggtggcagcggaggcggccgtggtgcgtggaggtgcggtcgcggtgctggtgcagcgcgacgaggctgcccggcgtggaggcagtggctggtgcggcgggaggagaggccagtggcccggtgaggcgcgaccggtggcaacgcgcagagactggccaacggggggcgccggtgcagtggtgcctacgctccggcggaggttttggatggcggtggagcaatggtacatgtgtggtagatcgacaggtggtggacggcgggtgaaaacctagcccggccttggccggacaggtaacgatgacgttcgagtgtcattcccctcctgagggcgttgtcgtgccgtcttgcccctcaaggatggttgccgagcgaaagctcggtctcggctctctttgagaccttgacggatggcggtggcggtgttccgtcgcttctctcgttggagatgtcgtctaggcatccccttgccgaaaccccccgagcaattggtgcaagcacactctagattctcaccctcttgtggcggcgtcctaatttctacaagttggccacgtcggagggcctaggggggagaggtgttccatcttctctcacaccctctctccttgaatcctgaagtcttggatagagttggctttgtgttgattgtatgggtcgggttttgggtgatctcggcagtgttctgttgttgacctagcggcggtcggtcacgcttagcggcggctggtccggtgctagccttctcctggatctgtgtgttggcactgtcggtgtgtgggtggtggtataattttcttttttcctggttacgaccttccaaggttgaaatcttgtaattttttttcactctatcaatataacttcgcaccgtctagtgcgagtcgttcaaaaaaaaaaacttatccagaacagacagaaaaaaccattttacccacgagcttgactctcttaaccaaaatccacccgcaacagattgtagcagaaacatggcgtggcaaaggtttaaacagaacacacaacacattgctgcaatcagattctagaaaattcgtgaatggattaatcatgccatccaagaaggcaagaatttataatagatccagcaaatgaattggcagggggagatcgaaacaagatcggcttggatatctctgaacagaacaaggttttcgcatcagaaatcaccttgtctcaactgtcaaaatcagaaggggagggtgaaacaacaagacgagcaaaaaagcaaacgaaaaagctaatctcccgatccatctacgctgctcaccaccggaaagccaaggaacaacacgaacgcggcgccgtcgcgcgcgcgcgcgacgtcgaaagatcaggcccacccggtagcactcgaagaagccgcacatcgccagagcgaggatcctcgcgaggctcctggacacgggcacgccgcgcctcgactcggcgtacgccaccacggccgcggatccgggcgtaaccgagaggagcacggcggggatgaggcgcgcggcgcgcgtgacgaagacgtaggcccggatcatgaggagcgtgcagaccacctggtccagctgatggcggcgctcccggaggagaagcgaagaggccctgatatcgtcgtggatcctctcgagggtgacccgggcggcgtgccgctgctccacgccgtccacgatcatgggcggcgacgccgtgacctcgcgcaccaggcggcggacgttcctgagccgagcccgcgccttggcgaggtgggcggcgttgtcgtcgaggtcggcgcgcgcggcgtcgagcaggatcttgacgtcgtcgacgttgttgatgaggtaaacgccgaggctgtcgagcagctcgtcggccaagttgttcacctccattgctgtgcgtgggttcttgcgcttttggcgtggttcagtgttcttctcatcttctggccttttctgttctgggggatgctttttggactaaaacatgggtggtctgtgggccagacttgtcatggtgtacaatagcttcgtggtagactgggatgttagattagctcacactgctaatccgcaatcaacactagtccataggagagaaaactgacatgattatggctctggtgaatttcaaatttcagatatcaaacatttttttcttgcggaatggatcaggaaaaattcgggtcacatttcactcccacacatcgacagcgcgagcgaaagtagcgacacaccagtacaccggtagcaaaaattaacgtgacataatcccagatgtcactcgctcgcccaaccgaagctgtaacagtgggggatgatctggaatgcgtcagtaactcagtatccaaacagccagaacagcggcggcagtatcgtgatcctcgcgtaggtcaccgcgcgtcatctcgtcgactcgtcctcgtcgtcaaccccttcgagctcggggcggccgaacacctccgactccacgtcattctcaatcgcaacagctttgcagcttcacatccctttgcagctttgcagagataaccatccaaatcaaccagaaacaggttgaagcagaaacacagagaggcaaaatgcttaaacagcatatacaatgcatcgctgcaaccaaattctaaaagaaaaacatga

SEQ ID NO: 15940 - DNA, 737 bp, Oryza sativa
agacaagtctagtggacttttaagtcttgtacccttctcaccaagggcatcttggatcagtacggtatctgcagatattctagaagcagcttctccagttgtcatctccacatcaaagaatgcaatgtcttgtgtgataatcgcttcgaggtacaaggatcgaatgcatgccgactgcctttctccagccattgtccaacatgacacctctggaataggtagatggagcactcatgagattctgtcatatgtgaatgtacaacccaactaaacagaaattttgttgcattgttaacatgtccaattgttccagaaaatttgtaaatagaaaattactggtaaatttgctttctaattgtggcaaatgtaattaattaatctgttgtctcatgaagtaatagaccaaaacctcttaatatcattttgctgatctgactatgaagttcaggaatggtaacaagtagtaaaactatgacattaaaatagccaaacattcaacaactttagaaaccatttttatactcttggtgtgtggatcgctatgttactcttgctagtgatcttaaataatttctacggagttgatggtttaagggcatgtacaatggttgataggggtatttttcttttggaagttcaactaaaaacaacttaaaattcaacatataggcatatgcaagagacataaaatatgacaactaatgtcactcgtttgtactttgtgctcataatatagt

SEQ ID NO: 15941 - DNA, 221 bp, Oryza sativa
atatatgactctaccattaaacttaggacattaaatccactggcttataaatcatataagccaataagctgacttaaaagtttaggccaataagcctaagcctaaacaaagagggtattatacaacttgcttttataaactactagtattaagttttttaaaaaaatatttaatttttcataatttatagagataatccacgacaataattcggggcatga

SEQ ID NO: 15942 - DNA, 971 bp, Oryza sativa
cttccctcttatccaattaagcctcaagctcttgatgttaatcccatcaatcaaaacctcaccagcctgtggatcatagaatctttcgacaagactaataacagtggacttgccgcttccactctccccaactatagccattgtcgtgccactagaaacatgcaatgaaaatccatcaaatatcagttgctcaggccttgctgggtagctgaagtacacatccttcaattccacatcacccctgatgtcctccaactgtttcccagttatgtcatcaggatcaatctgtggttttctcttgattgttttgaacaatctataagctgcagattgcccttctgcaaaggctgccatacatggggtcgcattccctaaagacctgccacaaggaaatggaaatttttacctccattcgttaaaattaaaatatcataataaattaagaactcacattgccccagtcatgacagcaaacaagatatttatgatgtctcctcctgagtatcctttgctgactaccaacttgccgccataccatatagctaaaccatagctggagaaaaatatgaagaaaacggagcccatgccaaaaccgttcgtaagtccttcctcaacagctgccttgtatgccttgtttatgagtttattgtacgatgcaacagcctgcttttcaccgttgaaggaaacaacctgttttcagataggaaccacacaaaactggtgagttcatgccatttcagatggaggtagagggagtgaaattattctaacaaatgaacttacagtttttatggctccaattgtctgttcaacaacattcgctgcatcgctatatgatgcttgacccttgctagagatttttgctagcatcttcgatacagctccaccagcaatgacaacaggagggatgcaggccaacatgacaagggatagaagccaacctttcacaaatgctacaacgaaaccaccgg

SEQ ID NO: 15943 - DNA, 6842 bp, Oryza sativa
tgaacttgagagaaggtgattaccttctcaccaatggcatcctgaactaacacagtgtcaccggacattcttgaaactatctgcccagttgtcatttctacatcaaagaatgctatatcctgtctcaggacagatttgaggtatagagatcgaatgcgtgtcgcctgccgttctccagtcattgtccagcacgccacctctgcacagacatcaaattggcattggttatttacagtgatgtgagcgccatatgccttgaacatgtagaattatgtttcattttttctaatcagtttagtttgctaaatcaaaagtagtagtaccgttttttaatgtgcagtttgacatatgcttattcattttccactttcgaaagggaaaagtaaaacatgtgtgctctgtatctcctattcaatagtaagaggataggtttaacaggaatattcgattcacaatcttaaaaattatgtgagtgaccttttgtggactgtgatagcattaataaagagaattgtttgaactttgaactcatattaccaaaagtcaaactttgactctgcattgatggcagcgtgcaggtttgaaacgccaatattggcaaaaggatgatatggagtagtagtattagataagttgccagcttgctaagcatatgctctcaccgttctcttaatcatgactaatttactaatgataatccataactagcagcaacagttgacgcatgtgcagtgtgccaagtgcatacacataccaacagaacagtaaattctattacttacgaagaaatgaaacaaccgctgtcgcgatgcccaggtagacaaagttgagaaccgcctagagaaattgaaagaaaatgacaccaaagtgaaaagtgtattcatgtcatcactacctttaataacgtgtaaccgtaaaggtaacgaattcataatgcactaggagtagttaactgcaagctgaatgttaatggaaagaagttttctgtaatatgacacactggcggtgataaaaaacggcgaaccgacaaatttgacagtgtgtatcatcaccactcattcaaaaaagattaaaaaatataacgtgtcgatctctgacctcttgataggaaaaagattccaaccattacattgattgatactctgttatcctatatgacatttctttactggaaatgggaaggactttgatccttcttgctccaaaaaaaaaattgatactctgttaactcttctgttgtctcttgttggaatattaacttattattacaagttgcaatcatttggcataacatatttactttattgaacaattactacaaaaacatagctaactgaaagctgcacactgtaaagtttgccggtataaaagccagctcccaggtgaacgagaaacaagctacaataccactgaatattttgggagaaaaataaacaaattcattatccttaataaatagacgtgagaatctttaaaaaaaagaagagagagattgagagaagaaatatagaaaagtactatcccagaaaataaaatgcaacaatatttagttgaaaaaagaatatcgcggtacgagaggctgtttggtttaagttccatagatcgaagaattatcccaacttgtcggaagaattgattccacaagcgaatactctctttttttcctttctcaagaagcaaagcaaaggaaagaaatgagtcgagaagacgactgaaaaaaaaaaaccccgaaggcaaaatcgacgaggagttaataccgccaaaagtcaagatacgagcacatcgttctccgagctccaaaacatcaacaaatttcaccggagctttctcaagatcaaacccacatctaaaaagacaaagaccgcaaaatgaatgaaatgaaagggagtggaattgattgaattggccaaagctcgatcgagcacgccgctaatccacggcgcgcgtttccttccacatcgacggcgagaggattaatcgaccggaaagttagccgcgcgcggatcacggccggacgggcggcgctagctgtggcggggaggcaggcaggctcacctggttgacgcggtggaggacgtcgccgttggtggcctcgccgaaggcgttgatgacctggccgaagatgacggtcatgagcggctgcgacaccccgttggcgagcgccgccaccgtgccgaccgccatcagcagcaggtccgtgccgtcggcgtaccggaacagccccgtgaacgacaccttcttcccggcgtcgccgtcctcctccttcttcttgtcctcgccgtccctgccgttcttcgccttcttctccttgccatccctgccgccgttcgccgccgcgtccattgctggcagctttactgtgtgtacaagatagatacgcccggctcgatcgcctcggcctgcggcgccggattcttgagtcgtagctcgcggctcaacgcctcaaccctttcgcgggtatttattgggttggccacatacacacaccgccgcacgcagggagagatgagacggagaggagggtttggacgacgaatagaaaatatcactgcgccagctatttccaaatggtctatggagaaaatgttcggaaggatcattacaaaaaaaatggggacaaaaaggtgtagtcctgtgcttttttttttgggaagcgtttttgtttctttgtacttacattttttttatataggcgaaggtcatagatgcatgttactccactaagatggggtatgaaaattcagaagggagttatgtggatgattaatatatgatacagctggtagtagtatatattgcttagagctggctagaacagggatttcctctagatgctattgtagtggaaagagttttttttttgtgaggaataagtgaagatcgtagcctaataaggtattatagatgttgatcatgttattctacaaatttagttaaactttaattgtatatttgtcctaaaatacgaatgattacattgacaaattcacttgtgttttggaatatatgcagtcagtttaattaggacaaattaatacttcgtatgtcccattttaaatgcagccatgattttccgtgcacaactttaaatgcctgtcttatttgaaaaatttttgaaaaaaattaaaaacataagtaacgaataaaatattattcatgttttatcatctcataacaataaaaatactaattgtaaaaaaatttcaaataagacggacgatcaaagttgagcgtgaaaacttatgtttgcacttaaaatgggacggaggagtataaaacacatgccttttatattggcatactccttctatcacaaaataaattagtttttcttatgaatctagacaagttctaatctagacattaagatttgatttattttagatgaagggtgtagatgtcatcggttagaacaacttgtatccatggcttcactcaaatacttgagcttagttctaatgtgcaagttgctttagcttttcaccgtcacttaaaacaagacgagggatagggtataattaattaagtattttttattataaatgaataaaatagatttatttaatttttaaagaaattttcactataaaaaaagtgatatgagacgtcgattaatataaaaccggcacatgtgatctttctccccatccttctaatctctcatatgagtctaaactaaaatcggcacttacaacacattattggtgttgtttaataaaaaaccgccaaatataagtttcagtgcatgttttttcaatcacacaatttaactggtacctatgaaatagccaccggtgcgttttttttattaaactgacacatatcgagaaaacaacgttgagccgaacggggtggaagaaataatccgctgagctcgagcctctctcccattccacatgtcccatgtttattattttacttcgatctactctccgtctctttcccacaccctccatatcctctctgtctctataccaccgccacccgcagcccctcctactcccctctccaccgctgcggcatcgtggcatcctccccctcaacggtggtgactccggcgggctgctctgctagctgggacaacgatggctcccatgggcagatctgtcggtggcgacggcggagactgtgcagatccataggctgcggcggcggtggctcccgcgctcggatttgtcagttgcaacgacgatggctcccgtggccggatccattggttcagatgacgacaagcatgggctcccatgagcggatccggcgatgtctcccgcagatggatccagtggcgtcgatggctctcgcacatggaggcagcaatggcaacctcggcgccccaatgagcgatggcggcaggcggagttctcgtctgcagtgagtgactgcacctcctttgatttggtttttgatgaatgcttgattctataatgtgcaattgttgatggatatccggttgaaatttttgtgatttgtgctatgtgattttgtgcaggggatgttgttgttagatggattgatgggtgatttgtgttttgtgatttgaaggatgttgttggataaatcgatggtggtatgggggtgatagggagcaacttaatttaagccgatgcatcgagccagcgttttttttttccgcattcgtggaacctcaaaggtgctagtttctaaactgaactttggttactcctcatcagtgccatttgaggggtttcggttgggaaatccaatacctatgtgatgttcgcaatcagcacctattaggttttagtgtgtgataactgatatacaaaataaaaaagaaacatctattaggttttagtgtgtgataactgatatacaaaataaaaaagaaacatcgtaaaactattactctctccatttcaaaatataatatttttcattggatgagatacatcttaggtagtgttcttttctcctaaaggtgaagatgaagattaagtttttttacgcaaaacgaggtggtattaacgtatgattgattgagttttaattattacaaagctgaaaatagattgatatgatattttagagcaacttttatatagaaagttttcgcacgaaatacaccgtttagcagtttgaaaagcgtgccacgaaaatattaatcttcatccaacacttgttagtactacgaatctagacatattgcctgtctaaattcatagtattagcatgtatcccatccaacagtggcggatccagaaaattgattcgttggtgtcataacgtgtctatctgtgtctagtatactaattatgcttagattatggtgttataatgtatgaataaaattgattcgttggtgtcataacgtgtctatctgtgtcatagtatactaattatgcttagattatggtgttataatgtatgaataagtagttttgctataggtttttgtaacgacccgcctctcccaggccgggctaaattcatagtattagcatgtatctgtgtctagtatactaattatgcttagattatggtgttataatgtatgaataaaattgattcgttggtgtcataacgtgtcaatctgtgtcatagtatactaattatgcttagattatggtgttataatgtatgaataagtagttttgctataggtttttgtaacgacccgcctctcccaggccgggcccacttacatctggcagctttcattggtcataaactaccctcacagaccaacacatgtcttttctgcacactttgtcctcactcgtgtgcacccgggaagaatttcctggtcggtcacccatcccaaattgctccaggccaagcacgcttaaccctggagttctttggagattggcttccggaaaagaagttgtaacttgttgatatattaatcctattaagccctaggccgggatgttacagttttgccaaaagtcatcggtgtcgcctgacacaggcccttataatgtagatccgtccctgccatctaaccaaaacttttttatattctaagacggatggagtattgtataagctcattcacataagcataagaatctaaggtcaaccctggtgggtggcgggctgctggcctccactgccacgtcattggggtttttcttcaccatatatgaaatcaccgttctggcaacggggttcggaaacgctgttcggcgatcgatcgccttagggatggggcagcgatccgatcccctcccccctccctccctccacccctccacctggtttacttttttggcaccgcattacttttctattttagtaaatttatacacctaaagtttatacacctcaagtttacacatctaaagtttagagaccaaaagtttataagtcaaaagtttatatatccgatttaaatttgaattcaaatatttttttatatatagtatttctatacatctaaagtttatacacctaaagtttataagtcaaaagtttatatacccatttcaaatttgaatttgaattatatctgattcaaatttgaattttgaatttgaattcaaatattttctatatatagtatttctatacatctaaagtttatacacctaaagttttaaagtttatagatccaaagtttataagtcaaaagtttacatacccgattcaaatttgaatttgaattatatctgattcaaatttgaatttgaattcaaatattttccatatatagtattcctatacatctaaagtttataagtcaaaagtttacatacccgattcaaatttgaattcaaattttttatatatagtatttctatacataaaattttctaacttttatttttttaaaaaaaattgtgtgtactgtggtagaaagagaagaaggggaagaggaa

SEQ ID NO: 15944 - DNA, 6021 bp, Oryza sativa
aaatttgaatttgaattatatctgattcaaatttgaatttgaattcaaatattttccatatatagtattcctatacatctaaagtttataagtcaaaagtttacatacccgattcaaatttgaattcaaattttttatatatagtatttctatacataaaattttctaacttttatttttttaaaaaaaattgtgtgtactgtggtagaaagagaagaagggggaagaggaagggggagaagagggaggagtatagggggaggggggcaaaccgattgctggcgatcgcccatgagcctccccaacgtaattggggttatttaggttttatatccgtcgtcttcctgaccccgcggataaaaggggccaggggttcgtactattagccgtgctcctttcatattaccagcaacatctcgtggcagcctatcaggttaattagctgcacacgacgtcaggggtgacgtacgcgtccgttggagaaagtccagtcaatcgcgccgatcgggaagggaacctctcgcgatcgagttgtatatgtacgtgatgtcaacgaggagagttgttaatgtcagcgaggagatttgttaactactgcaaaaagttttcgcggacgatgttttacgcacgttggtggccagccgcttttctggtctacgcgggtctccctagctgctccctcgctaggacacttttcgtgctaaaataaatatattttttaccatctcgctaatatgaaaccggaaaaacaaaaatacctttattttattaataataaatcataatataactattttaatttatttacttccaatataattattctctacttttataaactctaatttaaaagaacactttaaaaataaacttattacagcgcggaggggtgcatagggagtatgacctcagatggtgggacagcgggtcgcgaatagccggtagacaagacaagagaaaacctgtgatgatacacaccacgacgtgtgtggtgtcgtgtcgatggaccgtagttagattcgacccgctaccgtggaggggtaaccggatgagtgctattaacttgaaaagttagctacttcatccgtgttataatatagtaatttagaatttaataggatacattctaattataagactataaatcggatagaacttctgtctaaatttatagtttaggatgtgttatattcgattctaggttgctatatccacatcagattaattagaatacacgattcggttactatagatggtttgatcggtaaccattgtggtatttatattgtctgccttttttgttacagcacatgacgacctaccagtaattaacagagagctatgtacaaacacgctacgcgcgcgaccgagactgctgacactgtatttaattattaatctggacgctcgggagagttatggacatttcgaatcctattttagttgatgcacactaatttctaaaactcagtatgtaagtatactacactatcatacactagtaattattatataaagtattttaaatcacatgcaagtgtgccacatcattacctaatagcaattattatctaaagtattttaaatatcatgcaaatataatatatcatttacaaatttgttgtatttttaaaactcaatatgtaatcaatgtcaaataattatctccatattattttcatgttatttaagtatgtacatatatcattaatataatgtataatatatattcatccacgtatctcgtaggaaagcacgatgtatcatctagtcagtgagaagccaatcgccagctattatcgatcgatgtcaagctgtgaacccgcgtctacagaggcaagcagagatagcggccgcacaccattaattctgtatattcgcacgttcgtaggcccacgatctcaatcagagtaggacggcttacccgtacttacctaattgccgatatggtgatatatatggtccgtccattctacttaatcaaatccacgttattatatgcattaggctgtgtttagtttcacgctaaaattagatatttaaataaattagaacgatgtaacgaaaaagttaaaagtttgtataggtagaaaagttcgatgtgaaaaaaaaattgaaagtttgaagaaaaaaattggaatctaaatatagccttaaacttttgtgtttccatgcctggccatggcttagcatggatgtagtatatatcaacctaattaataatcaatagttccacattcccacgcacttaatcagtactatagtagaaacgctcgtcaaatttaacagaaaacatgattgcacgtaagcggtattttcaatttttctttaaaaaaacttagcgagtttgtataatctctaccatctaccgtcaatttcttggacacttatccagttgtatatatgcatgtgcaaatcagtcgcacttctgtcaaaaaaaaaaaacctaaaagggatgtgatcttttttagaacaacgaatttaaacaaaaggctatctaaattcattgtactaagagatatcacatcctcggctaggttatgtttttttaacggagggagtatggtcttgtggacagaagcgcctttattatgataatgaaattatgggtgtataacttaatataaatatactactaggatttgaattctattgtacacaattaaactattttacgcttatgagcatatccctatgattaagacaaattgggaagttgcttctattatcttaaaacattaagattacatgatctagaaatataaaatgagggtaagagcgatgcagcttggcgccgcgcactcgtgaacctactaaccgcacatgcttcagtttacaggggtggtcattctcatttggtaaactaacctcttgtcatttagtcatcaggctgtacctgcagaggagtggaaatgaacatatactcgcaatgcatctaataagtgaagctagctagctagcacagctgtacaaggggctggatggctagctctaaaagtcctatgacgaatttagagcacgaaacaggccggattaatcatgccccgaattattgtcgtggattatctctataaattatgaaaaattaaatatttttttaaaaaacttaatactagtagtttataaaagcaagttgtataataccctctttgtttaggcttaggcttattggcctaaacttttaagtcagcttattggcttatatgatttataagccagtggatttaatgtcctaagtttaatggtagagtcatatatctatctcatataagccaaaaaaagcttctccaatctagcttttggcttaatagtgttagagtggcttatggcttaaaaaaaccaaatgaaaaagctgcttgtttattttggcttaaacttttcgacttataagttggcttataaacctaaacaaagagggcctaagtaatacggtagaagaaagtctttggagaaatatattttaaagatgtgaatcaaataatctgcagtaataattaatttgatgacgtagcaaggagctgaaaccaacgggcttaatttgttcaaaataatttgatgctcgtactcccagaacaagtatacgtccctcacaattggatccccgatcgaagtcataaactccatctgtactaaaatatgagattttcagcatagtgtcaagttaggtatttaatttttactttaactactaatagcaaaacaaaaataaaaagggtcaattgtgtaaaattgatatgactagatttatcataaacaaactattataatatgcaactctttttatttacaacattttatttttatatatattgttggtcaaaatagaatctcgaagactatatcaaagtcgaaaaatacttatattttaaggcggagggagtatacaatacccctgtgcagctacagtattagagtagaacactagtatacatacgtgcaattaagaaacttgtgtgtagtacatactctctctgtccctaaatataagagattttggttagatgtgatttatcctagtgcaatgaatctggactatataaggtattttggttagatgtgatttatcctagtacaataaatctggacatattttatatataaattcgttgtactcgcatccaaccaaaatgggagtagattttatacgactggtcaatagtcaaacccagagcttgcaccgcaaggaaaagaaagtgtctttctgatccagatgattacgtgagtacacatgccgcttgacaggtacgtatagctagcaatatagctaattaggtgtcaacagataaatgtgcgctttgaccacccaattcttgcacgtatattttctgaagggcatgcatatgatcgagcattctgcagtacatacgtgatgctcttgtatatattaagatagtggagaagatatactacctccatcctaaaatgttgacgccgttgactttttaaaaaatatttgaccgttcgttttatttaaaaaatttaagtaattgttaattctttttctatcatttgatttattgttaaatatatttttatgtatacatatagttttacacatatcacaaaagtttttgaataaaacgaatggccaaacatgtttaaaaaagtcaacggtgtcaaacatttagggaaggagggagtatatgatagcatgacagtgagaggaactttccgttcaaaaaaaaagacagtgagaggaactatattaccgtacaacagcacaattcttgtccggacaactaacgcagctaaaatagtttcaatgctgcacgcataccttgtctcactgattggttgcctttcactacagggcatgcaacttttcccgacggcgaaatcaccgttggtgatccaaaaaactgtagggaatgctgcagtcgaaagtttacgatcgggaattgttggtcgagaatgagtgtgtcggggatttgtaatcgacagtgatcgattctatgtatcatcgacaatttacatttccaatcgaatattgtggaccataagcccgtcggggttttttggacctccgttatatcctccgtaacggattttaggattcccaacaaattataaactcgtgacaatatttgttaaactaatggaattgataacactattagcagtttatatcacattatcacatcaacccaatattaaccacaaatgattgtaaccttgtcttatgggaagcattttttttgccagttcttggtaacatagtttaacagtaaatatcaacaagattcatgaccaaacaagtaccctaagtttccactacttcatcagtataataaaattgaccaaacatttggcttaatacaaatagttttcttaatgaatctcaagctaattaaccagttcgaatgaacgccaagaatatgacttcaactatgcataggatcatcaccatagttctcctatatcatcatcatgatcagcaccagtctttaacatcatcatgagcagaaccaccatcttcatgatttgattcacatgcttttcttttttaggaactttgatgcaccatacattaagcttgatgacggctgcccattggtagacaaacttgtcaatttcgacatgtgtgaacagcaagaaatatgttttccttacataattcatgattgtttttacataatctctattttataagatatttttttaacttcttttgtggtactcctacctaatactctcattactccctgctccccccccgggcggaggagagtaagtgcaggtttaagagtgtgctgtagacaaagtacaagcacatgtggaggaaagagataataaaaagtggaaaataatattggctcttatgcaagaggtagctatacccatgctgcaagataaatgcattagttatatactctcttaatttgtttcatattataagtcgttttattttttctaagacaaactttaaaatattttgataaaatgtttattttgtgttttattatatttttctataaaattagttaaacttaaaaaaattgagtagaaaaaaaatgaagtgac

SEQ ID NO: 15945 - DNA, 3917 bp, Oryza sativa
ccaacgggacggcgccagcctctctggcgccgtcctcctgccaccgtggcgcacgcgaaccgacgtggcaggaggagggcgccagcatggctggcgccgccccagggaggagggcgccagccatgccgcctccattcctgtttctctgtatggagttgcaacggtgtcatttttattttatttttttggatgttttttcacactcaggatcacgatacaaccaaccacaaaaaaaatttaaatacgaactaccacttagctaagtctgaaaatatctagcataccacttagtctactttgcaccttcactaaaattagaccataactcctttagtaaaaccctttgatcaacacgttaaacataatgcactctaccactatatgaaattacttaatataattcaaaatataaccacatgaaatgacatatataagttaaatagtatatagagatgcaattttttatttttatttcatttttttgatatttttttcacacttaggagaacatagtaaccaaccgtataaaaaataaactcaaacggacaaaatatgtgacatatagaattttccaaaactctaccgaaacggacaaaatatgtcatctattaaaataggcgtaactttctcatacggactcggaatcagtcaaataatatatgcacggacatctacagaaaatgttacatccgattctccccggctttggcgatattaaaacctccaaattccgcttgcaagattgtgtttttgaggagagaagtttttcggtggagctttggaaaattccacatgccacatatttcatccgtttgagtttattttttacatggttggttcctgtgagttcctaagtgtgaaaaaaaatatcaaaaaaataaaataaaaataaaaaagttgcacatctctctcctctgcaatagttcggagagagaggagaggagaggaaaaattctacatgtcacatattacgttcatttgagttcaatttttctatggttggttcttgtatgtccctaagcgtgaaaaaaatatcaaacaaataaaacaaaaataaaaaatttcggggggggggcgctagccactctggcgcactccccctagccacctcagcatcgccccgccacgtcggcaggggaacggcgccaaagaggctggcgccgtcctgttgaacgacggcgccagccactctggcgcactccccctagccacctcagcatcgccccgccacgtcggcaggggaacggcgccaaagaggctagcgccgtcctgttgaacgacggcgccagccactctggcgccccaaaaaggaccatttttgggataagtttttctaggggtctatttacgaaataagtttttcaaaaggaccaaaatgtgaaaaatcgtcttctaatattttgatattttgcttgcactgtttgatcacttgttttattattatttttaaatataaaaaacgaaaagttgtgcttaaagtactttgggtaataaagtaagtcacaaataaaataaataataattctattttttaataagacgaatagttaaacagtgcaaataaaatatcaaaatcccttatattaggggacggagggagtacatcatatgtatactattattagtatgaatgtagttaagtttttttttcaagatttatagtagtaatgtgttattattttcgtaatagatgaagtgacaacggcgcgtgtgtgcgaacactggcatttcgaatgagttggaaaacgacgacttcgattagtagttgatcgaaaaagtaaatcaagtcgcttgttcggattggtgtctcgtcctgataatgatccgcgatctgcttggagttcaaacacacgcacgtgcgctgcgctgccgtccgcgcgctggattgctgggaacaaaacgctaccgagcgtaccgcgcgctgtggcgttctgcctctgcctgcctccatgtacaccacgcgatttcctgcacggatggcatcaaatgtatctatccgtgacacgtagcttagctattatgtaaaagcatttaattttacatttttttgcggggaatttaattttatatttttataactctatttaattttatagttgagatagtgttctgagaaggacataaacaataaataatattttcattcttacatattttttaaatataatacataataatcctgtctttgttttaacataggctactgcctcttattataaagttttttttctctaagttgaaccaaatatgaattaagcaacaaaaatatgatgacaaaacaggtttgaagcacatgaacacaaaagaagaaatacatattattgcagcctaccagtaaatctccatactaatttaaagttgatgaatattgacatgatcggtgacttcgaattgttgcatgcaagttaaattacatatttattcacgtcgcaccttttgtagttgggttcgaaaccgaaaccagaatgttgccgtgaaaacaaaatatctttatcatgaacttttgatatatgctttattgctctaatttagcaaataatttacctctacagctccaagtttttttttagctttagaaattattggagttggagctgctgatatattagagttattaggatgagacattttattcatattttacactcctccttttcccctttaacttggactactaattaagatccattaacggctaatattagtgtattgcctttttcgcttagctatcacacgcatgccaaacatgaccataatgcacattatgggctccaagaaaaccatggagcgcaaagtcatagagagaatgggagaggaattaatgccgtacattgtacgccttttttcttttatattatatgcggcgttacactacagtcatgcgatccatcaagtcagaagtcgccttctgttccgttaggcaggcagaggcctccttcccctttttgattttcttggcgtccaaggtgctctgcttaataattagtctcaaattaatggcctgtcaattggtcaaacctcctgttattttatatacttcgtcgtaaccaagagccagcagctcatggacttttcgtattatttccaccttctgtttttgatctgagtatcagagtatcatgaagcagatatgatgcttggtctccaaggctcatgcttcgcttccaaggcggcgccagtacggaggtccacttgatatgatgattaaactaagaggccatccatgtggggctgtgggcatgcaactagatcttaatttaccatcatccaagatttgcctttttttagtttcaatactccgtatgtactccctccgtctcataatataaaagattttgagtttttgcttccactgtttgaccattcgtcttattcaaaaaatttgtacaaatatagaaaacgaaaagttatgcttaaagtattttggataataaagtaagtcaaaaaaacaaaaaataattccaaaattttttgaataagacgagtggtcaaacagtgcaagtaaaaacttaaaatcccttatattatgggacggagggagtagctaagatcgattaacctatataaacataacatcaaatttctgctaagctttcacacatgacatgtatcatcactactctctgtcccattctaagtgcagccatgatttttcgtacacaactttgaccgtccgtattatttaaatttttttaaaaaaaattaagaaacataagtcacatataaaatactaggtttatgagttcaaatcagtaggatattatgacatgtatggattgaatctgatctctaagctcaattaggcacgtgctcgataaagatagcctgtttaaattgatatggacacttaatcagcctctctctctttttttctttttttttttgctctaaaaaacttgacgacgttgctattatac

SEQ ID NO: 15946 - DNA, 1021 bp, Oryza sativa
  unsure (1)..(1021): unsure at all n locations
agctgccgttgagctctgcacagcctagcagtttaatttaaaacgttgatacggttcatgagatgccatgttctcgtgtttatcgtttagctatccctgtcttctgcatagagacgcgggcacaagcgatactcaatcatacaaaacaggagtggtacagaaaggcacgaaacttagcgtaaaacaaaactggaacaacaactcaccaacaccagcaaattgaacgaatagattgctccatctgccttcccgcttaatcagcgtagcaggcatgcgggagacacgccctccaaatcactaaaagcagcactaataatcggcagtttatgaatccgaatgaacatttcaggccattttggtttgactccaaaatatgccatattaaattgttggtattttattaaatagtgaaaaccttgacctgcaggagtaaaatagcctcaagcatcatgcgtagaaaaccttctcacacacataggttaagaaaacccctgaactttaccccaccataacccaggcatcatgcgttgaagaccttctcaggcatgtcaagaaaacccccgaacccgcccccatctttacacagcgacaccgtaacccatgtgagaacaaccaatgacctggcatcatgcgtaacgtaacccgtgtgagaacaaccaatgacctagcatcatgcgtggaagaagaccttcttacgcacgtcaagaaatcccccgaactcctacccccacccttacatagcacatcgtaacccatgtgagaacatctaattacctggtccgggtctaagagctatactttgacatgggacagataaggggattttttttaaccctagcctggaattcgctcccatggagaatcgaatccagtgaggagtgctgttagagccacctgaccaactcagctaaaggctcattgtcagggttatggataccacatacctaatagtagttgactannnnnnnnnnnnnnnnnnnnnnnnnnnnnnnnnnnnnnnnnnnnnnnnnnnnnnnnnnnn

SEQ ID NO: 15947 - DNA, 522 bp, Oryza sativa
  unsure (1)..(522): unsure at all n locations
tagttctcccagaagtctcccagaacaaggaaaacccccctggtgacactgctcaatcctcccagccaacaactgaagtgccgagtgagttgagagcaaaaatcagagcaatgttgctagaaacactgtaaatctgtaataccctgtggggattatgctgtacaatgggataatgtagccaactctccttgttcagcaccgactcagggtatcaagaagtgtacttgttcggttatctctctcatttgaaatatgtgtactgtgtacaggatagcgactgcgttccgcaatggccatattggttcactactcggtaccaaggccatccaacatggggccttggatgagttggatcctattcgtatggtattgtgtattcgctgtttttcctcgcctccccgtttgcatgagccgagcgccgaacttgggctaatgggcaccgttcgatcgaagttcgaacaaatatannnnnnnnnnnnnnnnnnnnnnnnnnnnnnnnnnnnnnnnnnnnnnnnnnnnnnn

SEQ ID NO: 15948 - DNA, 468 bp, Oryza sativa
  unsure (1)..(468): unsure at all n locations
nnnnnnnnnnnnnnnnnnnnnnnnnnnnnnnnnnnnnnnnnnnnnnnnnnnnnaatctctaaggccgaccgccgtacgttgcagcttttgattcaggcggtgcataggctcagtgtgcgaagaaggttggctccagatgtccttgactttgtccttgaaccccgggacccgtgtccaaaagttttcaaacttgaaggtcctcggacgatgtgggccttgcgggttggacagtacaagagggcaatggtcggatggccctgtaggaagggcatggagaacatggtgggggaaagcaagatctcattcctcattgcaaaagcaacggtcaagcttgacaagggttgtctttcgacgctcattactccaagtgaacttcctgttttgcagggggatctcatgcaactcacatcgatcaatgactacgcgaaaacgtctcatgcgtgcgaggttgaggttgctattgttttt

SEQ ID NO: 15949 - DNA, 667 bp, Oryza sativa
  unsure (1)..(667): unsure at all n locations
nnnnnnnnnnnnnnnnnnnnnnnnnnnnnnnnnnnnnnnnnnnnnnnnnnnnnnnnnnnnnnnnaagaccaaaagacctaatgccgttggtctatgagatctccaaaaataggaagaaatccctacggcaagggaaagaagacgactcctgggtgcatgacctgaccctcgatgcgggttcatctatcacaatcaacctcctcgatcagctagtccgcctgtgggaggcggtacggaatgtgcacttagacagcgaggagccggatcagattgtttggaaattcacaagcagcggccactatacagctttctcggcttatcatgcccaatgtttgggggcgccaaacacaaacttcaactccctaatctggaaagtttgggcgccagggaaatgtaaatttcatgcctggctcatcattcaaaatagagtctggacgtcggaccgactcgcgacaaggggctggcggaataacggacattgccccctatgtcgttgtgacaccgagacagccttgcacctcgtcgccatgtgtagatacacgaagagaatctggcgcctcgttgctacatgggcgggatatcagcagttggaaccggcccaatgggaggaagcccggtcagtccatcagtggtgggagagcctagctaatacacccggcattccaaa

SEQ ID NO: 15950 - DNA, 702 bp, Oryza sativa
ttttatgtcatgtgtatgcagtgaaagacctctgttgcagttgtttgtctaagtgaaaacatagtgactgtgtgcaacgaatgaggctagaaattagttgaacatgttcttttagattttcagttgaacagtagctgtccagatttttgtaacatcttaattcatgctggacctaatgcatatatgttgttctcaggatgacaaatacaatgatgaagaacctaatgcatttgatttattcaaggagttccactacagcaagaaaaaaaaaatgctacaccccagttgtacaggaggctattgtaagataattttcagactttgatctttgtagtgcttatttttaattctctcaacatcaaccatgtttgctactttcttgctagactcagatggaaaacaagctatctacaacaacagaaggtgaagaacttaagtcagcggctcaagttgttgctgacgtgcttgctgagaacaccaagaagaatcggttcttgcagaatgtgggcttcaataatgcccagcctagattcagtgagcagagcactgagacagaactagaagcggagaaaagggccaatgctgagcttcgtgcacaggtggctgatttgtcaaacaaagtgcaagaatctgagcaggcaaggattaaagaccgagaggagatgaagaggagtcaatctgagatggaagcaaaacttaatc

SEQ ID NO: 15951 - DNA, 724 bp, Oryza sativa
  unsure (1)..(724): unsure at all n locations
nnnnnnnnnnnnnnnnnnnnnnnnnnnnnnnnnnnnnnnnnnnnnnnnnnnnnnnnnnnttttttcaagatttatagtagtaatgtgttattattttcgtaatagatgaagtgacaacggcgcgtgtgtgcgaacactggcatttcgaatgagttggaaaacgacgacttcgattagtagttgatcgaaaaagtaaatcaagtcgcttgttcggattggtgtctcgtcctgataatgatccgcgatctgcttggagttcaaacacacgcacgtgcgctgcgctgccgtccgcgcgctggattgctgggaacaaaacgctaccgagcgtaccgcgcgctgtggcgttctgcctctgcctgcctccatgtacaccacgcgatttcctgcacggatggcatcaaatgtatctatccgtgacacgtagcttagctattatgtaaaagcatttaattttacatttttttgcggggaatttaattttatatttttataactctatttaattttatagttgagatagtgttctgagaaggacataaacaataaataatattttcattcttacatattttttaaatataatacataataatcctgtctttgttttaacataggctactgcctcttattataaagttttttttctctaagttggaccaaatatgaattaagcaacaaaaatatgatgacaaaacaggtttgaagcacattgacacaaaagaag

SEQ ID NO: 15952 - DNA, 688 bp, Oryza sativa
  unsure (1)..(688): unsure at all n locations
gactcataggcagccccaagcaatgacaaagccccgcctgatgatgcatcatgcccactctcactattggcagttttgcagcccttgtttgaatcagcatctagaccatctttcaacaactgaggatgatctacaaggtaccggaagtagctgtggagatgatggtcaggcatcaagaaaccaaatgttggattactaccctgtttcacccttaacacaatctctgactggcccccatgctcactgacaaatagagcagttcttgcaataatttgatgaaccttctcagaaggaggctgcaaatgaaaaaaaatatgggggcgaaaacattgtctcagtaagggtctgagtgcatggaagtacaagattatgatcaaagctcaaatgaatttagctggtatatcataagaacagctatcccatgccagtacttttttctgttgtgtgtaacatttacatcattctaatcccacctgcctattccttacatcatgatatatgtaaggaaacaatgtgcatcactagtaggaacctcatctctgctccaaccatctgaaataggcatttaatccttagaagaacatatgcaccttggataattatggctggatcagctgaagaatattcaaaannnnnnnnnnnnnnnnnnnnnnnnnnnnnnnnnnnnnnnnnnnnnnnnnnnnnnnnn

SEQ ID NO: 15953 - DNA, 573 bp, Oryza sativa
  unsure (1)..(573): unsure at all n locations
nnnnnnnnnnnnnnnnnnnnnnnnnnnnnnnnnnnnnnttctcggtcttgtcaacaaaactggaaaatattaacttacttattttgagaaataaaaattgaaatatggcatgtagcctataggaacaaacatgaacttgcaagatttcagatgatctttttactcttacctgtctacaaaacttttagtcgaagccatcaagtaagtatatatgtagctgaaattgtacagaggaacacagctgcagtagaaaaggatattttgaaatgttaatgttgaaaacgtctataagatgataaacattggtacataaaaaaaattgaaattcaaactacaacataaagacttaaagcatactgactagtggggaatatgatcagaatgtcactctaactctctctaacctatagagatgggtaacactcatcatgggaaactcttcaaggtgagcacccacaagggaaaccaagaaaaggcattcaccgaattatgggatgccttcacagttgcatttttttttctaacattacttatgagaccaagcaaaagcgagagagcttctcaagaaacctt

SEQ ID NO: 15954 - DNA, 177 bp, Oryza sativa
ctatagggcgaattcgagctcggtaccctgttcggcagaacggcgaggagggcaagttctcggtgtacgtccactcggcgcctggcttccagcttgaccgcaccaccacgggatcgtcgtacttctaccggcggcagctcgccagagcgtaaagggtcggccatttcttttgcgtga

SEQ ID NO: 15955 - DNA, 733 bp, Oryza sativa
gggcgaattcgagctcggtaccctatgtctgcctaaaatggtaatggggcctagggattatgtatagtcaagggattgacttgaccatcaaactttaagttcattccattctggttacaagaaacaagttactttcatccttggccattagcattgtctttttggaatagtataagaaaatattggaaattatttaagggaattctgaaaatcattttggaattctgaaaaagtttcttaaaaaccactggaaaaagaaccaaaccggcatttgcacctcttaaaatggctgcctaccaacccttctgaatttgaaggtaataaatataaattcctggtaatattcccttcattccaaatattccttgattaaatggggggtcaattatggtagggcactaaccagcatgtatttggatatcaccagtggaggatttgctgaaccttacaatgcaccggtcaacacggcaaacaaaatagtcatgatttttcctcctgtgtaacctttctcaatgataagctttccaccataccaaaaggctaatccatagctgccaaatacaacgcacatgacaaagcccatgccaaaaccagtgataatgccttcctcaatagtagcctggaatgacttctttataaaataacggtacattgctatcgctttcttctcaccattgaaggacacaacctgttaacacaggatattaatcaaacttactgtctgctactccaa

SEQ ID NO: 15956 - DNA, 684 bp, Oryza sativa
  unsure (1)..(684): unsure at all n locations
tgaaagaatttctaatactgtttactacaaattcccttgctgaatactatttatatgtttcacatccataatttgaagctacaggttccactaattctttttttttctttgtttttttcagcgaaaagggcaggagcttctctctacttcactaaagaggtgttccaatcagagaaaggacttttacttacgaagaaaggaagctactgaagttccaattcccagatatatgaagttgaggacaacctggaggagaaagaagatccaaagttaatttggctaccggccggtgtgtctccatcgcgtatcactaagcgcccgcgggcactcaccttggtcacgctgcggaggacgctgccgctggtgttcgcgccgaaggagttgatgacgttgccgaagaggaccgtcatgaggggctgcgagatgccgttgccgagcgcgcccaccgtgccgacaaccatcagcagcacgtcgaggcggtcggcgtaccggaacaagctgacagcggcaccttcttccccgacgacgacgacgccgccgccgcagcatccttcgtctccggccatgatcatcacctgttcctctgcctgactcgtccatttttctcgccggccggctagctannnnnnnnnnnnnnnnnnnnnnnnnnnnnnnnnnnnnnnnnnnnnnnnnnnnnnnnnnnnn

SEQ ID NO: 15957 - DNA, 12479 bp, Oryza sativa
  unsure (1)..(12479): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcagaaaaaatgaattaatggaacgctggagtttagtgtcacaattgctctagttgactcgacacggtaataggtatcctcgcacaaggtgttctcaagtggttgacaagaaattgatcccaatctcagagattcctcccgcattatttgcccacttgcgagaaacttctctgcattagtttgagcttccacatcccccctgatgcagaaacgtgtataatgcacagtaataaaatgcaaaataggtcaagtaacgatgacaacaaaaggaggttatcgtgtcatctaaaatcagaaagatgacggataaatccacagcaagtgcctacaatagtcataggatctgaccaggtccaccatccaagagaattttggcagttccatactaaaaattcaaacaattatttcagttgaaacttattaccaggatgatacaccagttacctctggttctggaaaataccatcaggaaccataagtcaattttataataaaaaaaagctttataaactgctattactccctagtataatccagcttggatttaagagtcaacgttaatatttagtgccactatggatgatttgattcactacaaaaaccaactgatgaaatgggaaaagcaatcactaatataggtaaccactaacaatttcctggcactaaccagggattcttttttttatccagtgcatgcaactcttttgatgaaatgtgaaaacagtgaacagagtccatggaagacacaaacaattcactaaagatggaacagttaacaaatttgcacagagaacaaacaaagcaacaaaattgaaaacgtgccttccgacaagtaaaagatagtcagagttttccatcctagctcgaccacgggactgtataaagctgcatactgttgctgatggatcaaagcgaattaccaagttacaacttggcacatctaaaccctcctccaaaatttgtgtggcaataattatatgtacctgcataaccatcattctctcatcagagaactatcatactatgacttaacagaatgcctatagcatacttaacagaatgcctatagcataaaatacaagtaccaatatcgaacctttccttttcgaaaagattcaacaatttctgtatgatttttcctgctctgagatagcaaaccaggacggcttcctgccatgtgcttaacattccacccagacatttgatgaatagatgaaagtaggtgctctaatactatgcttgtgataactctctcaacaaacacaatgcatcttaagtcttgcatatgcctgagagagagagagagagagagagagagagagagaaagagaggtgttacttattgaatgatcaaaagaacaaaaagttttagtacaagaaagtagaagcataagcatctcttacaatcaccaagttacttattgaatgtcgttttgcccgcgcggtttggtctttaatccagtttgcttcgaatattagtttacctaatagtacaactcatatgtttgggcattggataagaagacaaccacacaatttgagatctttggtcttattaggggcaactaccactatttggtctatttggctttgcagaaatgatgtggtttttgaaaggaaaaacatatcttcccctttgcaggttatcttttttattacacattggctctgctcatgggctatccttcagaaggtcaatttgcggggtactatcattgcggcttgtcaacacttggagctagtggccatggagttttctaccccggcgcatgggtggcgttctaggctacggttagagggctcctgaagttctttttgtccctgctattttggatgatgagtttatcttttgtttctttcttgttggctgtgtgcactctttgggtgcagaagccagaggtgctctcagaataattgtatcacttgatagaatttactgagattaataaagcttccattatctaaaaaaaaaactttagaacacatttttcacactggctggtatgtgattatctattccatggaacttacttacacttcaatatccatctaagaactaacctataaaagccagtaatagggaatggaagtagaaggtgaaattcaagaaaaaactgtatgcagcaggaaaataatagtggtactggaatgtatcatttctgtactacttatatgagttggtggtgatgggttgtgctctacacccccaatccttcaatcaacctttggtgaaacaatcagcatagacgtgtgtcattttactcatttgtacttctattgaaccaatatatagatgatttaattatgttcatatgtatgtggttgtcagttgatccaagttaaatattttaaatgtggggatttttttttggcatttgagtaagccaacttatgcgtgtttatctgagatttgttacaagagatgggcaaatatgctagttctcccagaaaaaataaacttttttttcttgggaactcttctttatttttttattcagattttcaaatgtaatccatggggcatgtacaaaaggcacatgcatattgtagaagctaatggctctttctctgtactggtcatccatgatttttcctattttctgattatgtaaaaccatgcatatcacttgatattaactcacagcagacaaaattcaaaagttgattaaaaaagaatgaaagaatacaccactatcgtccaccctatacagaacctttggtaccatttagtcgatgcagtctcaaagggagagaatgagaaatattaccaatactactataagaatagccaaatgaatgcaatctcaaaggatgtggctgtgaaatattatcaaaagaaaatatcagaagagtattttagcacctgtactgcagaagagttcgaataaggcaatgaactttgggtgtcaatatcccatcttgagaatcagctggaaatttttcaccaatatgacctgaaaaaaaaaagcaaagaatgaaataaacatggtatgacctataaattggaatttcggcaagtggatgccatctatggtttaatattcagttagtatcgcatgtatcataagtgaaattatgttaaaaatatcatagtattcataagtgaaattataaacatttttctagtatccagatagcaattcatgcagacaacagactagacaacattttatttggtaattgagaattccagaaagcaaatgctgtcatgcaggtaaccaagaaaagaacataaaaagcgcaacatgctagagaaggtatgtttgtaaaagccagagctgagtagtatgtaccattcttcaagaaacatgaaagttctctatgtacttcttcgctgtagtttctaatgaagccctcaacatttttatccaatgtttcaccccagaaggataggctgttttcctcgtatgattgtacctcacagcctgaaaatacaatgttaaagataaattgggattccagaaagtactataaatgtgcagtgaaatctttattcatacctttgctgccagccatactcctagattatataaacaatatacaaatgtatgatgcaattttgatatcctttgcttagcgttttccagagatgaaccatgtagttttctgtccagagcttctatatgctaagagaatgaaacaaaattgcattggtatctggtaacatatatacacaggatttgttaaaagaagttacttaaagcattacaaaaagaatgtcaatgcatctcaataaaaaaaaacctcctgcttaaaatattgaatgtcatattcagcccaagcacaagaagccatgaataacaggtccatggcatgcaatactaaaggtctggcacatgctctaactaaaaaaagaagtctaacaacaggcttaacagtctctgagactgataaatcatcactaaaaactgtctttttgacctaaaccgcattttagaattcacatacttctgtagaacactggctgtgctactgtaataaaccctaactttttattcttcatttatattctgaaagatgccattgataggtcccacgttttggcatgcaggggatatcatttggctatctgggcctgtttggcagagcttcagagcatcctggctataaaattgttagaggtcaagctagcggtagactggggtgttggtgcgccatcctgtttacatttcagcatagaccaatttattttagcctaagaactccatatttacaaaaatacaagagttggagctcaatccagctcagcatattatgcttcaaaattcttgaagctggaacctaaaagtaggtagacaggagtgtttaggtgagtcatcttctttacattttggactaaaagtaggtacttaaaccactttgttttagcctacaaaactatattctgcaacaacataggagttgggagctctccagaatagacccttactaggcttcctctcatttcacatttattctaagtttctaacacttctccccaactcaatctctgttcccttctgtaggcatgccgaaagtgccaacctctcccttgtatcttaccccaaattggccgccatgcctagtcttaccactcaacttcatgcagtacagtaagcaacttgtcggcaagcaacatgtaactgaacaatagaaagcactgtttaccaaaagggcaaacaaaatgtagaagaatgatagtacctttttattcaatctattcaaacaactgagaatattggcatgcagctcagatgaaatgttggaatcgtcaaagtccactatttttgtagaagcaaatggtatgtactccgacaaagctgattcactatcaacagtgtacaccttgaacaacaaatgcatcaatgcttatttcccaaagacacatacaggtaactaaattaggaagaatgattatcgtaactgcagggatcacgtaattaactgaaaattacatggcctgaccttggaattcatgagattctcaatctcagaaatttgctttgaataattgtgcggattcaaatctatagaaggaacagtgtgacagattagatgatcagagagcctgtgcataaaacataagggatgatcgtttcgcccttaccttttgaataaatgagcgaagcagacatcccaaatatccttggcagagggtctgacgcactagaattcaactgggggtgataaaattcctgcaagcgtcgaatgatttgtctaaattggtgatacagatcagcaggggaagggagacatcaaagattctgactgaaatagtaaatgtggcaaaaccaacgctgcatgttccaattatattggcactagtatgtaagttagagcataggtgttcctatgttgatgagacgaaaatggaaaatgagagctactccactactaaccccacccgatcaataaatgtgaagggaaaatacgaaagggcgcaatacggcggcgggtgtaaacttttgtaccttgaaaatgcaggcgtacggcgtattgcccctggcgtggtgacactcgtcgaagatgagcagcgcgatgtcctggaggcggaagaagctgtggcggaggttgtcgagcaggatctgcggcgtcatgacgagcacctcgccgtcctccagttgggatcgccaggtggcggcgtcccagaagtcgacccccatctcgccgcagaactgcttgacgacgaggtcggtgtgctgctagacgacgcgcgcctgctggcccacgaggacgacggtggggaccaggaagacggcgaagcggggcgagttcgggctccgcacgcggtgcgcgtacgcccggagcagcatcaccgcgatgagcgccttcccgctcccggtctccaggaacgccagggtgttcccccgcaccggccgctcctgcgccttcagctggtacctgcacgccacgcgcaatcacaaacccccaccaccaccattagcatccaaaggggaggggaggacggcgaatcgcgatccgtcaggcgcgcactggacaccccccgggcctcaccatctggccattgtcttcgggtcgggcggcggcggaggccggagcggttccaccgccttggcgcccccatctcctcgacctccggcggcggtgagggggccacccatggcgacngcggcggcggcggaggaggaggaggggtttgggggaggaatcgggggaggcggcgggatgggggtgggagaattnggtggnnccnncncttggggcggcttcgtcttcggcttctttggtgcccgcaccgttcccaaccgaattcttacaatcgcgcgcgcgtgtgttgggctcgaacaatgacgagagataaatgatcttatgggggggaagcgggaggaggagggatgggaccaattggtagtgggaggcttcggggcgaaggattcgcccccgccggttcgttcgagtgcgccttttgagttgacgaggacccgaggagaggcgaccgggaccgcgggggaatgggcgcggccgtttggcgtcagatggaggggagggaatcacaggtggggtactgggggtatgtggaaggtcggggggcggtgacgtccttttgggttttggcttttgcaatggattaaatattttttagatgtcatgtcacatgtcacatcggatatttgatacgaattaaaataattaaacgtagactattgataaaacacattttataactctggattaattcgcgagatgaatcttttgaatctaattaatcattgattagcctatgtgatgctatagtaacaatgtgctaattgtggattaattaggcttaaaaaattgtcacgtgaattagctctcatttatgtaattagttctgtacgtagtctgtgtttaatactctaaattagtgtccaaacatctaatgtgacagggactaaagtttaaagtctagtccctggattcaaacaccccctcattgcaggtaataaaatctcgacaattccatgtgcattgctctttcaataaaaaagttcaatgctggtttgttttctaggatttgggttccttaggccatcaccaatgcgtactctcaagtgtgtccctgctcacagccgtcgccagtccatcagtttgccgtccctagcagaggggcgcgtcttcctccgctcctcagtcgcttttcgtcgagccacggagctaggggacacgttgggcgacgtcgtggcttgaggacacggctcccgcacctgatttttctccttccacccttggcctcttcgctgagaggcccatgtgttgataaaaaaacacacactggcctgggaggtctgcttaactccagtgcaggtcctaaatcttgctttcgggtttcgctgggaggagacagagttggcgacgacgaccggcgatgaccctgtgacggagacggctcggcgaccccgcgcgctgctgccctccgccaccgcgcccgtccccgcgccgcttgtcgtccgccaccgcggctggtgagagagaaggagaaaggtgacgatgagtggcgcaagagagagaggagagaggcgacggcgacgaccagatccgaccaccgtgcgctgcggcagccggcgaggacggagggcttcctcgtgcagcggtggcgaccagatctggcgcaggctgtcggcgcagtggctggggatggcgaggagggaggcgacgtcggtggcttgggaggtgacggcggtggctggggaaggcgaggagggaggcggcagtgagcggcgtgggagaaaatggcgagcgggcaagagagaggggagattggcgatgcgcgcgagagagaggagaagcgtcggtggggaaaaaaagtcatcggtgggctatggagagaggagggtagtataggaaaatacccaccgtgggctttttggttgggacacccattgtgagcttgagtgccttcacccagttatcttatattttgaggagcccatccaggggtatctctcattgtgagctgagtttctctacgagtgtcctcaattagtgaggacactctaggaatagctcacattgtagatacccttacagtaatatgttgtgtccaactcatacgacttctcattatctgtgttcgttccggtgacattgagggagaaaacccatcgttttccacgcgcacgcttctaaatatccaaaaattatgtcacatcaaatatttggacatatgcatggagcattaaatgtggaaaaaaaatccaatttcacagtttgcatgtaaaatgcgagacaaatcttttgagcctaattataccatgatttggtaacgtggtgctacagtaaacatttgctaatgacggattaattaggctattcatctcgcagtttactggcggaatttgtaatttgatttgttattagactacgtttaatacttcaaatgtgtatccgtatacgtcaaagtttttaaacctaaacaattaaacacggccaaagtgtcaaactttactagaagcagctgtgcagtggctatggtagaaattatatgttgctactgtagctactaactgccatctagtcataccgaacacgaatcacgtgtacactttttaaccgttaaaagataaatatattttatagaaatatactaagactagttgggtgcccgtgcgttgcaacgggaaaatatgtatcatttgaaacatacaatctatgccatatagaaatatgcacaaatcaatgaggaatcatttccttgatctgaacaaaacgaaattgtaatgaatctgattcatttgccaagttattatgctatatattaagaagtaaaacttgtagatcttcgaattcagcaaagaggaatatggacatgtgcacccacgtcaattctatgctttttttatataaacatggtttaatcacattccgtagcacacaaagaaaaatagtatgcatgcatatcaaaaggatcgtgtgaaaaatgagaaaaggagaggctacagaacatgggtactaacaattaactgatgaagcatgaatttgtgatattttcaaaccatgccaaaatgttaccatgcatttcttcaatcaccaaatccgcatacagagctagaatgagcatctctgaacaaatataattttcatcaaggaaattcgagttcaacaatcagataattctaattacaaactaagagagataacaaagaatgatttctatatcagtctatctttctggtcaatggtagcccgacacattagtgtctcaaacacgataaaatgcccaaacatagataaaataatgaaaacaaatccatttagttgttctcatgcccaaggtgcatgcaaagttttatatgggcatggtatcttaaataaagtttttaaggggttattgaccaaatggaaggactactgaacaaaaggacaatattaggtacctcaaatgatgtgtaccgtcagaacatttaaaacaaacttgcatggattcaaaaccttaagctgcttttcatctggcaaaataactggaatattcataaatgaacagcaacaaactgaatttcacgatcttagaggacacaaataattgaaggtgtaaagtattcagttaaaaatatattgtgctgaaaggttgaagccttcttttttcagagcaatacatgcttaaaacatgacaattcaagagcaaatgacatccgatgactttggttctaatttaagcagttactgattctgtttgaataagctgaacaatctactacagactctggtgcataaatcatgtaaatgtgcacgtgaaacccacgtcaataataagataaaacagagaataagcacataatattttcacgtctctaataagatgaaacagaaaataagctcctatacaacaatttaataattccacgtctctaataagataaaacagataataagctcccatacaataatttaatgaccatacaatactttgtatagataatctttccgatagaaagagcactgctacagaccaaaggatgaactgccccaaacgggcatagcatgagtacagcagacccattacatataacgttaaataaaaaatacataaatgaccgtcttcctattttactgccaaatgatgccttagaaggctcatagatggaggaagggttatataggcctcagtcctcagaagtacctttccatgaacccgagttaaatacaatagaggtgaccaacatcagttaaaagaaacacatgtagtagagagaataaactttatgcaatgtaaattatgaactaatgctcacggaatcagtgtcagctaaaaaaatgtgtggttatgtattaatgtgatctaaattagagttcgtaagtactgcagcctattctctgcaacgttaaatggatacggaaattgatggggcaaggcaaaccggcaaagtgttctctcgtactgcattccagataatcaaatgtgcagtaaacaatagtttacagcgatatgcaataatattaacaaccttccttttctatactcattaagcttaattgaaggaaatgattctgccaagatgcattgatagcagtaagatgactgcattggtaaggaagataatatacaggtaaagaaactaaccgtgtgagcatagatgatgcaatttactccatgactgaatcagggattagtgtattttctgctcgcatattgactaaatttcattgagtggaggtcttctctcacatttatagaattaaggtgtggtttatcatcatgaattcaggtgtggtttatcaccatgaattcccatcagcaattgcgctgatcatcagaacttaacatgagacacttaccatgaggaagtatatatataatcacatccaaaattttatgtctaatgtgagcacctagccagtaaaacaactaccaggatcatgaccaaacagtatgttaataccataggagaagtcgttatagtgatgagtgtgcaccacatgtaaatgcggcatcacagataaataaattgacagacacaacatagatcaacgatatttccattgcatgttaaaaaattgatatcgcagaaattaatcaagtaaaaacaggacaaacagaagaaactggtcttactttcacagtagggaagagtacccgggtgatgaaggaacctgacgtcctgaagaagagtgagcttgtgtccagtggtaagatttcacttcagatctacgccgtttgtgagataataatttaaataccatgggtaggtacaggatcaatactcttttttcgctggtagtactctcgcatcttttgaagcctagcttccttgtcgccagcactaagagcagcataccgctccctagcacgcttccgcgtaaattaaatcggagttaaattagtgatgccgccaagtgtacctgcagaaacttgtacagaaatcatttcacaacatagcaacagtacgaagcagcgagacgaaaagggagaaaacagataatgtccacaaatcagatacacattgtagatataccttcaacaggaaactgtttcttttacttaaaacgaaattgtctaacaggaaactgtttcttttacttaaaacgaaattgtctaagtgatactttcacatacattttgattacagctcgaacaaagcagtacagtgctaaaatcactttgaaaagtgaattggtttctggacatttgctcaacatatttatgaactttagttgatttgtaacttttctagatgggggatgtctagcaatcgaatgccatataagaaattttgtttaccttttgtagatgggaatgtccctcagtgatggaggggagacgggcgagtactgcatccacctgccgacagcatccagcgacgaccggaggactggcggccagcttccggtgcggcgcgaaagggaccgtggtggagatcgacggagaggagcggatccagtcgcgagatgtggcgtaggcgacggacttttggcgtggacgtgggctgcgcacggggaagcggagtcgacgacgaaggccgccgcgggatgggggtggtggtctagtgggaggccgggatgtggggggttgatgcagccggcctgcggaggtgaggtcgatgatgaatccggcttgtagacctgggaggtcgtgggcttgtggggcgtggattccacggtgatttggggacgtgggatcggcgatgggagaggagcgaggcggcgcggtggttgggcggggtggggaagtggcgtggtgaggacttccggcggcagggatcggtcg

SEQ ID NO: 15958 - DNA, 19299 bp, Oryza sativa
  unsure (1)..(19299): unsure at all n locations
atagaattttaaattagtagagattatttgaaaaatcgtattaatatttttaaaatttttaagatataatacttaattaatgatgaactaattcaccatgttgctatatttgccgggagtgaagatttctgaacctataccttcaaaagcacccaagcagtgttgtgtaccggcggtgtagtcggctgtaaatacgacacaatagcaaaatcgttctgttaatgtgacaagggctactattattattcattagtatttatgaacgtcaaaattccatttttaacgattaatcggccactttttttaataatccgggtaatcatttgcatattgcacttgacgatcttttagagtaacaaatttatttttttacgatcttgttttgtttagtgttgtttagtactacctccatttttaatggtaaattttgctacaggacatcgcgacttcgtggaattagctccaggacacctcacgaagtgagttttggggaagacacattctcaaaacatggctatttgtcataggacaccgcgcccatttgtttggtatattcgtgctgactaggcttgagcaggcccacatttttacgtgaccaggccaaattgccctaccacatattctttaggcccacacagattactataaaaaaaagaatattgggttgtactccagctccacacagttagtgggaagcaaccaagtcagctccatggctgccgccgcccacctggatgggcttcctcggcctcctcagcttccgctgcagcgccaccgccgtcgcctcctttggccacgcgcaggacgacgagctgcatgtcctccacaccctccaagcccacgtcgccaaccgccttgccgcggttgttaacaaccaaatttggtaacatcagcgtcggagagaagattagatcgaatcaaagtcggaagcggagatcgagtttgaaaacagggcaggaatcggctgaagtccagatcggctatgacaagatcggctgggtctgagtcaggttaggtaagccgatgtggccgattccgacaatacgacttgtacacggcatcaggttcaagttaatgtacttcaagatgattgccacgcatggatagagtcctgggaaggcaattgtatatattaattaggatattttatgtaaattccttatagataaatgtgggcaaaagtctgccgcaaagacttatgatatcttagagtttgttagagataatggtcatgtctggtatgggcatatcttataatcctcgagtataagtagaccccgagccctatgtaatttttaacgacagacgttcaacacaatttcggcgcatcgccaccctttttacttcagttttgtttagacgagttcttgttttcgggttgagctgcatcgatttcgatcttcaacaagaggtaaaattcattatgatggattgcgttcttaggattagtgcttccatctttatgatactctaatcccgtttatcccgtttatgtaattcatcgagttatcatatgtcttacataatctctagcaatatcatcatctaacctgccatcggttagtatctgttaatagagggtagccgattaggttaaatattaatattgatctagattatatgagacatctaccattctatgaaacttctagcgacttgattatctagatatcgttcttcttttcatacttaatgctgcatcagttgagtttgatctattaagtcgtgcttagaatattgatctttagcctgccctctagttgccgattagaatagcatcggagtttcagccgatcgtatctgatttaacttcatttgttatatatgccttattgatatgttaaatctgccctttatgttaagatattgttgtatctaagtatgttaggcttttgctcaatatattattcttgctttaatatcttgatatagagtagtatcggagtattagccgatacatgctagatctatctgatcggctatgttataaacatatatagtcttgttattgacatatatttcgatctaagtgatttatactgtctcggcatgatgaccgatctatcccaatcacttgatttaagtatacatcgatatgaggagtatatattgttaatatctacagccaatcgagtagatttagtccttctttacttattcatgactgccgatcgatgcacagatgacatcggctcaaagataaatgatatgtcatcggcatctagccgatcggctatcatttatggatttaaccacggtttctttgcttctatttcttgttgattacaggatcaaatcaactggcacgctaatacatccgaaggcgagctttggacctacactggagttaagtagatctcccaggccacgtgttttctgtcaacagcggtctcccatcagccaccgctcctctccctcgccttcctctccaagctgctcgacgtggtgctctcctcatccgacgccttccgcgacatcctcggcatcggccccgtcgccgcgcgctctgcaggccgcctgcctcactggtgacctcctcgaccacaccgttaagacactcgacatacttaaagccgtctccctaatgctcgcttcgctccggggctcgcaccgcaccgtgctcaccgccatgtcgtgcctcctcgccccgtcgctacaccacgcccactttggccgcgcatgccaggccatctccaggcaattccccgatgccgccaagctcgctgccgcgccaggctgtccttcagcgtctctaggaacaggtcctccggccgccacgtccacgccatggcggcgcacttcgcaccgccgccacagtagtcgcccacgtttgcctcccccggcgcaggttgcgggctggggctggcgctctacaccatgagctcggtgctcgtccgctgaagcatctaggcctccggtgttaattttggtaattgttggcgatatggcatgaggcccttcgaccaaacatgctgaaagcatgcacccgatgaggattcaagcccgagacatcaaggttagtcaaggcgaaccctccccatgtcgaagactatggagcaaggacgacgagaggcagggaatcgcagccgagctggaggcctcctggccgaagggcgcaaggcgaagagcgtacgccgaagggggacgacttcgccgtagcaggttcggccccgggaaggccgaagaagctatcctggcccatcaagcccaggggttaattgggtcgactataaccagtcggcccgctaagggcccatgaacctcaattacgctatgtacccatgtaaatatccctttcataagggcaaccatgtaaattcccctgcataaccaaagccctagtagtaagacctgtaatgggggctataaatagccccatagggccatgtaatagggggatccaagaaaaattctctaatcaatacactttactttttttctcaaccactgttgagtaaccacgtctttcgacgtatgcagttgtcgtttcgacaacagctggtgccgaccgtggggacctccgagcgaaaccactgagagtgaatgccaccgaagaaggtcgtaaaggaaaaggttacaaggcgaaaggaaagcgacgccggggcggatatggccaccgaagagggagcagagccttcggcgcctgtcgctgaagatggaggagcgccatctgcttccgcacctgcgccatcactaccgccttcagcccttgctacctctgtgcaggtgccgaacgcagctgacatggcgaaggcagctgcggcggcgagggcactccagaccagggcggagatcctttcgacaagccaactgctggtgccccaagccactccgtcacagccagcagcggccccaactacgctcgctgctgtgcaagtccaagtcaaccctgaccccgagacacaaaccgaagccgacatggaaggcatacgacagaacatgacacgactccaagacatgcttcgccaaatgcaaggacagcaacaagcgtacgaggcggcaaggcggtccaaggtcgcctcggcaccaatcctctagtattcggcaggctatgtcccaccccaagtctatccacaagtgccgacccagccccttccaccacaagtcgcgcgagcgccaatgtacttcgccgggcagccatcgaccgcagcagcgcatccggcccctcacgtgcaactgcaagctcaaccggtcgctgcccaagtacatcctcaaccgcctagccaagtgccacaaacaatggcagaaggggcttcagctctgcaggcgcagctccaagctttccttcagcagctcagccaaccccacaacatttcaagtacagccccttcggccctcccggaggggaatacaagtcaagatgcgcctagttggttgccttcaaatcaaccaggtctgggggcttcgccgtggagtcaaggaccgcaattcgactccatcaatgctgctcaggcgccaaccgttcggccgcaagcaccaacgctaggcttcagagcaaaccaagcaccaaaccagatcaccatgacatggtcacagccaactttcgacccattcatggcggctcagcaagcatcaccaatcggggctgtgtagccgagtgccatggcccaatctcacgcgcaagccgtgatttcacccttcgccacgccgtacccgcagcaaggtgctgtgaacagggcagggggcgaaaaggggcaaccgctgagtgggggaatcaagacccgcacaatcccaccccagtgcaagttcccacccgtcccacgctactcaggcgaaactgacccaaaggaattcctctaaattgacgagtccgcgatcgaagcggctcatggcaacgaaaataccaaggcaaaggtaatacatctcgctctagacggcatcgcccgttcgtggtatttcaatttgctagccaatagcatttactcatgggagcaattgcgcgatgtctttgtccttaactttcgatgtacatatgaggagccgaagatgcagcaacatctgctcggcattcgccagaggctgggggagtcgataagggagtacatgcgtcgcttctcgcaagctcgatgccaagttcaagacataaccgaggcgtctgtcataaacgccgcttcggctagtctgctcgagagcgaactcacaagaaaaatcgccaacaaggagctacagacacttgaacacctacttcacatcattgacgggttcgtaaggggcgaggaggattccaagcgacggcaagctatgcaagctgagtatgataaggcttccgtcgccgctgctcaagcccaagcgcaagttcaaattgccgaaccacctcctctcactgttcgccagccccagccggcgatacaaggacaaccgtcaaggcaaggtcaagcccctatgacctggaggaagttcagaaccgaccgtgcgggcaaggctgtgatgactgtcgaagaagtgcaagccctccgcaaggagttcgacgctcaggaagcaagcaaccatcagcagcctgcccgcaagaaggcccgaaaagacctctactgcgccttccacagacgctcttcgcacaccacggagcaatgccgaaacattcggcaacgtggtaacgagcaagattcaaggccacagcagggagcagcagtcgaagcacctcgcgaagtagctcaagaacaagcacccccggccgaacaacgccaagatgcacaacgcagagtaatccaagtgattacaagggccgacccgccaatccaactgtcgaagcgacaaaagaagatgcagctgcgaacgatccacaatataacttcagcaggcgaagggtctccgcaatatctgaaccagcaaatctcttttgggccagaagacgccgaaggagtaatgttcccgcaccaagatcctctggtgatctcagccgagatagctagtttcgaagtccggcgaatcctggtggacgaagggagttcggccgatgtcattttcgccgaagcataggccaagatggggttgactacccaagcccttaccccagcaccagcattgctcacaggcttcggcggagaagcagttcaagttaatgatagccttcggctcgggggaaaatagacgcgaagagcaagtattgttcgacgttgtcgacatcccgtacagctataacgccatcttcggccgtgcaaccttgaacaagttcgaagccatttcccatcacaattatctcaagctcaagatgcccggcccgaaaggagtgatcgtggtcaaggggcttcagctttcgcctgcttcaaaatgcgttttggccataatcaagagagcagtacgcaatgttgaggccgaaccgcatgaccgggcgaaacatgcgtcaaagcccgcacctcacggcaagatagtcaagatgcagattgatgatgccgaccccacaaaactcgtatcactagggggcgacatgggcgaagaagaagctaagaacatcctagaggtacttaaaaagaacattgatatcttcgcctggggccccgatgaagtaggaggtgtttcggcagatctcatcatgcatcacctggcagtcaagccggacgccaagccaaggaaacagaagctatgcaagatgtccgctgatcgctaggaggcagcaaaagccgaagtccaaaaattgcttaaggcaggggtcattcaagagatcgatcatcctgagtggctggcgaatccagtgctggtgcggaaatcaaatggcaaatgacgcatgtgtgttgatttcacagacttaaacaaagcatgtccgaaggacaatttccccttgccacgaatcgaccagctcgtggatttgatagccggttgcaactcatgagcttcctagatgcatattccggctattaccagattcgcatgaacccggccgacatccccaagacagccatcatcacaccgttcggcaccttttgtcacctcaggatgcctttcggtctgagaaatgccggagcgaccttcgctaggctggtgtacaaggtacttttcaagcagttggggcgaaatgtggaagcttatgtcgacgacatcgtcgtaaaaagccgcaaggctttcgaccatgcgtccgacctacaggaaacctttgacaacttgcgtgcagcgggcatgaaactgaatcctgagaagtgtattttcggcgtccgcacaggcaagctattgggtttccttgtttctgaaagaggcatcgaggcgaatcccgagaaaattgatgccattcagcaaatgaagcctccgtcgagtgtacgcgaagtacaaaagctcgcaggccgaattgtggcactcagtcgattcctctcaaaggcagccaaaagaggtttgcccttcttcaaaaccctccagggcgcgggaaaattcaattggacacccgaatgccaaacagcattcgacgagctaaagaaatacctgcaaagcccgccagctttgatcagcccggcaccagaagcgaactgctactatacctagcagcttcgccagtggcagtcagtgctgccctcgtccaagaaacagattcaggccagaaaccggtctatttcgtctccgaagcattgtaaggagcgaagacaagatacattgaaatggaaaagctcgcttacgccctggtgatggcttcgcgcaaactcaggcattacttccaggcccacaaagtcatagtgccatcgcaataccctttgggcgaaatactccgaggcaaggaagttactggctggctcagcaagtaggcggcagagctatccccttttgacttgcattttgttgcccgcactgctgtcaagtctcaagtgctagttgacttcatagccgaatggacaccagcattcacccccgagcccgagctggtcgaacagccctgggtgatgtactccgacagttcgtggtcacacaggggggcgggcatcgcggtagtactcacatcgccgaatggtgtgccgattcggtatgctgcaaggctgtagttcgacacaaccaataacgcagcagaatacgaagccattcttctgttcctaagaaaggcaaaagcactgagggttcggcgcatgctaatccgaaccgactccaagctggtggaaggccatgttgacaaatccttcgaagcaaaagaagaaggaatgaagaggtatctggaggccgttcgatctttggaaaaatgcttcactggcataacggtcgaacatttacctagaggccagaacgaggaagcagacgccttggcgaaatctgctgcttatggtggcccacattcgcccggcatcttttttgaagccctatatgcaccgagtgtgcccatggacagcttggaggtcatggcaatcgaccaagtgaaactgggcgaagacccatacgtctggtgaaccccgtttgtgaaacaccttgaaaccggctggcttccaaaagacgaagcagaagcaaaacgcctgcaactcagagccacaaagtacaaaatggtctcgggacagctctatcgttccagggtacttcaacccttgcttcgttgcatctctttcgccgaaggcgaggaaatggcgaaggagatacaccaagggctatgtggcacgcaccaagctgcaagaacagttgcctctaaggtgtttagacaaggagtttactggcccactgtgttgaaagtctgtgttgagcaaatcaagaagtgtgaaagttgccagcgtcatggccgaagccagaccgcgccccagtatgagttgcagcccattgcgccaatctggcccttcgctagatggggactggacatcattaggccgttcccggtggcgcgaaacgggtacaagttcgtaattgtggccgttgaatacttctctcgatggatcgaggccgaacccccttggaacgatcacttcggcagcagtacagaagttcgtatggaaaaacattgtttgccctttcggagtgccaaaagagttcatcactgacaacggcaagcagttcgactctgataagttcagagaaatgtgcgaagggcttaacctggacatcaggttcgcgtcggtcgcacacccacaatcaaatggggcggccgaacgcacaaatggtaaaatcctagaagcactaaagaaaaggcttgaggggggcaacgaagggcaaatggccagaataaatgctatctgttctctgggcccttcgaatgacccccacaagaccaaccaagttcagcccgttcatgcttctctatggcgatgaggcaatgaccccaacaaagataggggctaactcaccaagggtgacgttctctggggcgaagaggggcgcgagttgtcgctcgaacttttggagggggtaagagtcgaagcgctcgagcacatgcaaaagtttgccacagacacttcggcaacttacaacaaaaaagtatgaccgacggagctgttgcctggtcatctcgtcctaaggaaaaaaggcgaacccgatagccattggcaagcttgattcgaagtgggaaggaccgtacctcatcaagcacaaatccaagacgggatcctttcaactggcgacaccggaaggcgaagagttcgaccattcctggaatgctacctctcaagcgtttctatgtctagaacgggtgacacccaaatcgccaacttgtaaaaatgtatatattgttatgtaagcccttcggcaactatgtaagcctttcggcaagaaaaaaaagaagaaaaaaaagaggaaaatgaaaaaagacaaaaaactggatgtagggctattatccaccacggacgcccgaaccagtataaaatctttgtgtcctctgccttctttttatttgtttgtgcgattgataatttgcggaaaaaaccccaaggcaaacgcctgatcagcgaaaaagaccagagggcgaaacgaatcggccgaagcatcgctcgccgaacgttgaaaccgcaacagcttgttttcggggaacaactaaccgaacaccgttacactcgatcaagaggaaagcgcaaagtgctccttacaacgcagaacgaaactgatcgaaaacggaagccaaaagctgaaaagtcaaaacctatttcgctaatatatgcaaaggggccgacatgttccgacccaacgaaaagcacgcgaagtgacaatgcgaaaatagcgaaaaggaaataaaatgcaccttcattgatttcaagtaaaatacaaacccatcacgatgctacaagtgagaagagaagaacaatggcgttacagcccagcttacagataaataacatcttcgcccccataatcactctctctctctagggaatgatcgtacacgaccctgagaggggaaggaggcgaaatacagactagactgtaacgacgctgaaagattaactcctgccattcagtcttcttatggtttcgccaaaaacgagccatatcctccaatcgtcttgtatgaacaaggtcgtagtcttctaagatccgcccggggtgcgcccgcatccagccggcgaccttaaacaccttatagatgtggccatttatcaccatttcgcgaaaaacaggccgaaatgggcactgtaacttcggcaaacccttcaacgccacaaacttctcgttgctgtttcgccaatttttaacgggaggtcaaacgcaaaccttttgaccgcacccctgccggcaaagcgccaaagaaaagggggggagaagtacaaaaaagagaagagaatacagacgaagatcagccccgatttcaaatagaaacaattaaataggcgaaagggtaatactttgccagtggaatagagattatattaagtacaaggtgaatgcggcttaaagccgaaatgaccaaaagtctatatacaaaagacttaggctaaaagaaggtccgaaaggaccaaaggaaaaaataaaatataataaaaagacacgagggcgaagggcctcacacctcagggtggtcttggcctccgtcgccttcgccctcgtgccccggtgaccgtcccgacggtccgggacccttttcggagttggcggcagcggctttctcgttcctcgcgatccattcaaggttctcgcggagccgaatctttgcacaatcccggccgccatcctcccaaaaccccttccgaaaggcccttaatgcagcccccgagcactgcgtgttgctaggccattcttacttcacgaaatcgggaaatccccgatgtggtcgcagccgtgcgcgtgcaagaggctgagaacgaatcccgccgaaacacgagttcaacagtccnccgtaggcgcctgctacttcgacaatcgagccggccgcctcctgcgtctattcggagaagtcaagtgcagtcccgccttcgcccggagcaccttccgcccgcgccccaaggtcattaagggccagccgaagagtgtaacaggcctccttggcggactctatggctggcaccagggttgcggccgtagcttcggccgacgcaagacaggcttcgagggatttaatcttctcctcggccgaagcaagttgtcagtctcgttcggcgtcccgctggcgtgatgcttctaggttagagcggagagacctgttttcgacattcgccttcttcaacgccaccacatgcctttcgtcttccttgtggtgaaaatcttcttcggacttgcgaaggcgaaggcgatacccatctagttgctctaaggcggacttcttggcactcagatgcgcggcaaggccttgataaaaaaaacaacatacattacgtcagagagctagtgaaagagcaaaattcagcacgcaaagatgggccatacccgcacaaataggctctccacagccgcgcagctttcgccgaactcgttcagttcggtgaaaagcccaaggcctttggtcggcgcaatgacctggcacaccccgtccatgaacggagtgatctccggccgcgtggcgatgtcggtagggacgaaatgcagggcggtaagcgtcacgtccgaaacgctcgcttcaaccgccggggccttcccctcgcgttgaagaataggtgaaggaaccgcatcgacccgttcgtcttcagcaacgttcgacccagcggttggggttgaggcactcccgcccgtcgccgcttcggcattgctagcgggtggcggagcatgcgcctaccacggaaagttgcgcgtcgcaacaccgacgaagtaggggtcccgtcggacccttcactgtccgaaaacccatggccgacctgcacgacctttcctttcttatttttccttctgacagccatcaccagtttcgcggctgtactagagatcgccaagagggtgttcgctacgacgatgtcttgaggtcatgtaggcgaaacatgggagcctgccctggatttcgcaggggtagggctgggggtataaccacgagagccatcctcctcagaaccggcatcagcatcctccttatcctcctcctccctatcgctttcgacggcggtcttcacgctacggcgagttcggacttggctgcctttcgagaccgcacgcttgcgctttttcgaagtgccagcctcgtcatcgccggcccgagaggggttcgatcggctcggcaattcgccagtatagacacgattcactcggccatcagcttggcgttggtgcaagcgggcaaacttggctgtggttagagccttgatcatcttcgacgcctcaatttcagcgtcttccaatgtccgcactgcgaaaatagaggaacacaaccgtttagcctgaaaagcgctttcatgaaggaagcacgcggcctaagtcaaaaacaaagaaccttaatttcggccccggtggggagaactaggcggggaagcccaagaacctctttgccctcgttcacggaaacatcccacacacgggcgagaggagaaatccgaaggaggcaaaactcctcgcaaaggtcccgagtgctcagccgccgggcaaccttgcgaaggagaatgagccgggacttgagagtcccgtcgatttgcatgttcggcttcacgttgatggagacggcagaacgctcaaaaagcagccagctcgcttgagcatcttcggcggagtaggggttgtttatgtagaaccatttctgcatccagttcctgtcccatttcaccatcgacgcgggcactggtcaagcatctgaacgctccggccgcagcatgaagttcacgcagccgaaaacggtcttcctcgggcccgccggcatctgcacgtctttggtcgaggcgcatgcagtaaacagaacggcgaaaagctcggcggtaggggcgaacccacaggtccgacacattcaagcgaaaaccgccagcttcgggaacgccgacgggctaagctggggaagcctaacctcatatgtcgaaagcaccgaaggcaagaagtcatcgcacgggaggcgaagaccaagcagcaaagtatgcggcaaagacaaccgttcacccatccccaggcgagggaacaacggcctcgcccccgcacgatccttggccctctatgagagaaccggatgataccagttcgcccaagtcggcctctttgacaagcgatttgccaaggaagcacgaccatccttcgccaaggcttacaggatcttcgccaattgacccgtccttggtaggcttgcggggggccattaggctcatagcacagaaaagagaggcgaaaagccgaaaggctaggaggacgacgatggcgaaaaggctgaagaaacagaagagtgaagagagcccggagtgagtcaagtggtaaaaaagggggagagcacgcgtagagtgaaaaatggcaggccggtttgggggtatatataacaccgtagcgagaccgttcgcctgccaaccaatcgagctctgacacgtgtcaatgggcagacgaaacggtaaattcccatcgggacgatgccaaacagtaaaaagcccgaatacgggaaaggaaaagtccgcagggcccattactattcatagtaataaaagagactaaataaccccccttcgacgctttgcagcgaatgcgaagaggagttcttctaaaagaaattttctctaagcgaagaaataaacaactttacttgcaagaacgatgtaggtttcggcaggagcaccagtcgaaagggggcgccacataccatatcacatggtttgcacggcctcggccgaagctcctatctcacccttgcccgtgaggggcttgttggcgatatggcatgaggcccttcgaccaaacttgcagaaatcatgcgcccgatgaggattcaagcccaagacgtcaaggttagtcaaggcgaaccctccccatgtcgaagactatggagcaaggacgacgagaggcacggaatcgcagccgagctggaggcctcctggacaaagggcgcaaggcgaagagcgtacgccgaagggggacgacttcgccgtagcaggttcggctccgggaaggccgaagaagctatcctggcccatcaagcccaggggttaattgggttgacaataaccagttggcccgctaagggcccatgaacctcaattacgctatatacccatgtaaatgtccctttcataagggcaaccatgtaaattcccctgcataaccaaaggcctagtagtaagacctgtaatgggggctattaatagccccatagggccatgtaataggggggctaattgtggactaaccgttgctatttatatatgttttaagttaggcctacgtcatgtgtgcgcacggatgattatcgatggattaaaatttgatgacgcgaagcgaagaaaagaagacggtaaaactagtgctttagttttaaaattgatcgaggtgaagggcgatcaaatttgctagtttatttttagtttcgccgtactatcaagggggtaatgacctagcaatgagatgattttaattgccacattaggtcattgcatttttcacttgtgctcacatttcatcacacacacacaatctctttgcatctcactgtctggcctgaccaggggcggtcagaccgaccacatagtggcggtatgaccgatggccttggccggtctgaccggcaagagagtggcggtctgaccggccaggcagtggcggtctgaccggcgggtataggccggtctgaccggccggccatatggtcgggatggcatgctctgggatggccgatcccgagccgccggagccgtattcggtcagaccgagctggtggcggtctgaccgagccgaggccggtctgaccggccacggcagtggggcccaatgatagccctacaatcgctagaaaactagccattgtagagtagcacggtctgaccggccatatacctccggtcagaccgacagagcacagagttgggggatttcgcccccaacggctagttttggttggtgggagtataaatactccccctccagcagcaaggggactctcttagcacccaattcaattgcatacaccccttgcacctctctcgcacccacttgagctttgtgttcatctatctagtgtgttagagggttaattagccaagagtcaagtgcattgcttccatttgtagagctagtgtggcacttgattgatcatctccacgccgggtcattgcttgttactcttggaggttgccacctcctagacagcttgtggaggagttgctcggtgacctctccaagaagattgtagaggagtcccggcgtcggtttgtgagtggtttggagttcaccaccttcggagtgaaggaaaaactaccccgagtgatcgaggcttgggtagtcctctccatggcctggctcccgccttgcccaccccttgacgaagggggcgtgcggtggcttcgtggttgagcggtggagttaggctcgcctcaacggggagtaggaaaccggcgagtttccgaacctcggtgaaaaatctcttgtttccttgtctcatttgattgtcgcatttacatttgtgcaatttatatttctagagacatacttgagatcatatcatcctaggattgttaaacattgatataggagtgtgatttactttcctagagatataattgagccactatcaccctaggtttgcaaaacataacttagttgcttagttagagttgaccctcaccaagcctagcaatttatgttagttttgattaggtttcatttagttttaaatcgcctattcacccccctctagtcgacatctcgatcctacatccgcagccaccaacccccagtggcaaacggattaccagtaatccttttctttagtgagggtgaacagattcaactgggcctaaggaatatgcgcaggggcaatttggtccggtcgcgtcaatatgtgggcctgctcaagcctagtcagcacgaatataataaacaaatgggtgcggtgtcctctggcaaatagccatgttttgagagtgtcttgccccaaaactcactttgtgcggtgttctggagctaattccacgaagtcgcgatgtcctgtagcaaaatttgcctttttaatagatgacgttgttgacttttgaaataacgtttgactattcatcttatttaaaaacttagtgtaaaaatgctaaaatataccccctccgtcccaaaaaaaaactcaacttgacccctcctaggacagtgaagtcgcgatgtcctttatcaagattcgttgtgctaggaggggtcacatccccttctaagttgagtttttattgggacggagggagtaagtcatacttaaagtttatttaatggtaaaacatgccacaacaaaataggtaacatttataaaatattttgagtaagacgaatagtcaaatataaacaatgttatctatttaaaaaaataggagtactaaacaacaccgcacaagatcgtaaaagataattttgttgcacaatataattttgaagctcatgggtcacttacgagacgccgctggccatctccgcgtgccccagcctagcccaccacccctgccgcggccgcggccgccgacgaaacccaagagcctacctgcggagatggactccgagcctgagctcaaggcgccaccttcgcctccacttcttgccctgccacagccacaagcggatggtgcagcgaggccgtgaaacctgcgacagcggacgcggcggcgcccagccgcctacgtgtcgtgggctatagcggtgcccgtgccatcctcatcccgacgccagaagcgcgcggcgttcttggtgtttctcaccccggaggagatcgaggaggacatctatgcgccgccgtccccctcactcccatcagcgccgccgtccttctccccgagttgccaccgttcccctctctctcgtccgcgccgctgtcctccttcccatcgcgtgctcacctccagcatggcggctcggcgagtggagcggaggctaatggagaaggagatggaggcgcggctatggagctcgcggtgcagcggccgccggagagaaaaaaaagagaagaagggagaaaaaaaaaggaggaggaggaagagaaaaagaaggaagaagggagaaaaataaaaaatttctatgtcattatccacgtggcgtgccacgtaagaccacagccaaacaagactttggatcgggttgatacaataaaccaagtttagagatctcaatgtgcgttttataaatttatggacctaactgaaacctcacggcaagtttaagaaccgctggttttactctttcaaattcattttagctaccactaataaatcatgtactaaccatcgctctgtaccctcacaatcgaactcagcctacgaattgctttctcgacttccacgacgatctgtgacgggaagagggtgccagggatcctgtgctgttgtcgacgaagatgaggtcgaaggcgtcgtccatcaagaggagttggaaggagccgatggcatggtcggttcccttgaaccggtcaaagaagaagatgtagcagaggagcagtggtgttcttttctccaaaaacatgaagatgaagattaagttttttacgtaaaacgaggtggtattaaagtataattgattgagttttaattattataaactttaaaaatagattaatatgatattttagagcaattttcatatagaaagttttcacacaaaacacatcgtttagcagtttgaaaaagaatgtgctatgaaaatccaaaatttcatccaactcttattggagaaatgaacggaggagagagggagagaaagaggaagggggggggggggctggtagtgatgaaatataggtccttcccgctataatttttgtaaggcacccgctaccatataggcctcctcaattttttttattttgtgtgttttattccgtgccaaaaaaacgccatatcaatgtcatataggacgaagaccatgtcaaacgtaccacatagacactacgttagataaaaccgccttctaaaccgtctaggatttgatttacattgattttgatagttggtggatattatatatctgatgtcgcggttggggcactaaaataaaactcaactcataattgagagacctaatactttttctaaaaaaatttctgactaggaatgccacgtcagcgaaaccagatatttatactgctacgggacctaaattacatggttttgtatagtttatgggtgaagatttatggtattaaggataagggatgccaaataatctcggtgtaaagttttattttcgggggaaaactcggtgtaaagttgagggacgacggatgaacttattccttttcctcctgttatccaggctcgtgcgagctcatcaggcattcaggcctggtttgccggccatatattataacccaatccaaaaaggaaaaagtatactttgagtccctcaactatcgtccgaatatgattcatgtcatccaaccataaaaccggatatatcgattcttcaaactattaaaaccggtgcaatcaatgtcccttggtggttttaaaggtggttttggcttacgtcacctacatgatggtcttaaccgagtctttgtccaatgtggcgcttacgtggcattagaaaaaaaaacaaaaattaaaaaaaagtgtgacccatatgtcattcgcaaaaaaaggtatcgtgggacccacattgtatcctccctctccttcccttctttttctctccctaatctctctctcagctatcggaacatgaggagacggcggcggcgtcggccgaaagtggcggcaatggctttggggacaacagtagggagtggtgacggcgtctggtggtggtgcacgcacccgtccaaacccaggcgacgtctgcgcggtggggatgaggaggagaaggcggaagaggttgtttgcggggaggatgcggtggaggtggacggcgtagttcagggaggag

SEQ ID NO: 15959 - DNA, 2554 bp, Oryza sativa
ccatcctccatccatcccgtccgttttattgttttgctcatttcgacatggatttagtaccgattatgtatgccatgctcgtaaatttcttgcgtttttagtgaatctaacaagaatctggacctttaggggaattgatgctgttgactgacactggaattgaactgcgagaacctgcacaattacatacctggtggttgtttaacctttattgtatttaaagaaacctgctattgctgggaatggatgcatcttacatttatgtttgaattttagcaagatttaggatgtagattgatgaaaatgtttgaaatgtaggttcctttttttgaggaaacaaattcagcatgcccaaattcgcattatttttcagtttagaatataataagttaacaagaaacaattgcagttccaaagggtgaacctccacgcagttttctattcttttattatgttgttcactgaataaaagttctcccacaagctcttttcgcaattatcaggagcaattgatttatttacaataaagaaaatgacttcttggaagctttggcatagtattttagaaaagtaatttcttttagaatgtaggggttggctagctctttgttgaattctgataaagaggttcaaagtacagcatgaccataaacttgggttacagataaacatgcagcatttttttttctttgcaagggaaacatacagtgttttggaaatgaacaatcctgatcttcacaccaacaatactaagtcccttgtcatgacccgaggccatgacgggataaacaccaccgggaatatagccgggcggcgtcggctcctggagaatggatgtagatttaggctagggagaagaacattgttgagagggagagattagactaattgatattcattgcttgcctgataatagacacaatgtacaacttgacccctaagtaagaacctaatcttatattatctctaactaactaataatcttcttatcttatctctaactaactaataatcttatctcttaacttaattggtatgcgctacctataggccttggcctacggcccaatgcccatgacatccatgctaagagaaataaaatgaatcttgtggtggattgtgtattgcttcaaaacagcacagcagcataggataatgcctttcagaaagtcctcgcaaatttcaacaaacctgaacatataacattattttgttttggcatgtcatgttgtcttcctcctgaaaatcagtacaactccagggctatctgtaccagttccgctagcaaatgcaactaattgtatatatcaacatggacttcatatgataatttatgcacatatcctaatctgatgttttggaccatcttcgatgaagtggaattcttgtttgttttttcttgttaagaatttatcttataagctttatttttgaacagtttgtgctgtagcattaactgtcgttatgggaataagatacatcaaaacaagaaaggtaatgccagctggaataattgctgccgtcaggtattctctctctctctctctgtctctctcatgttattgtgtcccttttgtcaggttctaaatttgctatgctttaataaaatccttctgtagttctgtactgatatttcattgtgcctttcatagcctatattaaccatagccattgtcagcaaagtgtagttatatgtgctatatgttaaacaatattactaactagccctttggctttgattctcagaagtattttttcctttgtgcatggagcccacaaccactacacatatttgagaatacttcacctagtcaagtctttctttccttctttcatatactagataatagatactactccatgatatcttattcccatccttggtgccttggttgttgccttgctgttctgtgcactctaatttaaatatatatagatgacgccttaacatggtctatacatgtctttgcagtgcacttgtactgatattctacatctacaagatatcaaatggtggcaataaggtttatgtcccagtgagcgcggagtgatactggaggccagggtattatggtgcattctctggataattctgaatcgatcgatctgttcttctaatttgttgcatacctgtattctgccatcccagtgatgagaacatcgttctgcataatgtgaattatgaatgacccatgaaaaatctcggcagttcagacactggttcagctaagataccaaattcttctgcgattgtgacatatgttccgcttgtatcgtgtgaaaactatattgtcattgtactgcacatcttataatgcggccttgatacagtgattgcttattagtcattactaggaactaatttgggatgatttggtttgtttcaaaatttttttgggacgattggctcgttcaaaaacaaggtgggatgattgatgtatctatgattggataatctgcagttccattatgcagagttcacaaaaatgattcagaaagtgtctcattattcagaaatgcagagtcccatttcttacccctccaacgcggagta

SEQ ID NO: 15960 - DNA, 6277 bp, Oryza sativa
taggctggggttgaaactaaaaccacagctcatcatttgttttaagataagcccagcttttcagaaagcaacagttaatccatgaccagacgctctgcactctcttctgttctctgttgccttgcctagctatgccattgcttgcagatttgcaacagaaattatagtgagcatgacaaatgattattaattcagtaagtactactagtaccaagtttgctactgtcgtgatcatgcaacccaatcatctcatctcgttattgtgaagtaaattctctgaagatttgttaagctgcattgcctttttctgctaccacttggttgtcgtcgatcgctgcctcttgtcttgccctccgccgcgtcctctcacggaggaactccacgaggccccggagcgcggcgtcggcgtcctcgctgcgcagcagcatctccgacacctcggccggcgtcacctccacgccggcgagcagctgccgtatctccgggaacagcgggtggtcgccgacgaggaagtagttgtgcgcgagcgtcttgaacgcctcccagccgcagtagcccatgtagacgtgcatgtccatccgccccggccggagcagcgccggatcgaggcgctccttgtagtttgtggtgaagacgatgacgcgctcctcgccgctcgtggaccacagcccgtcgatgaagttgagcagcccggacagcgtcagcttctgctgctggagatctcccgcgcggcgcgctctgggcggcgcgccgacggcgtcgtcggagtccgacgaggagaagtcgaagtcctcggcctggtcgagcgccgccgtggtgatcttgtgggcttctcttgggttggcgtcgaagcagcagtcgatgtcctcgatgacgaggatggatttgttgggcatgctgatgagcaggcgctgcagcgcggcgttgacgcgcacctcggagaggtcgaggtcgtagaggttgaagcggaggtagttggccatggcggcgacgaggctggacttgccggtgccgggcgggccgtggaggaggtacccgcgtttccacgccttgccgatgcggcggtagtactccttccgcttcaggaagcggtcgaggtcgtcgacgatggacttcttgaggtcgggttccatggcgatcgtgtcgaacgtcgccgggtggttggtggttgaagccgtcccacgagcgcaccttgttcatgaagatcctgagcacgcgctcccgccgctggagctgctccgccgtggccatgacgaagggactgtagcgctcgagcgccgtgtcggtgtgctcggcgtcgaagctgagctcgaggcactcgcgcggggcccggtgaccgcggtcaccaccacccttgccgcccctcttgcagtagtcgccgcctccggtctccatggacgtccacctgaactcgacgccgtcgaacacatcggtggtggagtccccgggctccaagcacagcagtgtggtccagctgctgctcccgtcggcctccttgcagcgtgagcgcgcgaggctgagccgccgcagggcgcgcgggtcgatcttggtggcgaggtacgcgcgcgccgcctcgaacagctggttctcgctgtacccgccgtcgagctgccgccggatcaccaccgtgtgccgctccttctccgacgcgccgagccgcgcacgaacgaacgccgcgccccaccgcgccgcggcgcggagctcgtcggggagcagctcccgcgccatagaccgcgccagcacggcgtacgccgccaccgacgccgccgtcgccagcgccttcttgtatgcgtcaagcaccctcccgtgctgcgcccctgcagccggcgacggcgccgacgccgccgccgccgcggcggccagtggcaagtgatccatggctggcagctggctacctcacccacaaacacaagacgcccaaggcaaatgtcacgtccattttatggcacaaacaagtgtggtttcgtggaaattcccaaaaacagggtgattttggcgtttgtttttgtttgtttgcttgacctcatcaagtctcgtcggatcgaattgacttaggccattcacagtgcaaacaccggaccaagtagcttagtccaaaagaaagccccaaagacactcattcccatagtgcatgtatcctattttgcgtgacctaactggatggagatactgtgcaagggaataaaccccacaacgcgcgtgacccggttttaaagacacgggcgagtgaaggaaatctattccttcacctacccttgttcccgtcgtcctcctcgcctcccacgccgctcctcgcctcctagcctcccacgccgttcccctccaagtccgccgctgcgccggttcgccgctgcgcctcctcctggtccgccgccgtgcctctcccgacggtgggagcagtgggggcggcggaggaggaggggaaaggctgctgctccggcgtcctcctcgcctcccgtcgtcctcgtcgcctccctcgtcgcgcctccttctccgactgctgcggcggcgagacgcctccaccgcggcgacctcaccgagggagatcccgagcagccgccaccgccgccgcgaggaggaggagcgggttcgccggtcgtcgtggcgacagcggtggcggtggatctatccgccgcacctcccctctccctctcccactcccttacttcaccgcgtcgcagctgcagcggcttggcatcggcggagccgcaagcgcccatggaggagccacgcggcaccggcggcgcggggagtgcggcagccgccgccgccgccgccagttcttggcggcacgcggacgccggtttttggcagcacgcggacgccggttcttggcggcacgcagacgccggccgccggtacttggctcgcccggatccgagttgtggtggcggtcgtcaacgcggggccccggattcgccaccggatttgcgggtcgtggcggcggatgtggtggccgcggcggaagcggacggcgcgacgccgacgggaagccgcggtgaggaggaagctggcgcgtggtggcgagattattgattgttgtttttttttgcatgtgagatgtgttgtttcttggtgattcctcttctgtttcttgggacggatcgtgtaattttttctgcgttcttgcttggggtgtttcggtggcgggaagaatcgtgggcaaattggggttttcttcacttgatgcggcgcaaggggacggcgcggccaagaaccacaccccacagtgcgcgcacctcgcttcttcctctccttctcgtgccctcgttttggcttggtttcgcgtggctctgctcgggggcgaggagctctgctagggggcgattccttctgccacgtatgcttcaatccgagctggcaccgtgtagcaccgctccagctaggagcactgtgagaggcctcagcaaagagtcgagtcgtgcagctgatgctgccatggacctcgattggattgatttcactcgagaaagaagttggcatgtgaaaaaggagagggggtgtttacatctatggaagttttgacatgtcatatcgggtattatataggttgttgtatagggcgtttggacactaataaaaagtaattacataatccatcagtaaaccactagacgaatttataaagcccaattaatctgtcattagcaaatgtttactgtagcaccatattatcaaatcatggagcaattaggtttaaaagattcgtctcgtaaattagtcacaatatgtgtaattagttattttttaacctatatttaatactttatgcaacatttcaaacgtttaatgtgatcggatgtaaagtttttctgtggtaaataaacatggcctctttgatgcggatgcggcacaaatgacagtggatgatcgatcgaatcacggcattaggggaccgacaaatgactattattattggatgaaactatacggcaaaggccgtggtaccgatcacttaatccactgtgattaaaaaaacccagcaaactatatacccgtggcttgtttctattaggcggccctgtttgtgaacactgtgtgcactgtgcagtgggaaggtaaagtgcacctttttctcgcatgttgtttctcgcatgttgtttacgggtgaaaacgggatgaggattttcctaccgcctatctaacccaaagcttacgggaaaagcatgagaggaaaaatgggatacccgatattatccgagtttaaacttgaatctataaaataatatgggttaagatacgagaagaattgtatccgctcgtataaaatctattataaattcacctataaacataataaaagattaattaatcactatttttgtgtgctcacacgtaatattatataatttatttttttaagtaatgttttattttattatctaaaacaaaatatctataagttagatatataaataaataaccgtttccgaatctgattcgaagaaaataatatggaataggatacgggatgagtaataagttatccggcactacatctactcggttctgaatttaacaggagatatatgagaatgatgtgatccgaccgacccgatccattttcgcctctattttcggcttgctttcttttttttttttctgtgagatgctaaccaacaggtgtctgcgtaactgcgttcacatgaatgttttgtaacgtagtacattctcgaatttgggctgtttttagataagaggtgtaaagttttaacgtgtcacgttagatatacggacacacatttgaagtattaaacgtagtctaataacaaaaacaaattacagaatccacctgtaaactgtgagacgaatttattaaacctaattaatccatcattagcaaatatttaccgtaacaccacattgttaaatcatggcgcaattaggcttaaaagattcgtctcgtaatttacacgtaatatgtgtaattagttatttttttgtctatatttaataatccatgtatgtgtcaaatattcgatgtgatagggtgtaaaattttacaatatctaaacagtgccatgatcgttttaaatcagtctgcagcccgtctaaaaatgtagaaatacatgggcttgcgattcattactcacttaatttttttagagtaaattgtatattggtccatgttttttaactatggtttcacattggaccaccattaactgaatgctttcactttacaccagattttattaccaaaatgtatcactttggaccagtggcccacttgccagtgtggctgagggaaaaaaaaggaaacttctcggttgggaaggaaccagcgagtccgctggctcatctcctaccacaccgtcgatctctttccaacttcacccaaccatctcatggcggtgtgggcagagatcacgctaaagccttgggggcaacatggggagcttgggactggaaagactcatgtggaggtcgatgttaggcgacgtgagcaaaggggagctcgtgtatgtccaggtacagcagaagtcgagtcacggaggcgacggcggtggagaggagcttgagctccgggatagcgcgcgggcatcggagtagccatggagatcgaggttgagccgggacagcagagaggagcttgagcccaagtacgacgcgctagtgctactgaatatcgaggtcaagcgaggtgcgacgacggcggagaggagctctagctcggggacgacgtgcgagcgtaggtgaagaacgaagtcaagctagcgagggccgacggcggcggagaagagctcgagcttgaggacggcacgctagggcgacggagccgcgtaggtcaagctggggtggtggataggagctcgagctcaaggacagcgtgtgggtgctgctgcctgctggtgcctggaggtcgacgtcgagcggggggagacacggcagaggtcaaggccgggggtggcgcgccggcatgggactatgggagagttcgaggtcaagacggggcatgacgaaagcggagattgaaattgagactgggaaatgcgtgcgtgcgggaacaggcggaagtcgaggtcgagccagcggacgacatcggcggagattgaaatcaagccaggaaatggcgtgcgagtgtgggcggaagtcgagatcaagccaccggacatcgagcttgagcctgagaccggccggcacgacgggaacaaagtcgagctagcgtgatgccgtgttggcggaggttgaccccgtgctggctggactacgagcttgagatgcgcgggcgtcagctctgttatatatgctcgagctctcttaggcgtcgtggtct

SEQ ID NO: 15961 - DNA, 6477 bp, Oryza sativa
agctctcttaggcgtcgtggtctttgtggtctacagccatcgatgaaaatagttgaagatgatcagatagggatgagagattagctctgagagactgactatgggccatacgcccaaagtgaaaggttttggtataaaatctggcctaagtgaaaacattatattaagggtagcccaaagtgaaaccatagtaaaaaaatatagtccaacatcacttttacaggcaacccagattacttagcagataagcctcctctttctcctgatcccggttcgaatcacccactctaccacgtggccccgctctcctccctccaggacccccgtgtgccgctgcccttcatcagtggtcatgccctctcccttccttacttcggctcctattagatggcctaatcagctaaaaaaaccaaattttaaattttcaagcttaattttgagatattttcaacgtagtttcttttttaaaattggcttttaaattaccaagaacacgtttataaaaattttatttacaaatttatttttattttctaataaaccgttttggcttattagcgatggagaccttcttcgggtctgttgtcgtccatttccatcaacttcaagagccttgcatcgatcctcgcttctcaaccacatggctgatggctctcctcctcccatctcaacaccaaccctcccatcatcctcctctatccatacggcactaccggtcttatgctcttagcctgtattcggtaaccttttttaacctatctccctcgtttttcacgcgcacatttatcaaactgctaaacagtgtgtttcttttgtaaaaagtttctatacgaaagttgcttaaaaaatcaaattaattcatttttgaaaaaaaaagctaatacttaattaattacgtgctaatggaccgctccgtttttcgtgcgtgctgtttccggttgggaacaaggaattgcgaacacagcttacaacagcgttgttatccctctaaagctaccctaatcgtccccttaccccctcccactgactccaacgccggatcgtttattcgtgagttcacagttggagtctagggtcgtcggtcagccgccagcctaccaccattgaggactcatggagaagttgctgccaatgtcgctgactcactggcgaaagtccctctcccccccccaccacccatggcatgctctctctatcgctctcttatgtctccctggactagagatagacgaaaccatctggctaccggatcaacagccgacgactttgaacaacccactgagatttaggaaaacttgagtctgatagtaaagatggtatagatatttaaggcccccttcgattcatatgattaacaaatgagtttttatagaatttaaattcctctggattcataagaaaggaatacaacttctcataggattgtattactatgctttacatttcatagaaaaatagcaagaggtacgtactctttgtaatatttcctttgtttttcctatgacactatcaaagggtttgttggtatttcttaacgacaatactagaaatataattcccagcaataacgtagaaatacttctggtatattatggttacagagttcatccgcaagcgcatggatataccattgtagcatttcactcaagagtattctaagggtatcgtttttattttatctcgtaggaagatcatgtagagagaactcaagtaataatttatatattacttgtggtaatcatattctaagtaggggttaagataattcatgggtagagtgacacacaagcattactactcatcctcataataaataatctaagctaggtggaaagaaaagagaaagagaatctattcctatatttctaatatacatagtatatatacattctagttaattgatatactagctaatactctctatccgatgccctcctggtacttcgagaagccacccctaactgccgagttccttatgacagcccgtcatgaccatccaaccggggctaaatacggaggaataccctccccaggaaattaacttaggattatatataggcgtggaggaatacccgtactgagctgtcaccatcagcggtccacctctcatccgcaatatataccccaaataatgatatcccgtaatctagacaccacatctaaactactagatactactctaatatcattgtcataacatagagtaattgcataagcaaacattatacccgcaccaaagcatctcccagataaactagcagtatattcagtataacaagaacataatgtaaaatgtaaagttagtactcatatactcagaaagtatttcaataccagaaatgtatatagaagagtattctaataaaagtacaaagcttacaaaagaggaaagaaaagctactagagccagacccgaactcttccgaagacttccggactcctgattcctattctaattctattctaccagctagatactactaaactaaacttaagagaaatgagaaagctcttacttgaggtgtgtgttgaagtgaagagagtgagctccttatatagaggtaggtatgacggttgtggaaggggaattgtccgaagtgccctccaaccgtcattgggatgcaatcctggacatccgcgccaaaacctggatccaacggcgccaggattggttcgactgaaccaccaggttcggccgaacctggggctggcccaatccagcccaatttcggctggtggcctcctctattgctcctctccgcggacttgtgaattttggcctaattcatcgtgtcaattcttagttcttggcccattcatacataagtctggtcctctacatcgtctgattgatttatcgttggtgtttgatgtcgattctccttcactttattgtcattctctgtaaaaggttagtagacataatactagtggaatattattgttctaatatatttatgcattgcaagcatcactagttctctgctgttttagtaatattgacggtcgaaactgatcgataacgaccgtcaacagagttcctatcttttttcatgtgtgttttaaattctagtaaaattaaagaatcataccgcttcaattcctacgtttttcttatcactaaagaggcctagaaaacggttcatctcctgtgggagttcaaattcctcactggcctggctgcaagcctgatcaagttaccaaggcccatcacactatatgaggaattttttttatttataattttttttattaaaagttttacaaaaataattttccattttgaaaattgacggaagtagtcgcctaccgccctctgggagggcgataaaatcgccctctcagagggcggcgaaaatgacgtggcagacggccgtttgctctcgggcgacggccgtcaacgaaatttgcaggcggcccccttgccgccctccgctagggcgattttatactgtgcggggggccgcctgcaaatgggcggcgagggggggggggcatggaattttgcaggcggcccccttgccgccctccgctagggcgattttctactgtgggggggccgcctgcaaatgggcgggagggggcatggaattttgcaggcggcccccttgccgccctgggggagggcgattttatactgtgctctatatttttgtataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatataaaattgtagtgaagaatgttctacataatctcaaatctagattacgtattaccaatgaataggtttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcagtccgggggtacggcacggccaacccgtcctgcctgtataggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaaagaggccccagtaccgaagatcccggctgcaaatcttgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcgtgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgctcgaaggcaaatgaggtcctgcgaggatggaacatcaagttacgacggggtgatgttttcgtagaaaaatagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcatgggatacgcgtccgtgacagcggcaacgtgcggctctggggcgtctggagtgaaggtcacacgcgcacgagtgcgaggaaggtaccagcgaaggtactcacggtagttctcctcagtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacattgcccggaaacacctgcctaagtccgaactatctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacatgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtc

SEQ ID NO: 15962 - DNA, 1968 bp, Oryza sativa
ggggggagagatatgggagagagagggggaggaataaacttttttttttggtgaatgacatatgagtcccacattttttttgtttttattctaatgccacgtaagcgccacgtaggacatacttggtcaagactgtcagtccgtcacgtcagccaaaaccaccgagatattgtttataccggttttgatagttggaggagtcgaaaaccggttggaggacatgaatcatactcgggcaatagttgagggactcaaattatacttttttccatccaaaaatgggcggggcctagacgggcttttctgggccctgtggctccatgttggtctacccaacccaaccacccactgacccacagtcccacaccgccggagaagaagactagcgacgcgaggcgaggctctcggaggagtactatcaccacccaccgccggcggggaggaagcagatcatggaggatttctacgtcaccatcccgtatggcgccgcggtcctcgtcgggggcgtcgccggctacctcaagcgcgggagcaaggcatcgctggccgcgggcggcgggttcggcggcgcgctcctcctcgccggcgcgctgagcgccagggccttcgcgcgcggccaccccagcggctccctcttcgccgccgtcctccagactggtccgtttctgctagttttgctacagtgctactcccccccatcctccatccatcccatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggtgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcatctggtcgcaaataagcacgtatgataataacaacttatttacttacagtgaactggagcaaccaagccttgctaggcccgactgtagagtacggaggaagggtgttggtcggtcctaggtgtggaaggcgtatcacctgctcgaagcgcgcagtgatatcctccttccacccaaaaaaaccgtccacgggaccaactggtgctcccgtcagcggtagcccgagcaggtacgacacgtcctgcagtgtcggagccatctccccacagggaaggtggaacgtgtgcgtctcaggtctccagcggtctacaagagcagcaaggagtgaccggtctgcatcccaccgcttcgctgggtcacggtcgtccgccgccgcctcaacaagcctacaaagtggtagaaggcctgccgcacgcaacctgtatagagcaaatttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcaca

SEQ ID NO: 15963 - DNA, 3133 bp, Oryza sativa
aaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgcagcttcggattcataccagtgcaggtacatccaccatccgctttcaagacacattcttgcacggcttgcttgcgatagataccacgcgtgctcctatcaacacacattatttcataccgatgcacttgtgtgccttgagcaacaactctatgtctccgtacctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgtccctaacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcacaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaataggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttcgctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccgtgtaagtagcacttgtgctcggtcacaatgctaactttccaataatcattccatttacccttatatgcatggacacgccacggcaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcctaaaaataaccttctgttgcacgactcactacaactgacactgacattgtgtagacttcttggtctattctaaatcctctcaataaccaactataaattgactgaaatgttctctccgcaggcctatcgatgcccttagatgtcattacaaaatctgacagatcaacaccatctggaccaaatctaatatttccttcaccatgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctcctcttctgctgccctcccccctctctctctctcgttttttttggatttttagtgaatataatgaaatttcacagaggagggactgggctttatagggggaggcaaaaatcgccctcccccagggcggcaagggggccgcctgcaaaattccatgccccctcgccgcccatttgcaggcggccccccccacagtagaaaatcgccctagcggagggcggcaagggggccgcctgcaaaattccatgcccccctcgccggccattgcaggcggccccccgcacagtataaaatcggcctaacggagggcggcaagggggccgcctgcaaatttcgttgacgggcggtgcccgaaagcgaacgggcgtct

SEQ ID NO: 15964 - DNA, 14827 bp, Oryza sativa
tttttgtaaaacttttaataaaaaaaattataaataaaaaaaattcctatatgagcgagtgaacatgggctgtgctgagatgtgctctccaggccgagtggcatctggcagctctactcagcgaccaccgcgaggaagccgccgctcgccggagaatgacaactcccctcaagttcggtgaagcgacgggtgcgttaaactgtattgtcattgtagtgagatacctctagaggtctttcgactacttttacaaggtagtggactaaaacggtttaggttgaaagtctcacccattcttttgtttggtattagatacttccctaatattcgtatttttttattgtcattgtaggtactaaagcatattttaatccaaccttcatactgcgattgttattactactccattcgtcttataaaaaaacaaatctaatacatgatgtgatttgtttagattcgtagtatcatgtctttgttttttatgggataggaaaattagaaactaatttgggatgattggggctgttaaaaaacgacaggatatgatctgtacatattctagtattacatctttcccttttagggacgaggaaagtagaaactaatttgggatgattgggttgttcaaaatacgaggggggatatgtatccatgattggataatttgcagctccatcatggagagtttataaaactgattcagaaatgcggaatcccatttcattcccatctagttttcgtcctatgatcatgttctcatgtaacatcgtcttactggaccagtatgtactctttggctggtatgctaagttgagctgggttcgacactaaaaaaaaagttcatcatggccaggctatctggactttgcgcagttaccttagtaatgctattgcaagacaacagcaagaacctgttgacgctttttcgtggccaacacacgatcacctaacgatttgcggtgtaatcaacggagtcgtcaaaatcgatagatcaaaatcggctagtgaaaccgatttctagattaattcactttcgcgaaatcaagcgactaatttacaagcaaattagcaaagaggataaatatcgtactatgaacgactagtttccgagcaaactagcaaaggataacctcctcgctttcgtggagaagcacgaccatttttcagcgcaaagcggcaaagattaactaaattctagggttgctagaacttagccatgaaaacaaaattaaaaagaacaaaaaaaagtaaaagagatgaatagtgatcgaaattgttcgggctttttttctgccgacgcatggactgactttataagcaccacaggccgcatcaacgatctcctttttctgctatcgttccttccttccttcctatccggattccatactggtatactgcatgcaatcaatcaatgatcttctataatccacgacaccttgtggcctcctgtagcctattcctccacaaaggatccggatgcctccctgcatgtaagctacacactgaccctatgtggactaatacttgcgacacacctctgattacatgtcaccaaaccaggttaattgctgcagccacacccaacagtttgcacacacgatctcttagtgcatcataaattcctgcacatgcaaactgagtatattttccaagtaaatcatttgacagttttatcattttattcaaaaacaatctggcctgcacaaatgtactaactataagccaaattatggtgcaaacacatgcccccctgtttttggtataattagaacttttgttttaccgaaaatactagaaaaattaaccactcatgattgactatactctaaatgtgatgttagtcctaagccaatccatagtcgtcctcccaaaatgatacttaaataagtatcgatcctgggaccacccatagtcgtcctctcaaaacgatactcataagtattcgtcctgagaccaccatagttgtcctttaacgatactcaaacaagtatctgtcctaagaccacccataatcgtcctctcaaaacgatactcaaataagtattcgttctgagacaattaaacttcctgcaatacactaggataaaatatttctagtatttttcactgagaattttaagcaaccttcacccctcataaagtaaacaaacttattattcccaaaaccaatagaaaaaattgtttgccatactaacttacctatttgaaacgatttttcacttattttttttataagccttgactactctagtttaatcaagacctacaccctgtaaaagcacctaatctatagataggcgatataattcatcaaagtatatttcacaacccatcaccgaacttttccatcttacctagtctttacaagtaattaccagagaaactcataattcatttgattcaaattttactactaattcggtcatccctaatgtccattaaaccgaattaacctaacctccaactcgatctggtcatgatactacactatcagtagctattaaccaccagttactagctcggccagaacgacaagacaagcccctgtctccattgcattcagctggccgaaccatcatactccaatgacgcatgtacactactactagaacgtagcaccaagaccacacgcatgcactgtgtacccctatcagaactaccaggagccagcactactgcatgtattcaccacggtgctactactagataaatcggcttccactgaattgctatgcaaactaacactactatttaagccgatttattcaatataatcacacctctactaatcagaaaacaagaaaactgttgcgtcaagtaatttgctttgctattttcctccctgaatatatgacgaacagtaaaggtatctgacaaattaattaaatctaaacatcggtccaaataactatttattttttttagtccataaaaacactaaacttcccattaatcaattgaactactaaaagtgaaacatcaaaagcatatgcatccctcgcaccaatatttaccaagctttgcaaaccgaataatagagcatctactcggtctaaagtgcaagaatactctaaacggactgatagggaccaatgtgtcataaacaatattacttagtgaaattaaaacagtaccagctccttgccaactcacacaaactatatacgaccgaaataatttctaaagagttataaaaaatcacggttatttctagcacctaaatgtttcggtctctaaaagtgataacaacacctacaactaatagtcaatatgcaagacaatacggtaacatccctccataatataaagattgatgaaccctgagttccactcgtcactcaaggctgttgttggcccgatctttcggtgagttgagataactacgatttgtggaaaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctatcaaaacccaagaaactctaaaggctacctagctatttaaggaggtgggaggacctctaggtcgtcctccacctggttggggcgcaccccacatgggccccacttgggccggggtcccaaacgaagttacaagtccattggcccatgacaggtgacgcagcaccttgtttttgtatttgcggccaaacgagatggagtctgctgatgaggccagatctgttggaaagaggactccgagaactttccatcaagtactcatgggacaaaaacggaggtcgtatgcagattcggtagccgtgtgaagtcagcagtgtagcaggtggccgaatcggattccagcacttggaggacttgatcttgatatcatcttgttcatccatgatgtgagctatggttgtatctgtagtagccatggtcacatcatcctccccttcttcacggaaaaccgtcctcggtttttccatatggtgctcgccacatagtccattcaaaataacctgtttcatccaatcaaaactagagaaactcgaagttgtgtgattagcaataacatgtttctctaaatccgaacaaatgaaaactctatgcaccaaatatattcctctatcattatattcgccaaagatatggaaaatagcattagttggacatggcaaatcagacttagcaaataatttctccttcaaattatcgagctcacaaaaatcatcaaaatgaacatagcccaaaatattgaaagaagatctcaattcactctcctctacttcatcatcaatgtgaacaacatgtttaaaattagcacacaatgaaacactagatatagtatgtttattcactagttatggcatggatataagtgaagtactatcgcacaactcttctttatcacaaggaacagaatgcaaatcaacttgtgacaaaggcaattcagaagtaggttccactaaagtttgctctaggtcagcatggaaagtggaaaaatgtaattcattagaagcatactcaccttgagtaatttctgcaccatttaatttaccttttatgccctcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttatttcccacagtatgccatcaaaaagatgcagaaccggtacacttattactagcagccttaatcatttgagcattagaaaaatcatactcatcaaattgtttttctactgctagctcccaattaacataagcggcggaatcatacttaccatcaaaactaggcaatttagattctacccttgtaagatcattatcatgtatcatgcgtgaagaagtcgctatatctcgttgatggtgaagatgttgacattgagcatgaccatcttgtttccccttgcgcaatcctgccatggttagcagcaaacaagaaacatacacaagaatatacacgctcctatcaactactaggtagtggcagctcaaatctcacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctatggagctctgggtaggcttaaatatgtagcaaaggaaagcaatggttcaaatcagagaatgcaaagttgaataatggttcaaagtcaagtaccatgctggtcctagactagatcgtactagagacgcgagcctagagacaaatggtaccacaagatagcactaggaacaacttatgcacaactctgatatatgaaagcaaattcaaagatacaactgatttttctcttttccttttttttttcttctttctttctttttcttttcttttttttggtgcggcttttctttttcttttttttatgcacctttctgccttttttttcttttttttggattttttaacaaaaacaacctcaaggactataaagcaagtttacagggactcaaatgtaaatataaaaaaatacagggactcaactgtaaatgtccaaactcaaaattaaaactatacaaaaatggaatgctctcgtcccgtagattccgtttttgcagacggatctccaatccgatacacaaaaatttttcaccaagctgtctataccgtgaggagaggggatggagggagtcggactcaccaatgccgagaggaaaccgtggctggagatctcaccaatgtcgatctatggaaaggctccatgtgaaaacagagacaaatccctccctttttcttttctacgttggctaccaaacagaaaccaatccaatctaatctagacagatctctcctccttccttcttcctcgcacacacatgcacggcaaaaggaacacacggcagcaacacggcctcgggacagcgcagaatcacaccacaaaaaactagatgcaactcagcaacaacaaaaccgaccgatagaaacttctgaaaaactagaaaaatgaaaccttggcggaaagacgattccgttttcgtaggtcctgacgacaacaaagcacacgacgacgatgatgacagtggtacaaaacgtgaccagaactcgaaactctaaacgaactaaacgctatgaccagcaacacgacgtgacgatgcaacacaaaattcaacaaagcaaaaactgaaaaaaacaatgcaatggcacaatatggctaggtgaatgatacgaatttttttgtatggctattttctggttataggaagataaaaactcaccgagcaacgaaagctctgataccatctgatgaaccctgagttccactcgtcactcaaggctgttgttggcccaatctttcggtgagttgagataactacgatttgtagaaaaacattgacgatccgactacaaccgtacgagacgttgtgttgcgccttagcgatcgatacacctctccgtgggttgttgatcttgccaactcacacaaactatatacgaccgaaataatttctaaagagttataaaaaatcacggttatttctagcacctaaatgtttcggtctctaaaagtgataacaacacctacaactaatagtcaatatgcaagacaatacggtaacatccctccataatataaagattgatgaaccctgagttccactcgtcactcaaggctgttgttggcccgatctttcggtgagttgagataactacgatttgtggaaaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctatcaaaacccaagaaactctaaaggctacctagctatttaaggaggtgggaggacctctaggtcgtcctccacctggttggggcgcaccccacatgggccccacttgggccggggtcccaaacgaagttacaagtccattggcccatgacaggtgacgcagcaccttgtttttgtatttgcggccaaacgagatggagtctgctgatgaggccagatctgttggaaagaggactccgagaactttccatcaagtactcatgggccgaaaacggaggtcgtatgcagattcggtagccgtttgaagtcagcagtgtagcaggtggccgaatcggattccagcacttggaggacttgatcttgatatcatcttgttcatccatgatgtgagttatggttgtatctatagtagccatggtcacatcaaagacccatatgatatccaaggataagaataaaaccatgagggataatcatacatacctgagaattggttccatgacataggtatcggtggcataagtgaagaatatgaataatgtggtggcgaaagaacctgacgattggatacaaaccattgatttggtgcatgcctctgaactcccttctcctcttttgcctccacttctcttttaacatctttttcattatgcacctgaacacttcctttaggaacccatgccatacctctatccctcagcttttctgcacttagtttgtgtaactgcttcttctgccaatttgataagatacatgagtgtctcggttggctaccattgcccacgaagctcttcggcggattctgatttattactaactctgccgaagaagactctcacttcatacttacattgtgtaaattttctagttgttgtacacgtgcatgccccccaggttcaataacctttttctgaactgaagccttttttacactcacacgtgctaatcgcagcaacgctctcggcgacggcggctaggataccgataaacagatcgggaaagaaagacaaaaattatggatagatcaatttcggccagatcaggaccgaaactctcttccccagtggagtcgccaaaatatgttgacgctttttcatggccaacacacgatcacctaacgatttgcggtgtaatcaatggagtcgccaaaatcgatagatcaaaatcggctagtgaaaccgatttcgagattaattcactttcgcggaatcaagcgactaatttacaagcaaattagcaaagaggataaatatcgtacttacgtgacgacgaacgactagtttccgagcaaactagcaaaggataacctcctcgctttcgtggagaagcacgaccgtttttcagcgcaaaacggcaaagattaactaaattctagggttgctaggactcagccatgaaaataaaattgaaaagaacaaaaaaaagtaaaagagatgaatagtgatcgaaattgttcgggctttttttctgccgacgcatggactgactttataagcaccacaggccgcatcaacgatctcctttttctgctatccttccttccttccttcctatccggattctggactggtatactgcatgcaatcaatcaatgatcttctataatccacgacaccttgtggcctgctgtagcctattcctccacaaaggatccggatgcctccctgcatgtaagctgcacactgaccctatgtggactaatacttgcgacacacctctgattacatgtcaccaaaccaggttaattgctgcagccacacccaacagtttgcacacacgatctcttagtgcatcgcaaattcacgcacctgtaaactgagtatattttccaagtaaatcatttgacagttttatcattttattctaaaacaatttggcctgcacaaatgtactaactataagccaaattatggtgcaaacagaaccatttggtacagaaactagtgagtgtggcaaaaatgttgctacggtagtgatcataacggtggtgcgactaaattataacagtgttgattgatagcaatagtacaacggtaaattctatatatagaaacaaatgataatgtttgtatatccaactctattatatacaaaatagaattgcatatatagtaatacgagttaaaagtgagtgtgtaacaaatcctatttgaccagctcgcgcaaatgggctagaccgccagagtaccctttatcttatactagtctcttctgattttatctgggtgactaattaggacgaagaggaggcactaatcagaggaccaaaatgtggcacccaagcattttttatcaaatgtggttagtgtttggcaacacaggcaagacaagaggaggaagagatcatgggggctgataaactgaaaaagagggatttaactcttgggatgtagaaagctgagaaaaggcttgagtcctgacatagtggtcacctttcttttgggggagagaaattaggatcaactcttacctttccagcattcctttgtactatatgggtttattttatttgccagggtattttcataagaaaatgaatagtccgagggggaggttttactggcaaggcactgccaagaaacagaagtaccacttcatcaaatggcaagctttgtgcaggccaaaagattttggggggctgggttttatggataaatggatactgaaattggagtcaaataattcagagatgtgtatccaggtcctcaggaagaaatatatggggcaaaaaagttttttccagagtactgcaactagggggtcccagttctggaagggtttacatgaatgcaaaatgtggtttggaaatttgattaaaaaaaagtgggggatggcctgaccaccagcttctggaatgatgtgtgggttgataaatgtcctctaaagatcctgttccctgacttgtatgctgtggactctcaacaaaatgctacattcagagatatttatcaggaaggggcttgggagttgagtttcagaaggaatctcaatgaagaggggagagctcagttaattgagctgctctctaaaaatccaggatgtggtcctgaatggggggggggggggcactataaagtggtgtggcctcatactaagaagaagcagtttacctctcgattaatgtatagactcttgacttttggaggggtagtggattcagacatgcaggggatcaggaggagtaaagttcctttgaagataaaacattttgtttatcatgtgggcaggggaggattccttgtgcctttcagctggttaagaggaactggaagggaggagagaataaatgcagtgctgtgtggggtttctgaaactgttaatcatgtcttgttcaattgccctattgcaaaatttacttggtgtgtggtcaaggaagttttgcacttccctgcaatccctgtctctttctgggaaggcttagatttgttaaaacagaagttaggggggaagcttggtgtggtggtgtttgctagttggatttgggtatttggctaactaggaatgactgatttttgagaataaattgcttaagtctcctttgcaggtagtttacatgataatttcgctgttacaacgctggaggctcattcaaaagaagaaaagaagaggttcgtttggagcagctgattgaagacctgatgaccaaactgcaacaactccgtccttcagggaggctgccaaatgatttagatgttggttaggagtagtttttatatgctgatcttgggggcgtttgtgttttctggaacagggtgtgggtgccctatgcctggttgctggaatttttccagtaacaacgatgctgtaaaatcaaaggtgttttttattattattctgtgatgaacaattggcatcggagattatcggttttgatgtttgaaatttattcacgtagtggttttggagatgattggatttacaggtgaattacaagtgctgttattttatgttaccggtcagaccgggcagtggttgccggtcagaccggcgtgtatcgcgcggtcagaccggcgcagcccgcggtctgaccggccgactctgtgtcgatttcggtttcgggttgtttgtttggatatccgtgattgtttcatgcttatggcttctagatgaatactatgcgtatgtaatactgttgtttgctaacaataagtcaagttggagatagcttggtctcggaatatggtttctttgtttattttatgtgtaggtgaatcgatgcctcgggagagtatttacagtgatggaccgggagttggcttggggataagacgacgtccgtgatggtcagagatcatgcgggatactaaggctaaagttcaatacacgtggttggtgaagattccatatggcatacaatggaggtattgtgtgcgtatgggatgcggagttgaatttggaaggagtccaaatttggtatgagtggttatgtaaagtttgtttcttgtactaaagggtttcctaaggtgtttaggacttctagtatgagtttggttcgtggctttaggctgcctacctcagggtataaatagagggggagcgtgaggcttcctgagattttttagagcaattgagctgatagttgagtcaaggtttcgagtttccttgagatttttgtaaggaatgctgttggtgcactttgtaaacatagggagaatcaataaagtcgtcatccactttaggagttcttcgatttgtttttcaccgggtttcgacggtctaactggcgacacaccggcggcatcgtggcggttagaccggcgggtgcaaggcggtcagaccggcggcggcaacaggggcgacaggcgattccagggcggtccgaccgagagacaaggcataggcacagtcagaccggcagatcaatcttggtcagactgatctccgtcgaatttgagggtaacttttatttccgctaaaagttttggtttttgggtataccaattattcaccccttctggttggcttagttgttgtgtttcgatcctacaagtggtatcagagacttgttttcttctttggattttaaccgatctagagttcttgccatggctgttagattttcaactaagcctcacgttttcgatggaacggattttctcatgtttttgatggaacggatttttctcattggtgtagtaggatgcaatcttacattatggctgaagattatgatatttggagaaaagtttctcatccttatgtaattcctgaagaaattaatactgctgctttaaaaactgagtttgaacaaaattgcaaagcacgcaatattcttttgagtgggatttctcgttcggattatgatcgtgttgctcatcttcaaactgcccatgagatttggattgctttgagtaattttcatcaaggaacaaataacattaaagaacttcgtcgagatcttttaaaaaaggagtacattaaatttgagatgaaacttggaaagctttggatgactatctttctaggtttaacaaaattttgagtgatcttagatttgttgattcttcttatgatgctaattatccacaatttgagatttctcgccactttttgaatggtcttgatatgtctatttgggagatgaaagttacatctgttcaagagtccgttaatatgtctactttgactttagattcgctttacacaaaactgaaaacacatgagatgaacattctttctcgtagagttgattctaagtcgagtgctttggtttcttcttcttcttctttggatgttgatgcttcttcatcaaagtcttctattcttgctttatttaatgccacatccgatgatcaactcgaacagttcaaggaggaggatttggctttggttgctaacagaattgctcgagctatgaacaatgtcaggttcaggaagagaggtggtccaaatcattgctttgaatgtggtttgattgatcatcttcgttcgcattgtcctaagcttgggagaggcaaaagggaagacaatgatagagagaagaacaatgacaacaagccgaagggtacattcaaaggaaggaagatcaaggagaatctcaagaaggcttttgatcaagtctacgccgcgtttgagccactaagcgacgtagatggtgatagtggagatgaagataagggaaagaacatctccgttgtttgcttcatggcacgtggtgaatcatattcagagtgtgaagacaatgaggtaagtgctcttgaggaagctattaatattttgagtgcaaaaaataagaagtgtgagaagatgtatagaaaataggagtttatcattgaatctcttaattctgaaattgctagattaaaatctcttattcctaatgatgatgattgcaaaatttgtgaggttttaatgaatgagatttcaaaacttagagatgtcaatgttgcacatgatttgaaaaataaatcctctcttgctctagttttgctttgcacacacgcgctttggatgagttgtttttaactaaaaagttgtcgccaaaatatcaaattgtttttcatgctagaatgatgtttaacatgatttgtgctaagaagttaaaacaaccacatgatgttttagattgctcaacatgtactttgtataagaagaaactaaaagttgctttaggtcgtgttgagtacatggaagatgttgtgaaaaccaatgaagtgctttcttgctctaagtgtcgtaaaaacaaaggtgttatggtagattgtgaaaattgtgctaatttggaaaaagaggttttgtatttgaaaaattctttgcaaagattttctgagggtaaaaagaacctcaacatgattttagattaatctaaagttagcacacataaccgtggtttaggttttaatccttatgctcatcatactagacatcctcctgttgtgttaggtgttggtgctagaggtggtgagattttggttaaacctgatactaataaaactgtatttaaatctgtgggtatcatgtctacattgagtgcatcttctttaaaatccaatgttatgcatgcaaaacctcctgttgttgcttgtgttgctaagtcttctgattctactaatgtgtctaataatcgtgaaaaatatgcttgttctttttgtggcaaatatggatatattgatggtttttgtttcagattagctcataaacagaaaaaggagagagaggttgcttttgcaaaatcaaagtggcaaaaatctaggtttccttcgaggaaatcggttagaccgcagtggttcccgcggtcagaccggcgaccggtcagaccggct

SEQ ID NO: 15965 - DNA, 6435 bp, Oryza sativa
  unsure (1)..(6435): unsure at all n locations
nnnnnnnnnnnnnnnnnnnnnnnnnnnnnnnnnnnnnnnnnnntgttagatggcgctcatactgttaaatctcattttgcattggtcaattaccaggtatctgcagctacacatatatttctgcaaatttgtggctgcacttctgttattgatggttattccttttctttttcctgattagtcatgtgcttgaaaattttcagttgaagcaaataagaactgcactcgctattgcttccctattaaagaggaccctggtcagtggaatttctattctttttctagtttgatttgaactccatgatggtagtgtgaatactacacacttactattcgtgattgtgaggtagtggacatgcagatcattaagtgtaaacatttagttgagattgatttaacctgcaattcgatttcttgaatgtgatctctttccataaactttctatatgttaaaaggttgaaatgattattaatatgttcttatcttttagatgttaattttgtctttactgatgatgtgtgcaccatcttaatttgatacaaaatttacaacttgcaaaagtgcatttatccttaaatgagtaagctgcagctaattagtgagtattgaggtgttgagtagtaatgtatggtaggtgcttcatgcttgcttttttgaggataagtttttatcttagataacttctggaggtgtttgagagcagaattacgctgttcgatgtattgtgctcaaacttgtggacacccaatttctgactactgtttgtacttttaggtaatgcctccattatggtgcaggcttgataggatgtggtttggacatcctggagttttggaaggaacaatgaccagacaacctttcctctgtccaatggatcatgtttttgaggtgattacactgggaatttttttcatttctgttatcataacattatttactatttttcatattatatgacatactattagttggttagagaaatagtttccttagttgtatgaatcatattttgtaggaaattcatcacattttttttttcaaaagtatatatggttagtgaagttaaagtaaattatataactgggatttcatgttatatgtgtcagcataccttagatttttggaaattctctgtagttttagaattttagatgtcattttttttagatgtatccaggtggcaggtggctgaagcttgccatgctttttattgtccaagctttggtggtttggagtttagaccagaccacagtgctatgtactgaaaacttcttttcaacatattattgctgatctggttactgtactgatatgcgttattcattattttgcaaccaccctcagaatgtggcaatgtgcagataaaaattgacatatcgggccattaatatttttcataaatatagcaaaagtaccaccggattaccatcacaggaataacaaatgatgtgtggtcaacttatggttttttgtgggtaaaatgagcatggatactgtgggaaatttgcatagggaagttgaaaaggacaaatatgtgaacaaagctttggtgaaatgctagatatttataagcagatagaatagtgttaatgatggcgtttcataccaactggtcagcaacacaaataaagttgtcttgtattttgcactacataataaacaggccagagaagtccacaggtggatccagtatgaagctaacattcctactacgatgatttaattctacaggtacatgttatgctaaaggacttacctaaggaggagtttggcccacacattgattttagagaatactcgtttcttgagaatccatcattgcctaaacaggtaatgttattattgtacttgttttaacaattcactatgaatatttggtagtaagaaaggtgggtttgccttctaataattattgttttgcatcttgcataggtcaaagaatcatttcttgaggttgagctctgcaatgagcatagcaccagatgctcaacaactaatagaaccaataaaggcgcgcctgttctcttaccaaggaatagcacagaacaaacggtaaatggcattgtttgcacattatgcatgcctaatttatctctcatgtggtcatgcatacaaatatacaacatttagattagaggatacttatttgtcacaacatgagggaactatactagtacccagattataggatttttagaaaaaggaaactcaagctaaagtgagaactggagcaaaaggcatatcatgcaaactcagaattaatgctgtaattttgaagttcgcaaacatgaacattttatttgagacaagactccaattttattaagaaatatgtgtgcgacaagccaacaagtcaccagacaagaggtatcatgccttgatcagctgcaattgctgctgcagctgctgcagccgcagtagttgaaagccgctgcagcaatcacatccgaacacacccgtcattaaaaatcactaaacataaaggtatatcgagacatatacacacctcagataagaggaaacggcataccctgtggaacatagagtaggattcctatactcctagtagcagccattgcctattgcaaggtctgctttatcttttggtatcttatggaaaaatcatattctgaagttgctatttttttttcagcttttggatatattcaaaccatataaggatatcaaaatcttacagttctcatctatggttaacgccttcggaggtttttctgatgcagtaagcttccagtcttcaacaattttgtgctagttctgaataaaaggatgcatagtaactttattgtttaaaccaggctgtggacacgaaatttcggaatcgagtaaagagatatgtgggcctatggtgctgtgtgcagctccgtgaaatagggcacatatattatgacatgtactgggatgagaaaccaggctggaagccccttcctccacagaccaaggtggaggaccatccaccttggttggaggtacaggaatgaggctaactacaatcacggatgttattttttgattcaaaggcaagatagattccttactacagattaactcctattatcatagcagtcactacctgttggaaatccaattgattcttcttgactgcttactgtgaaggaaatagaaatcaaatggcaatcagttttgtagctctgatctttgataggctgattcacttatggtcgatcagtgatcctttgctctgttcttacttcacacagatctctgataaaccgtggtccattcatcttgtgaagataatgttgtagataatgactttgactcagaactgttgcgctatgttcatagttcatacagacattagcttcaaaggagaagatagcttttttatgcaaaatgcctgaattgattgtttgacagttatctggctggtacagaaaaggagtaaacatgcatcattattggctgtgtacttagttagcataaaagggtattttcgttcctaactctccatactttcttgtgtgaaagttaattatttatgcgaactaatcagtagtattcagaagttccatatgtggaacacaagctgatttggagagggagaagggaccatacgtgctcccgattgccgatctatggctcagatccttcagtagttggtccctcccatcccacaaggctacttatcattttcttatctcccaagaccaagggggaaaaaaagaaaaggatcacaggcgacgggttaattgcaatgggcatagattaatctctgcctccaaatcacgagtaatcgagtggataactggatgcttcatcgcggctacattttcatctactttctcattttaaccaatcgtaacatttttcaattaaatttcatcaacttccttaatacttgtgttcaatcctaaaattctttatattttgaaatcatccatgtgctccagccttcaagcctccactctaaatggagtaggaaaacacctactacttgccacgcgttcccacgtgttcctcattgaagcttctccgctggaaggaaggggtagtggtgttgccgagccgtccttcaagtcgagctcgtggccatcagatcacctgaatccggttttccttcttttacttcccttcatctcgcactcacttgacctcgagcttcccatgattcttctttccccaccacggcgagatggctagaagaaaacaataggtcgcagtctttccttctccctgaatgccttggttgtgagaggatctgtccttcttgaaaatttgtggttttcatggggatctttgcctcttttgtgcttttccaatttgctcgccatggggattacaatcgctattggtttgccgcgaggcaggccaaagattggggtttttaaggggtttttggatttgttcatgtgtttgctgcgaggtaggccaaagattgggttttttaaagagttttttttgaatctgttcatgtgtttatgcttcaacttttgtcttttattggctttgtttattgttcttgtcttgtggtgtggtgtatccgatttgcttcattggttgtattcaagctatgaaactctaattttgggaagttcttttataagattgattattgaattattgtgttgttatcacttaatgaacacatcttgctttcctgtctccgattcagagaatgcaaaggaaacgcttcatgtggggataacgtgtgaggaaaaaacaccttgcaagtgttgggacaaacgaagggagcaaaagaggattgagacggacataagcatattagaacgatcggaaagttaccagattaagtagttaagataagcattggtcccgctattttcttttctatttttgccactttgttgacatggcactactattgcccttcttctctgactcgcttccccaacccatttccctctctataccaggatgagaaggtaggagatgaatcaatgatgatgaggggtggtgacaggccgatcatagtgggtgcgtacgctagatccatgcgacaatggaggaggtgcttgccaccttcaagcccatgccgtcactcctacacaccaccacccttaccatccttcgggtttgtgatatgagtaggggtggcccgaccttacagtgagctaaagataactattatttgagagagagaagttgatgaccaaactataatcgtactagatgttagatgttgtattgcgctttagtgactaatacatctctctatgggttgttgattttacaaaaacagatataccttgcaggggcaggcctacaacaattcaagggtattcaaattaaatacccaagaattttggcaaaaaaatagatatatatatactatatattttatatgtatattaaaaaatttaaagaaaagacatcaaacaacccatcaagcaaagaaaccatcctttttaggccgtgtcctccccttctttgttggcccattagcacaattgattcactccattttacccaaccaaaaattctatatacatgaacttatgctcaattttgtgttatatatgtcttattagtttgggatattatataggcaaaatttgctaaaggatactcaaaaaacgtgtaattagctatgacatcgtaaaaacgtgacgcggctgatagacactacaaaaattgcgtaattagctgtaggacaccggatacaatattttataattttcgagtcaaaagaggtgagaaattttttaaaatgacaagattgcccctggcacctcacctctcctctccagctcgctcacgtacagcatggagcgcggcgggtgcgcgtccagccaggcgcggtccggaccgtataggcacacgaaatggcggtactgttccgccgccgtcctcaccgtggtgagcttgtgcagcggcccgacggcgaaggttgacttggacagcttggcctcgatcttgcccagctctgacgcctcgaaggcgttgaacatgttgaccacgaccccagacgccgaatctcgcatcgtgtcggcctgggtgctggcggcggcgggggcggggtagaggagcgtttagttgatggactgcgcgccagtgtggggccacgcgtcgacgcgcggccgcagcgcggagatgaaggacgcgtgcgccgccgtgccgcggttcgcggacgtgccggtgcggctgctcactaaccggcgcaggtgcgcgacctggacgggctgggcctcgacgccgacgcactccggctgccggcccacctcttcagcgttttcgatggccacggcaacgccgaggtaagcatgtgcttggaacgatccgaaacgtccggattggtcactggtggcgcaaccaacctcaggattgatttgactgattccgtggcattgtgttgctgtgcaggtggtgaactactgccgtgaaaggatccccgtcgtgttgagcgaagagctgaggatacagatggtgccgca

SEQ ID NO: 15966 - DNA, 22990 bp, Oryza sativa
ccgtcaccgacgaataggtggctcgggctgatggtgtctctgaagtagggtgtcaggaagtaggagaacttggagttgagctggctgtcgagctcgatgatgccggaggcgccgttgagcgctcccggcgcgagatcctcgtctggctaactcatccgaaggcgagggtcaccgtcgtccccgacgacgggaacgtgaacgcgtcagtgcccagaacgctgagctctacgccggcgccgtaggttgccacgaccacgcacacgtcgtcgctgccgcgcgcgcaccttgccttctctggcgcgacgccgcacagggcgccgtcgtcgcacggcaccgcccggacggtgcgcgacagggaggagttgtagtaggggaggtacgagggaaacagccaccggtggcgggaaggcggcaggcggagcactgcgtctagatgaggtcgctgccggtgtcgacgatggcctccgccggctgcggcgggtcgccgatgctgtagttggcgatgtactgcgttttgtcgtccatgcggatcaggtctcacacacggagcggctcgagctctggcaccgcctcatccagctgctctcctgcaggacgcaaggctaggcggaggcaaggcggaggcggtcgcgcgcgaggcggcggcggcgcttcgtgacaacggcggtagcggcaagctggcgctgtgggagcaggaggcgcccgcggtcgagaggcagcggcggcgctccgtgacaggcgagcgagctggagaggagaggtgaggtgccaggggcaatctcgccattttgaaaaatttcttacctcttttgactcggaaattataaaatattgcctccggtgtcctacagctaattacataatttttgtagtgtctatcagccgcgtcacgtttttgcgatgtctcacagccaattacacgttttttgagtgtcctgtaataaattttgcctattatataagccaattattaggatttttgagtgtagaaatatttccccctctttattttgaatacccaaccttaaaattctgggcccgcccctgataccttgttcctacaaaaaaatcgaaaaacaagcaagaacaagataaacacagtctaaattgcaaataggaattaaagctcatgacgaataaaacactcccaaaggtggtttcagaaatcgagtaactagatgatctggccaaaacacacaattacaaagaaagtagtaatgactaaactataatctaaacaaaacccgagaaaccctgaaagggtatctagctatttaaggaggtgtgaggactaccaacgagtccctagggccatacttcaccgggttaggcacactcctctggggtttcagacgaagtcataagcccgtagacccatgattggtggtacaacactttgtttcctccattacggttgagttatatgaaatttggttctaaggtggtccattgaaaagaggactccaacagatttgcatcaagtactcaaggacctaaaatagagcttgtatgtggtcattcaaagtcacaattgtcttttgtaggtcgatctagatttcataacatggcctgcttgaactctttctttgcttcagccatggatgacgtggtggcaccaaggaagacttgtataaggccgtcacttggtccccaaatcaacatttttttattttccatgcatgcttttgcacttcctttcttttcctttaatcccacttatgaaattgaaaacacacaaaaactcaagttgtagtatccttttcaaatatatggaaattaaacctaaccaaaaaaattattacctttggtatggaatcagtgagtagcccaacagctgttggtgcaagtgagatgcaggaggacgccgggtgggaagtgagcaaacagacgataccgatgggaggtggaaggaggcagccggcgatgagtgggaggttggagcaaggggcaccgggagggaggcaagaggcggcatgcgccagtgcggaccagctgcaatagagggcttgctatgaggagagattatatgaatatgtgctgagcacagctagcggaggactgcgacgatgagcaattcgtggcttgcgagctgagtcatgagaagtagaagcattgcttggcagcgtgccacgtgcgattaagggatcaatcgaaggcctagggttttcttgatacttgtatggttactcctccactgcacgggccttggtgggtttcttttggagtgaactattaactatttagagcacatttcacaattttcgggggcccacaggtgaaactttcaaccttccctcatccccccttggatttagggccccgcctcgacaaactatgggtgaggaatttgtatggcaaatagtaaaaaaaaatcctaatagagacatggaaagtactacacatctcacgtgcaactcaatacctctccaagaagaatgtgattgcaatttgcataacattaactccattagagatgaacattttgaatcgtgatatggtgtatcattagttcatcttttaggctagttctgacataaactcaaagctaatataatcctggctagtatccttgatgtggatggaggaggtctgttgttcacgtctttgtgatgagagagatccatcatccgtgtcgttatcctccaggtagatgttgtagattgataaaaagatcccattcgaggtagagaaaaggaaaatgctttttttggaccaacaaaagcatttgagccatcgatgaagaaaggatagcgcggaagtacaatgcaaatgcacacgtgacacatccatgtcctacacacacccatgtggttgtgtcctaacacttgtctaaaaaagattagcggctaagtcacataatcgattagaaattaatgatagagaaaaactaatctgaattatctcctgaacttttactcttgtagtgtaatttacctattgaattacaacaacacatatttttttactccttatattttactccatatccatgttcttaccccaaccgttgttggatcttgaattttccatcacggggctacccccttaaaataataaggtggcggagggccgtggatagggatggcaattgtgcccgtttgcccgtttacctgcgggtaaaatccctattagggttgggtttgttctccattttatacccatgggtatcttattgggtcaaaagctatgcccgatgggtaaatgggcatgggtataggtaatcactacccatgcccgctttgcccgtttatccgcgaaatctaacttacatgtaggctaggagcaaaatccactagaatacataagccacgttctttcttttctacggtttcccttttatttcccttattatttctctcctcttactctatcgctgccagaggagagacacgacaccgaggcggagaatatttgatgttttaagttcgattcgaacttagtagcttgtagactttttgttccactgcttttgttgtggcgggtaaacgggcacgtccgtgggcataaggcgcccgcgggcaatgggcatgggcaaccatccttacccgtcatgtagtaatgggtatacccacgggcacaaataatctcacaggcatgggtatggataggcacttcccgtgcccgtcgcgcccgattgccatccctaaccgtggagaatggcaagactagttgttggctcttgtagcaatcagagccaactcgcagaggactcagcgcgggtgacggtgaactcactgtggaggtagcatgggcggcttcaagctcacagtggaggccgcacgaccgatgacaagctccatgaccttacaccactagcctccgctagctccgtcgccacgcatcacctcttgtaccttggtgtcgcgctcctccactagctccgccaccatgagtcacattcactaactccacacgatcgcgtgtcctcctccccacccaccctcaacctcatcatcgcttgcctagcttgcgttccttggtgtgcaaccaccatcgagatcaagagagagagagagagagagagagaagaagaagaagaagaagaagaagaagaagaagaagaaggtcgatggtgaataggatggcaacaaactagccattgctgatctttgtgtcgaggaggccggatcgccgttggagggggagagagatggggaggaagaaggtgatgacaagtgggtgctataaatttattattattatttgactgggaattgccacattggtgccatgtgtgctaacttggaccaaaaccataaaaaaataatgctcaaggggttaaatcgtttggtgccaaaaattagagaatgatgtctgatattgaatgtagttcatggggtaaatcaaactaatgcaacaatttaatggggtaattcgaactttcactaccacaaaaaagatttttatgaacccccgtatttttaccaacgggctagaaaggcattcgtttgcaaaaatatgtaagaggtgtccggtcaaggctcacttacaaaaaatgattttcatatacggtcatcttaacaggtccgcttgtaaaagtaggcgtatttttacggcttgcttttacaagtgacactcttaagacaaccacatgtgaaaaatcatattttttaaacctaagaggcccacttaggaaatacaggaccacaacctgcccgcccgtgactacataagataaccctcaccccgtcctctcttatcccctcagttctctctccctcctcactttagtctactcaccttctctctttcgatgatggcgtcagagattggcggcgatggtagaggtaggtagctatggcattagtggtgcctctccctccgatgacaacaggagggaaaaatctgtcgaggagggccccgacacagcgatctgtctcctgctagcccagaggtggcggatctagtgcggcctctcccccttccttgtcgttctggcgatggcggttatagggaaggtgaatccgtcgtggtggtggcaaaaggggaggtgcgatgactgcattggcaaagggagacgacacgggcctcttcagagccgcctcccggccatctcatcgcctcccagtggaggtggtggtggcagatccacctccacacctcccattgccatgcgtgtcgtcgcctcacgggggaggtggaggtggcggactggcggctccatgcggtggtggaggcagcagccggatcactacgcatggatttgtttcaagttcatgtttgtttgtgattctagttcaagttcatgttctggatgtagatgactgtatctgtgatgaagtttatgttttgttctggttctgtgtgtgatgattatcatgtggatgtggattttgactagagagctagggttatagggagcggcaaggattaggtgattttattttgagtaaattttactttgggtcgccttttatttgtttcagtttggaccattctttaataaaatattttcaatttgaaccgggtaaatttacctttgtggcactttgggccaccctcaactattttatctatctgcatcaacttgttatatgccaaagcaatagtctaagtatagctgtgggagttcatcgacaaacagaaggcgacgtactcgacatcgttcatatgcgagaagatagtcgagatggtccaaagtaaaggtaagattatccggtcccaagtgaaactatttgttagatggtggtaaaaaggaacgtcagtaataaaaaaggtaatccaaagtaaaattcactcttttatttttttcataaaaatcattaccctagtcagtcgtcttaaatagtcacctgcgaaaattgatttttcgtatgcggtcgtcatgcccacccgtgataatcatcattttcacgtaaagctactcccaggcggctggtgaatgcacctgacataattcattttaaccgtttgaaaaaattacttctgtagtgtaagtgtttatcctcagtaatacgatacaacaatgtggatgcttgattttctccaagtatacacgggattagtaatgatcgatcagttgatcacccttaccttaccttaaatggtaacctgccgtttggacaaataaatggacggggacaaatcgatcggttcttaattagcgagattaattgttagcgacagaccgatcagttgcttgcttcgctgccgagaatctgtcacgcatgcagacgcgtgctgctgttggagggagcggccagaggaattgatggctgcccctgtcgtttgccgcctgttggctacctgttcccaaattagttgtccaaccaccatttaaatttcacttatctccctaaagtactgcttgtcttactcactccgtctaattttatagagaaaatctataaaatactattgacaagcattctaattccagaaatatcatcgacaaagacaacttcctaaaaataccattgcacgaacctctttctcccaaaaatactatcacaccataagtattgttaactcatctccattaagttatatgaaaagacaatcttaccctaggcatccatttgcacacacatcatcattctatattatttgctcacacaatattattttgcattcatgcatattttttctgtccacaactaaattcacagacatcgttattttgttatcaatcaaattatttcagaattaaattcacaaaataatttcacacattttgccatcgcaattccttcagaaattttgctatcaataatcaggaaacagaaggacaactgaatcaacctactatccacgcacaaagttcatctcttgcagatttcaaattcatcaaaagaagcaaaaacaaatttaccctcctcgccggcaccaatggggctttgctcatctacggcccccgcgctgcaggctgcgaccgtcgcaccgccgtgaaccacgtcgacgtgccctgcagcgccgccgccacgggcctcctcgccgctccctgccgcgccagcgccacgggcctcctcgccgcgccctgggcctcctcgccgcaccgccgtccttggcctcctctctgcgacgccgccctgtgctcccctgccgcgccgcccccgtggaccgccggcatagcggtgccaccgccgtggaccactgccgagccgccgtcgctgagcagccgccgggcctcctcgccggatcgggatttcccctccttgccggcaaagtcttcaaatgaaatcgaacaaaaggggaaaaattcaaatcagagagttgcaccacctgctaggactgcagcctcctcggcgacctcagtgacctcagcgactttagctgtgggcctctcctccccctcgctagcgcctacggcccccgcgccacatcctgtgaccttcgcgccgccttggacctcgtcgccgtggacctcctcgcagcgccctgccccgccaccgccctgctcctccttgccgcgtcctgccgcgtcgccgccctgctcctcctcgccgcaccctgccacgccaccatcgccgtggaccttctcgcggcgccctgccgtgccgctgccctagtcttcctcgccgtgccctaccgcgccgcacccgtggaccgctagcatagagatgccacgggcaccgccaccaacccgccctcgccgagacgccgccggggattgggatcggcagaacgctggatcaggggattgggatcggtagcggtagggttaggttataattttttttctttgacagtgaactgggtatattttgcaccgagggcaaaatggtcattattaaaaaaaaataacggttctaacggtttggagttgacggtgatggcatttttgggagaaagaggcttgtgcaatggcatttctagtaagttggctttgtagatggcatttttgggattagggtgcttgtcgatgtcattttatggattttctcaattataaacgtagttatgagtttccgtgtccaactttaattgtttgttttatttgaaatttttttatgattagtatttttactattgttagatgataaaacattaataatcctttatgcatgaattatgttttgttacttttttcaaaaaaaatatcaaataagacagacgattaaagttagacacggaaactcatggctgcgcttaaaataacacgaatggagtattaatcacgtcccatttagatttcttcctattttactctcaatcacctttttattcttaatcataacttatttgataacaatattatattatagtcttttagtttaaacctagtatatgccaaacaacataaacaataagtaatttagtacagaggtaatgagtagttagtatattttagtaggaatggtgtattacttccttcgttaaaatgaataaatatagataaaatatgggggtgtttagatctaggggggtaaggttttggcgtgtcacatcggatattatatagggtgtcgcatggggtattcagacactaataaaaaaactaattacagaatccgtcagtaaaccacgagaagaatttattaagactaattaatccgttattagcaaatgtttactataacaccacattgtcaaatcatggagcaattaggcttaaaatattcgtctcgcaaattagccgcaatctgtgtaattagttattttttagcctatatttaatacttcatgcatgtgttcaaacgttcgatgtgacatggtgtaaatttttcgtgtgggaactaaacatggcctatgatacaagctttagaattggccatgtttattaataaagcaggtagaattaaatggaaagatgttgtaattggtggaaaagtgaagatgggtggaaaaagtgaatggtggagggttgtggttggttaagaaaagagtgttggtggaaagttattatattttggaacaaattctgagtattagaagttactatattttgagacggagagagtatattttagtgctattaatttaaataggaggtcatatcttatattatatttgtttatttttgagatggagggagtattctcttgcagacattattggtgatcatatccttggaacagaagacactactacaaatccggtttttccatacggtcgaatcccggttttcgcaggtggtagggcgatccgtatgcacaaatggtttgcaaaaataactatttttacgtgagggtggtggaattaaatttgaaaatatactatcatttttttttcttaaaaatattcggggttcaaattttttcacaaatataccgccggtatatacgcgagaatgacgtggcgtgatgatgtcgtgcggtcttgcacaaccaaagagcgaggtcatttttgaaaattaattagtgtttattaattggtaataattagtgattaatcatcctaattattaattaattgctaattaggataattaagcactaaataagtcatcaaatgacaagacatcgggtctcgcttgttgtcgtacaacggtctcgctctttggttgtgtgagccgcgcgcgcgagagcgagcggactcgcgctgttggcccccaagcaccaacattcgtcagtatcgtcacgctacatcattcttgcgtatctgttgagcgataccaacggtatactgccaaaaaatttaaaccccgaatatttttaagaaaaaacaaataaacaatatattttcaaatttaatttacggtggtgcatccgcaagaaaaaaatcaaaaaaaaaaccaaaaatcaaaaatcacgtcctcgtcatcatcgtgggggcgtaggaggctaggggccgccaggtctgcccgctcctatagccgttgtcgcctcgccagagacatagccgaatcaaccgccccacgcctccccaccgcctaatcagctgacgccgtgcctccctaccacccgatccgccgccgccgtgcctccctaccaccagatctaccgctgctgaacggggggacggccgccgcgcctgatgtgaccatggctactacggatacaaccgttgctcatattatggatgagcagcacgatattaagttcaagtcctccaagtattggaatccgatttcggccacttgctacactgctgatttcaaatggccgccgaatctgcatacgacctcggtttttggctcgtgagtatttgatggaaagctctcggagtcctctttccaacggatccagcctcatccccgaattccatctcctttggccgcaattgcagaaacaaggtgctgcgtcacctatcatgggcctttgggcttgtaacttcgtttgggaccccggcccaagtggggcccatgtggggtgcgccccaagctggtggagcacgaccctaggaccctcttggtcgttctcccacatccttaaatagctaggtaccctttcagggtttcttgggttttatttagatgaaagtttagccattgcaacttccttgcagcgtgcgtgtcggctagaccgtccgtctgcttgtatttgaaaccccaacttatcgtgtgtgtgagattgcttttatcttgttattgcttgtttcttcgatttgcttgcaggaatagggttgatctgcaccggcaagatcaacaacccacggagaggtgtatcaatcgctaaggcgcaacacaacgtctagtacggttgtaggtggatcgtcaacgtttctttcaaatcgtagttatcatcaactcaccgaaagatcgggccaaacaactgccttgagtgtcgaaaggaactcagggtccattaggtggtataagagctttcgttgctcggtgagtttttatctacctataaccagaaaatagccagacaaaaaaaaattgtatcatttacctagccatattgtgccattgcattgttcttttcagtctttgctttgttgaattttgtgttgcattgtcacgacgtgttgctggtcttagcgtctagttcgtttagagtttcacgttctggtcaagttttgtaccacagtcgtcgcaaccaccgtgtctctgttgtcgtcgggacctacgaaaacagaatcggctcgctgccatggttctattttgtagtttttagaagtttttatcggtcatttttggagttgcatctaggttttgcttgagtttttggtttgcccatgaatagataggccgtgctgtttccagcgctgagaagaggaagaagaatttctaaatatgtttttggaagtgtgagtttaatctagaaggaaatagtagattagattgattgaaaatcagtttcccttttcctctcaccaaatccgaactctagtggtgccgtatccatccactcgtcgcccactaccaccgtgaggagaggtttttacctgtatgccactaaaatatgacccttgcctctgtgccactaaaaagttcgagcctccctctatgctatcgtcgaactttatcgcgccctccacaccattctgtcgctattctgttagggttcatccgtttggcagctctgacatgtgggcccgggcagaaaaaatgtccctattgccctttctttcagtttcttcctctcgctccttccccctttctcccacgcgcgagcgcacataagcggcgacggccgggcacggcggcgcctggtgcatggcgcggtggagacggccggtgcgccgacgcgggcggtgtctgattgcagtggcatgggtcgggggacgaccggggagcaccgtcgatggagcgctaggcaggaggcggtcgggcgctggatggggaggcagccgacggtgtcgctggctcgactcggcggagacgtcggcgccggtggaagagaaggccgtcgtgcaccccgacgtggccgtggaggcggttcgacgcggcggcggggggacgacactagcgggggacggccagtcgtcatctccgggtccggcagctcgggtatcggcgtcgtcgacacctcaaaccccagcggctcctcttcccagtccacccctttcccggcggtggcgtcctcgtccgtgctcctacaagcgccgatgcgtgtgggacgagacgccgcctctacgcggctgctgcgcacggtgatgagcgcctctccggtggggccttggagcgcgagctcgccggcggaggcggctccccctccgtggccgtggcgaccaggaagggcggggtggcgtggcgaggccggcgaccggcgctgtgcggcggctgggcgcaggttcgacggtggcggccgacggccgcgagggggcgtccccggactcgaggacctcgctcccgacggccacgatggagatggtcggtggcaaagagaggctagagagagcgccacagagagaggccaggagagatgtcggcggcgagcgaggggatgtcgccgttggccacgccggcgagggaggcggcgaagaggagggcgaacgccggggtgccgacggccatgtggcggcgcaggtcccaccccctggcggcgagcgaggcgacgaggagcgtggagacagcgagcccccggtggtaggcgaagtgggagacggagcgcttggagaggaggcgcgcgtacggaggaagtcgatggtcatcgccgtcgttgcgtccgccgctgctgccatctccaacccttcctttcaagtctaagggcaaataagtcatttggctgtgccgttaccaccgttagaacaaaaaaaacggatggaatggtgtggagggcgcgataaacttcgacgatggcatagagggaggctcgaactttttagtggcacagaggcaggggtcatcttttttaatggcacacaggtaaaaacctcccgtgaggaggctagtccgactctctccctctcccttttcggtttcaatacatattgtgaattgctagacactttggtgaaaatttttggagtgtcggattggagatccgtttaaaaaaatggaacctacgggacgagagcattccatttttgtataattttaattttttggtttgcacttttgtatttcagtccctgtaatttttgtatttacatttgagtccttgtaatcttgctttcaggcccttgagtcatttttgctaaaaaaaagtgagaaaaggcagaaaggtgcttacaaaattgaaaaaaaaccgcacaaaaaaatggcaaaaaaggtgcataaaaaagaaaagaaaagggcgcaccaaaaaaaagaaaagaaaggaaaggaaaagaaagaaaaaaaagaaagaagaaagaaagaaaagagaaaatattgttatgtttgagctgaacttcatatatcagagttgtgcgtgagttgtgagttatccctagtgctatcttgtggtatcgtttgtgtctaggctcgcgtctctaatacattctagcctaggaccaacacaatacttgactttgaactatcattcaactttgcattctctaatttgtgcaattgctatcatttgctacatatttaagcctacccaaagctccacagatttgattgcagccgtacaacaagtgtttgccaaggcatcgatacatccaatctccattggggtgcttggttgagtcagtgtatgccaccattccgcttgcattggtaagatcttgtaagagcttggttaaaagcttgagtgtgtgtgtgatatttgagctactactacctagtagttaataggaacgtgcatatttttgtgtatgtttcttgttttctattaacaatggcagggatacacaagatcgttggatatgaccttgctcgacaccaacattttcatcgagacatgaggaatgatcaacatgaccattatgaggtaagtgatgttctagctaagatcaaatctgcactaccttattttgaaggaaattatgatcctcgtgcttacattgattgggagctagtggttgatagagaatttaagaagcatgacttgtctgagaaacatatggttatgtgtgcctctaatgttctaattaaaaatgcttcttctgattggaaacatctttgtaggcataataaagtacctcaatcttggaaagacctgaacgacatttgagagatgtttatgttcccatgtattatgctgacattctgttcaacaaactacaatgtttaaaacaagatactaaaagtgttactttatactataatgatatgcatgcttgtttattacgttgtggtttagatgaatgcgaagaagctacagaattgaggtttttacgtgggcttaacaaagaaattcaggacattctttattgtcaaagatatacatctctttctcatttgttataacttgcttgcaatgctgaaagtaaaatagaggaggacatgaagaagcaacttgctatgtttttgccttctattactaaccatttgcaggaagtagataatcatgaaaaggaggagagagacatgaaaaagccgccagtcctattattcacactcaaagtcgaggcacctccatcatctgaagagggcatcaaaggtaaagtaaatggtgctgaaattaatcaaggtgaatgtgttgttaatgaagtaaatttttccacttttcatgctaaagtagagcaaccgttagtggaaccaaatgctgaaattcctttatcataagttaatttacttgttgttccttgtgataaagaagagttgtgtgataatgcttcacttatatcaatgccacaactagttaatgaacatgctattcctaatgttaattctgctgattttaagtatgttgttcacattgctcatgaagttcaggaacgtcaattgataacttctttaaatactttgggctatgttaactttgataatttttgtgagctcgataatttgaaagagaaattatttgctaaatctgatttgccatgtccaaccaatgctatttttcatatctttggcgaatataataatagaaaaatatatttggtgcatagagtttatatatgttcggatttagaacctcctctacatgtggataaaacttgcaagctaaagatacatgttatttctaatcatattacttccaatctctcttgttttgattggatgaaacatgttgttttaaatcgaccacgcgttgagcatcatatggaaaaaccgaggacggttttccgtaaagaaggggaggatgatgtgaccatggctactacggatacaaccgttgctcacatcatggatgaacatcacgatatcaagttcaagtcctccaagtgctggaatccgattcggcctacttctacactgctgatttcaaatggccgccgaatctgcatacaacctcggttttcggcccgtgagtatttgatggaaagctctcggagtcctcttttcaacggatccaacctcatccccgaattccatctcctttggccgcaattgcagaaacaaggtgctgcatcacctatcatgggcctttgggcttgtaacttcgtttgggaccccggcccaagtggggcccatgtggggtgcgccccaagctggtagagcacgacgttaggaccctcttggtcattctctcacatccttaaatacctaggtaccctttcagggtttcttgggttttatttagatgaaagtttagccattgctacttccttgcagtgcgtgtgtcagctagaccgtccgtctgcttgtattcgaaaccccaacttatcgtgtgtctgagattgcttttatcttgttcttgcttgtttcttcgatttgcttgcaggaatatggttgatctacaccggcaagatcaacaacccacggagaggtgtatcgatcactaaggcgcaacacgtctagtacggttgtagttggatcgtcaacgtttcttccaaatcgtagttatcaccaactcaccgaaagaccggaccaaacaactgccttgagtgtcgaaaggaactcaggatgcatcagcgcctccccatcgccggatcagccaccatagcacaggcagagggcggccaccgtcagatccgcacaatcgtgtgcctcctccgtcttgctccgctgcccgagtccctccaccgccgttaggaggaaagagaggggagagaagtgggggagaggaggaggaagccgtcgccgtcgcccttgcccttgccccccgccggagcctgctacgtgctaccgagagtaaggagaggggagaggggagaggaggtggggagagtagtgggggatatgagtgggagaaccgggagaggagaggagtggagtggagtgagggtgatgggggtgggtaaaggagtgggaatctttcggggtatttttgcatgcatgtgagttaagaacaccgcatgcgaaaatacccttatttcccttattttggtgcggatatttctaagcggttcatctagaaaaatttatttttatatatatgttttaaagagctgtatggaaaaatgaggatcgatctttacagacacggacatttatgtttcgtccgcaatatattgagatgctcgtgtagaattttttttaagcagtgagaatatcttagtgggaagacggtaaagtaggcctcgaaccactctctctctctctctccatgcatacggaggagtaatttctctctgtgctattgatgatatggggatcgagttaagaatatgctgacacgtctgatatacctgtcaggccattactaggatagggcacaccactttgtcaggcccaaaccgaatgtgctgctgcatgctatactatctgcactggatatatatctgcatgcatctctgccgccaatccatcataaagtaggagtatatacctgtatacagtatatcatcatcagagagagtagtagtagtgttatgcatgcatgggatcgatgaattaactgctacagttaccggctgcagcagatgagctgagctgaactgtgctaggctagccatgcacagatgcactcccctattaaattaccaatcactctattccactctatatattcgtccacgaatagaaaagattatacgaagccttttaaaatataaaggcctcaaaggttatccataagtttattataagtcataacaatttattagcagccaaaaataatttttgtaaagttttgtgtatgtgttcttagcgatttaaaagccaatgctataaaataaactatgctaaaaaatattttaaaatcaacttcaaaattaagtttcaaaatttaaattttgactttgactttggtgttttaggcaaccgatcgatggagctcaaacattttagaccgtctataaatatggttagaaaatgcttatattttagagcgaatgaagtatgttgttaaaatatatagcttaaggggttgaggtgaaattattttggtacttctaaaaaccttttatttaattaaaaatcacgattacccatgtaagtgagcaatttaatacaatgaggaattggaaaagtaatactctaaataagatctgttatatttaatttgtagacgagttctaaattaaaatcaaaatctctatagcttgtactcgtgtatggagcactaagcaatgtattactactatctagaggtagagggtgcatgcctgctagagctagctagcgaggttgcatgcgtaggattcccgtgacctggtctggagcgattgttgctaattatcagctagcgcgtcgatcgatcgcctatggatggatggatggatatcgatcgatcacaggaggcacttggttagattgctattagatggatggcatatgttggggggaggacggagcgaggaggggttggttggactggacaaccgatcgatcgacgcgtacagctcacacccacaggaaaccaaactcgtactgtacttgctacagctatatctcctgccattgcatgcgtcagatcgacttgctacttgcttctctccatcaaccatatgatatgagagagagagagagagagagagagagagagagagagattggggagagttaattactcagtttatcactagtactccaataagcatatcgatatgcaactggtgattaattcactgtacgaatattgttgtgcgacaagattaaggtatgtttgaggagattttaattttgagaagtaactagtaggaatccttggtgataatgtgaataagttgagaaaacatgccaacttcttgcttcaactccctctgtctcaaaatatagtcacaacaactgttagcattaggctaatctaatactaggttactatatatattttgggagacggagagagtacaactgtggcttcttagaatctagatgaaaaattaagatggattgtttgaacgagtttttattctggaaaaagctactaaacaagcccaaggagcaaggtttcttcgactaggtcaagtagttgggcttcatttgtgattgttgaactatggtgtcaggtttctttaggtgcaggatattcgatcgttccattatcttaaaaaatacagttattgtgttatgctgaatcgtcgtgttttttgtttttgtaatttgttttaaattagcaaatatattgtttcactccgaaaagttgattttcgtagaacaatcatggcgatttataatgttagacaaaatatgatacccaatataatcgttctgtcccacccagtggcaaggccaagaaatttaacatggcaaatcgaactgtgtgctaagtgtttaccgatgatcctgggcagccacccaggtcatcgggcggtggatagcgttattgcttgcaagttagattaagagatcaactcatcaaagaaaaaatgctgaaaacagttgcatgaaacgagattatttattatacaatgtacttcaacaatgtcaattaagcaaactattagcatttaattacaaaaaaacaaaatactacataaatcatactataacactttaatccatcattgatgtttagcttgcttacatgtaaattaaaaaaaaaaagtaaagtaaaaaggtaggaacaacctaggtggaacaaaatggatccacatgcatgggatttcacaacaaagctagcatggacgcaacaaaagtgaaaaagaaacagaactaagaaaacaaagaccatgacatgatacacggactttgatgtcagaatgttatgacaaatactataccacatatagtaataatataatcagttaattgattaatatctcaacccagttagctagacacaataactagttaaattactagtaatgaattagccctgcagctaagctcaattccttcggaatcagctgttaatttgaacccatccacacctccatcgccggcctagggcagcatcgcgaacgtcgagatgtcgccccacgccgggatcgcgctgccgcagttggaggtggcgttatcatcgccgccgctactccggccgccgctgttgaggttactgctggtggtggcggccacggcggcagtggcaggcggcggtggggaagggagcccgtaggagcagctgtccatgaaccacgacgtcgccgacggcatggccgcctccatgctgggaacactaccagccatgtgcatgaaggcgccaccgcctcctccggcagcatgccctgacgctgtggcttgggcgccgttgccgccaccgtcgttggcctgggcggcggcggcggcggcggaggcggagcccggcgggccgaggaacatggtggcgagcctctgctgctgcagctttcagtgcaggtcctggttgatgaagctgagcgactcgatggacgacgcgatggtgctgctcaccgcgccgtggccggcggcgccgttcaccgcgttgccgccggcaatgtcccccgagggccactccccgaacggcacgtactgatgatgcccgacgccgccgccggcgggggattggagccgcggcagcggcagcatcccgacggcgccgccctgctggaagtcggccaccgcggcggcggcgccaccgagcggcgacgtcgacgacgacatcatcatcgttgttccaccgccaagaaaccccagcctggcagcagccgccgcagcggggtcggccgctgcaccgccgataccctccaccgtcggcaggttgagcgagaggcgcgatgccgccgccgcggagcgggatcgcttgttcttgcggcagccgccgccgactgggacgttgcggagcgcgccgcccttggtccagtacctccggcacgtcttgcagaagtggcgcggctggctgaggctgtagttgttgtagtagcagaacttggtgttcggcgagtcgcaccgcgggcaccgcaacccctgctcctgcggcggcggcggcgggagcggctgctgctgctgctgctgcgccggtggcggcggcggcggcgtcgtcgtccccccacctccagctccctttcgcggcaccaccgcgtcgtccccggccgccggcgccatggcacaccgtacaacaacaacaactgtagctagctagctagctggctagctgcagggggtctaagctggctagctccgtgatggcgcgctagctctaggttggtctgggtgtgattaggtggacagggaggggtggccgtgacgccgcgtgcatataagaagaagaggagggagatcgatggtggaggagggtttcgtgcgggggagggaagaggaattgaatggcgtctcatgtgtgtgtgagggagaggaggaggatcatgcgctggggctcggatcggctgcatgcatgggattaatgggaggtaaaaaagcgacgtctcggattgccgcctgtgattgccatcaaagtgctcagctcagcaccacacctcacctctcatctcgtctcatctcagcgtctcagcccagccagcctaccagctagcccgggtaataatcacctgtgattaatcaatgttgctgcatgccttctccctagcgtagctagctctcgattgattaatcgatcgatcgatgggcccctgttcactgtgcaccctagtacaagctgtctgccgccgcctgccggcgtgtcagagtattgtctgcggcgacgaacagtacggaggcggtagccgtcctggatgttttacactttcgtccttttcaaaaacttgtttaacaaataaacccctaaaaaaacttacaccgtactagaaatggttctttttggacgtcatagtcattggcgccgtggtccaataggacggtgacatcatctcttgcaccgtccccctgccatcgtggctggccggcgctgacgtggcaggggaagcgcgccaatgataattttcttttattttattttatactttttcacatttaggagcacacaagaaccaaacatagaaaaattaaactcaaacgaatgaaatgtgacctgtagaatttttcaaagctctatcaaaaaacttctcgccttgaaaacacaatcttgcaagcagaatttcgagattctaatttcaccaaacccgggcgaaatgggggagaatcagatgtaactttttatgtagatatttgtaaatatataatttgcctttttctgtatttgttttaagaaaggtcactcgaatgtaacaaaaaaactcaacaaacactaacaaagcaatgctagtaaaaaaatgctaaagggtttataggattaaggaaatgtaatctaatattgttttggtaactttctgactataggaaaaataaaaacactgaaaacagaaagtctcttaccgataaatcttgcgtggatttgagaagagggagagagagagagcaagagcagcggcgctcgggctcgcgtagggagggcgcgggggatgggtgtgaccctcggggggagcgcaccaaggaaaaaaaagatagcattgtgggtggggggtagcatcattggcacgctcccccttccacgccagcgctggtccgccacagtggcagggagacggcgccagatatgctagccccatcctagtcccattggaccatgatgtcactgactttggcaccctaaaaatgaccatttctgggataagtttttccagaggcctatttgtgaaataagtttttaaaaaggaccaaattgtaaaagattcgggaagcatacaaaaataagggaatggattctaaactctcgagggaatatctctctgcatgtcatttaaatagttatgaaaaaaaatttaagaagatgtgttacatgtaatatatcaccacaaacatacaagtccaacttctacatgtcacaacaaaaaataaataaatttgatttttaattttttttttcattgcaatatgtagaagtttaatttgaacatgcagtttgtggagtcgatctagtaatatatcacatgttaatacatattcttaatatttttttaatttttttcataactatttgagtgacatggagacaacaagaggatatcccctcgaaagtttagaattgttttctctaaagataatactacatccatatcggaatataagtgtttttgacggtgatatatatggtcttcgaaataatactttgactgaaaaatatttataaaataagttatttcaaataaatggagtaacatattataatagtttgtttagtgataaatacatcaacatcattctcatagatcaatcttttttatgtttccctattaatagttaaagtgaaaaatgtttgacttaaaattattctaaaaatttttatattttgaaacggagggagtatcttagtattactaatcgaagcatgtacagattcataatactagtatacatgttttacatattatattttaggtaaggcagtatatactatcactggtggagaaaccgtctttggtcggtcgcccgaaatccacaatagtctcggttccactaaaaaccgggactaaaaatgatctttagtcccggttggtggctacagcggatatatttgatctttagtcccggttggtgttaccaaccgggactaaaaatgatctttagtcccggttctaaatctgtcaggccttgtcagccccccgagatctttagtcccggttggtaacaccaaccgggactaaagatagggatcttgttaccaaccgggactaaagatcaacataagctttactcccggttggagttaccaaccgggactaaagatgtatttttagtcccggttggtaataccaaccgggagtaaagattcccatgctatccccgcctttaagt

SEQ ID NO: 15967 - DNA, 3686 bp, Oryza sativa
tttagttccgggtatttgaaccgggactaaaataacgatctttagtcccggattggtagtcccggtttgaaaaccgggactacaggggggttacgaaccgggactaaaaagcacttctccaccagtgtatattcaataaaattggcacattctaattgttcttttttcaaaaaagaatacgtgacggtaacgctagctcggacggttgcgcggcttgcgccattgccatggctacgtgacgacggcatgcaagtgctatgctgtacgctggggccggctcgcgagcagaatcaccagatatggtgctcgcctatactgtgttcatcgagagtaaccgaacgaaaatgtatatatgtaactgaagttgcggcgttttgcgtgcatttttagtaaaagtcatcgagggcaaaactaccataaaagagaacgtaacaatccgcctcaccatgtcttctgcgtacacccttgctcccgttaaatttataagcacataatgatttaatttattttataaataaattatgacattgtagatgtaaactagcataaacgcatcataaaatctacacatgtaaactagacagtaaagcatgaataaatcgaatatatacaacatgttgaacacgtaccaaggataacagaagaccggtttctctgcagaaagcatgggcggacctaggggtgtgccgggttggcaccggcatacccaatttcttttgggaaaacactaggatgtatatgcaatcaaaggacagaattaaaaatagaatactctactctcagaaaatagaatataacaatgatcacagtttgtcatcttgtaatcgtcaacaaatcaaatcaggggaagagggaaggacatgaagagaaacgagaaacaatggggaaaaaagaacagctagatagattacgatatggggttgatagttctgaattttatagatttttcataaattatggaccaaatttgaatagaattttgaaaaatcggaccaaaatctgccaaaattcttccatcataattgggtgttttctttttaaaaaatatatagtgaagtgatcgctagaatgggcacacccagtgcaatttttctaggtccgccactggtaggaagtactcgcggttgcgggcgttgatgatggcgcacagcacgcaagcgaagagggagcagtcgcgcgaagcgcttccaaaaaccttattgtcaccttctcccggtgcaggacatcgaagacgaatgttccagagacctgctctcccgatcgccagtgcatgccgatgagcgggatggagtagactacgagcgacgacgtaatacagaggggaggcaaaccttagattgatttcacctgtattccgtggaggcagtgactcaacttatatagaaatatcaggacgcctgcatgatctccactccacgtaatcgaactagataagtcacgctcaacttatccagactccacgccgttttatgcaccggattattcagagtagactatgagcgacgacgcaatatagaggaggaggcaagccctagattgattccgcgtgtgttgcgtggaggcggcggctcaacttatatagaaatatcaagacacctgcacgatctccactccgcgtaaccaaacctgataagtcgcgcgtaatttatccagactctacgccattttatgcatcggattattaggagtgtttccaaaacaatcaaatccgaatttaccgcagcaaaacaaaactgcaaaagaagactgcatctgcgcaagggtgagaaaccaattttggcggacaattgcatatgtcatgcacgcaccgccacgccatgccatgccaggcgagcaactatgcgcatgttccccctcttctctccacctcacatgcctcaagtggctaggagagcatcctcccttataaggagatcttcctttactatctagaatagtcaaggtgtactaaatttcccatccatgccatctcataaggtgggcttttatgattttctaaagaattaatcttcgaatgggctaaggtctagctattaattccgacagctcctaatctcttttactttgttctcgttgttaacactggcccacctttcaccgccggctacacagcttcaattcatcgttatgctgtcgctcgcacgctgctatttcgctaagcccggaaagttaattttcccccctcacctcctatacccactcttcccattccatctgacctcaaccgcgaaccctaactgattgggtcgccatcttttcgcctgagcaagagaaggagggcatcacattcccgaatgtggtgtggatccattggcggaggattcaacgtaaatctactagcataaataaaggtcaggtttatttctttaaatgaaatagtgctacctctattttgtaaaaaaaaaaagattgaagtaattaacaaacatcatctaaataaaaatgaagggagtagtccttaatttaataaaataaacttcaccacaaagtttttttaacaatacctacgttgtattgtgtaatttaaaaaaatagaaattaatgctaagctctaaatctcgcttggccgaatccttctcagcctaattccttttcttctcttcactctactactgttcccctcagattggatgggcctaagcccatattctctccttttctttcgggaaaagtacaccgaaggtccctaaacttgtcatcgagatacaaaatcgtccttgaactacaaaaccggatacaacgcatccctcaactgacaaaaccagtgtaaactaggtccctcggctgttttgaccccggttttgaccgacgtgacagttgactcagcgtgggacccacatgtcagtctgtccacgtcatcacccatctcttttccttcttctctccgttccttctctctcttctctccttgcgacgatggtggggcgcagccttgcagccttgcggcggcggcgtgaccctgtggtgggctggtgagggataggcggcggcggcggacctgctctgcggtgcccggtgagctgcagcgccatcgacgctgtctctccccgttccccttttttttcttttatttttaacttgtttctctccctcgatgccgctgctttccatggcagctagcgtggaggttcgcgcaggcgcagcggctggatgtggccggatgcgaccggaggccaggacgacaccgcccacagccgtcaagcccccacccgccgcacacctctcccaccggccgagctcgccgccgccgtctgcaccctacaggtcgagctactcatcgccaccgtctcaatggcattaatgtctcatcgccagctgctcccggccaccgcccgcttcaccaccggttagctatcccggcattaatggcgatcgatggctaggggaaaagccgcgacgagaagggcggaaaccacggcgccctcgacctcgctgagagacttcggtggtgggcgccctagcaggcgaccgcgatgaggtgcggcgcggctgcgcgtgctacggcgtgaaggtgcgcggcttctacgcggaggatgttagcgacgaggggcgctgcagccgcgctcacgacgacggcaacgagtgacgccaaggccgcggtcacgtgggcggcgagtggtggagcgaccgcgcgaacgacgactaccaggggctccgcggccgtgcacacgatgatgacgtgggtc

SEQ ID NO: 15968 - DNA, 5095 bp, Oryza sativa
gggggggactttgacagggcacgccgcgtcacgaacgctgtgctcgccgctgcagaccctatgggggaggagacaagggaggccatggcggtgcccaaccgcgatgtgctcctctacatgagtcgcggtggagcccggtgtggcatggcgccatccacggtgaagacgtccgcgacgcgaagacggcctcggacgcaacggccgctaacgtcgcacgcctctttgccctctacctgccagcactcacctacggcatccacaccaacctcctcctccgcctccccttctcctgcatcgccgccgccaacctcattccctcccgcctcgcgcccaccggctagctgcctagactggacagagaggaggaagggagagacatgggaaggagagagatgatgtggatagattgacatgtggggcccacgtgggtcttacgctgagttagctgccacgtcggtcaaaactggagccaaaaccgccgagggatctaatttgcataagttttataagttgggggatgtgttgtatccggttttgtggttcaaggacgattttgtatctcgacgacaagtcgagggaccttcggtgtaccttttcgttttctttcccgcaggggctaagcccatcagcctagacgcactgccctccctagtaacaaaacccatgcaccagaccaggccaatccactctctttcctctctttcctctataggcaatccaatcgacgcagacgcagacgtagaccaggccaatccactctctttcctctattggcaatccaattgcgtctgcgtcagactcaacgcggcgcggaccacggaaacggagcctgcgtctgcgtcaagccgtccacgcccgcgcgccgccaacgaaccctcgacccaaaacgctcaggaggacgccaccgccattgatggtccgagctctgatctgcttcatctcaccacatctgatcatctccatcggaggcacgaagtatggtccagtggttctttcttggaagtcctaaagaacacaatcgatctaggcgaaatcgctgttcggttggagatcggaggcggagctctaggcctccatcggtcgtcggacgccgccacaagccccacaacctgggagagtgggcgctgcttgcctgcttccattgacttcctcttcagccgcagccgcctacggtgatttaagtttcctctcatctggtctcccttcaatcggcaccaatattccgaaatataatccgaatggcctgacaaccaccaacgaacaaataaatgcatatgctaattgtgactccatgtcgtagattttcaaaattggtactctctccgttgcacaatctaagtcattttagtatttttcacattcatattgttgttaatgaatttagtcatatatatccatctagattcattaacatcaatataaatgtaagaaatgctaaaatggcttagattgtgaaacggagatattgtgaaacgaaggaagtacaatttatttgttcgtggattcagaattggcaaaaaaaaaattagtttgtggaaccttcaaaattttgtcttctgctaattatgtgtccatgggattataaaacgtgtgttaatcctttaatattacaagttaacaactgattctatgcaaaacaaattaagaaatatcatgaatcatcaaaatacttcaattatttctttgtacattgtttgaacatgacatttttctatatgttcatgcacgataaagacataatatccccttcctcaccccaaaaaaatccccaacaattaaaattttatttttctaatactttgtaatttcaatagtttattctacaccatattcactttactttcatagaaatttcattatttatattgagcaataggtggctaacttcgtaccccattcttgaaatcacatgtgtgtcattgtggtcttaggctgtgttcgctgcatgcagttgggaacatatctccagcgcacggaaaatagagcaatccattagcatgtgattaattaagtatttgctaatttctttttcaataatggatcaatatgatttttttaaagtaactttcgtataaaaactttttgtaaaaaaaataacgtttaatagtttgaaaagcgtgcgcgcagaacacgaggagatgggttgggaacccatcctgccgaacaaagccttaaacttgttccgaaaatacttctaatcggtcgtccgatccaaacataaaaatcgaatggctcttgactaacttctctaacactcgtgactacacatcagcacatgcgctgcataccaccttttgccagtgacttgctactgcatacctgttgcttctctctctcttgtctctgcactccatactacttgcatgcattcatttaataatatacaaaacgatttttctcctaaattacttatccaatatacaattcgatcacaccattgtattcgttgttattgaacctttacaacaaaatgtcacatgattatattctaataaagaatagtcatatgtttcgatctgttaacattctttgtttcatacgtaatagcgatatgtttcaatatgtcttcaacatgtttcacaaaatttccaaaactaactgcactactctctctccacctcatccatacatgcatgcatgcattttaacaagtttcaaaatattttttctcctaaactaattatccaatctacgatccgatcacactgttgtattctttgtaattaaatctttacaacaagatatcacatgattatattttgatgaaaaaaacatatgtttcaatccattaatattggttgtttcatatgtgatagcgatatgtttcaacgtgtatcttcatcatatttcataaactttttaaatgtttcagttactgattttttatttcacactaaataacttgatgtttcactcgttagttaattgaaacatttgactaactgatttcttttttttgcatgttggtggtgtgatgacgcgcagcgtccgatatttggtggaatatcggacgtccgatgcggagtcttctccaacttgttcagcagttatctattcctttcccggttcacctgtcttgattagagatcacctatgcaatattgccttgttcggtatttatctattcctttctccgttcatctacgtttcactagtgaccactgtgcgacatcgccattgttaccaggattccagctagttcttggagctcgatccgagcaattccctttgtctccacatggctagagatttgagagccgcggttgaagtcgccaatggacttaagcaggtaagcctattcacaattgttctattggacactattaaacatttttgaaagactttttgtaattaatgtgtaatattgaaagtcaaaaaatataataattatcataattggtttgtgtgtttgatgacattagtaaactttcttctttgattgagagggacttataaatttgtgaagaaaaaatatttgtaataataactaaaatcaataaattttctcaaaagaaaataggaagtgagcttttcaaaaactctatatgaatttaatgtaggctatgctataggagaaatgcctgactcacaattgaagttatcaccgtaagaatatccttcatcctcaacaatcatgttatgcattatgatgctttgcagcaatgactttaataagaaattctcatactaaaagatgagttgtatacgtacaataacaaactgagaacgtcgaacaacaaatgcacatgtgacatctttttcttgccccttctttgtcttgtgcagattacttgtccttcattcgtcggggctactctctctttttacatgaacacaattttcaagatggtgaacggtgtattcttaagaaacattttatttaaaattttctttaaaaatcaaataaatttacttgtaagtttgtcattgttaatacttgactaatcatgcgctaatgttttaattttttttccacattcagctacgccacttgagcagaaacgaatgggacctaagagtgtcacataagattaggtgatgagatagaggagagaaacatgagccacatctcttatgcaagggagaagctctatacaaacataaaaaaggtgtgaaaatattagtagtattggaatatgtgtattagagatgacatattggttcctagtcacactttgccatcactaaccgagaaaagttatcacactttgtctaaggtgggtgatcaactttctcatttaacaccggaggaattgcattacaggccaaacaagtgctcttcttgtagtcaaaatgtttcctgttcgaatccactgaaatgagtggattaaattttggattaaagtggcacgcttttcaaactgctaaacgatgtgtttcgtgcgaaaactttctatatgaaaattgttctaaaatatcagattaatccatttgtcaagtttgtaataattaaaactcaattaatcacacgttattactacctcgttatacataaaacacttaatctttatcttcatcatctttacatctttaggagattcaaaccccacctaaatcgggatcttttttatcttcctctctttggcatgtagcacagaagttgttactagatgccgaggtacgcttggtcctgcccttcaatactctggagacaagttgagctcaggctgagtcaaaacagcctgttcctctaacaatttctcaagctccagaatgtgttgtggctgttctttcaaggagagaatttgagcagtcagggaggagcattgtgttggtagtttgaactgaatggaagtctagagtaaccttggcctgcccaggcagcagactgcatagaaggaataagttcaccggaggtccctcaacttaacagcaagattttttaagatcccttaaccacgaaaccagaaatctccactcctaaactatacaaaaccgttcacttaaagcccctaggcagtatatatgggtggtttcgctgacgtgacatcttagacaacaaaaaaaaatttaaaaagtacgtggggcccatatgtcagcgggacatatttttttcatctcttttcttggccttttcttctctcttctttcttct

SEQ ID NO: 15969 - DNA, 2847 bp, Oryza sativa
gcgggcagtcccgactcggcgcggatggtgacagagcgcgaaggaggcgacgagccgacgacggtcgacggcttgggccagcgaggatgtgatgccgaataggggcggtgaggaggcggcattggcagctggggcggcgaggaagcggcctcggctagggcacgacggccttgggcgcctcgtcagggactgccggcgggaggagttcgtcaatccggtcttgtggttggagagctcgatcgggatggtcatgccgtggagcacctcgacgacggtggaggagggatccggagaagccatggtttccgccgcctcacgaattgccgcggtcgcggccgcagaccccaccgtccccaatttagcgccgcaggaaccaccgctctgcccgaagcccgccgccgcgcgctccgcccgccgacgctccgctgccgtgcgggcccgctgccgtgctcgcccatcgcagctccgctcgctggccgccggcctccctaaccaaagaagagaagagggaagagagaaaagagaagaggagaagaaaagagaagaaaaaaaaatatgtgccgctgacatgtgggtcccacataatttttttaattttttttgctgactaggatgccacgtcagcgaaaccactcactagggaccttgagtgaacagttttatatagtttaggggtggagatttctggttttgtggttaagggacctgaaaaaatctcgctgttaagttaagggacctccggtgaacttattccctgcatagaataaccttggcccaattaaattcatcgggagaaaggagcacagcagcagtgaagaaatcggcccatttatgtggtatataaactattgggccagaggaaccatctggcccagtcaacatgcttggcccacagatttgaactcaaatgccgggaagcttgtgcagcgtatctcatatttttcagataatggaataatatcaggcctttgcttccaagaaactacagccacttatattacagagtcagctaatcaaagagcaaataaaattcaggaattgaaagtgcaaagatgagcgcggatgataccggagaccaggatattatggtgggcatatgctctgtttccatggagaggtaattgggaacaatttgatctgtctgttctgctaacttgtcgtggtgatgagaacatgttgtgcgtgatgtgaaatactccctccgtcccattttaagtgtagccacgattttccatacccaattttgatcgtccgtcttatttgaaaaatttttgaaaaaaatattaaaaacataagtcgcgcataaagtattattcttattttattatttcataacagtaaaaatactaattataaaaaaattaataagacgtacaatcaaaattgggcacgaaaactcataattgcacttataataggacggagggtgtatgatgaaccatgggaaatctccacggttcagacactggttcagctaaggtaccaaattattcctgcaattgtggcatatcctggagagtggagacctgaactcctgaactgaattcgatcatggccatatgtagatctgcttaacttcagtgcaggtctaaaaatcttgcctttaggttcgtgagcgtaccagttgatttgatcctgcaatcaacaagaaataaagacaaagaaaccgcggttaaatccataaatgatagccgattggccagccaccgatgacatatcatttatcttggagccgatgtcatatgtaaatcgatcggcaatcatgaataaataagaatgaactaaatctacttgatcggttgtagatatcaacaatatataatccttatatcgatatatacttaaatcaagtgattgggatagattgatcgtcatgccgagacagtttaaatcacttagatcaaaatatatactaacaatgacattatagatgtttatagcatagccgatcaaatagatctagcatgtatcgactaatactccgataccgctctatattaagatattatagcaggaaaaatatattaaacaaaagcctaatatactctgttgtaataagatctttaacataaagggcagatctagcatatcaatcaagcacatagaatataaggctaaattaggtaagatcagctgaacccctgatgctaccttagtcggcaaccaaaagcaggctagagattgagattctaatcacgacttataagatcaaactcaactgatgctactataagtataaaaagaaggataatatctagacaataaaacttgtttcatagagtggtagataccctgtataatctaggtcaacatgcatatttaacctaatcggctgccttctaataatagatgttagccgattgaaggttagatagcgatattatcaaagattatacagaatatatgataactcgacgaattacataaataagattagagtatcataaagatgtaagcactaatcccgagaacgcaagccgccataacaagttttacctctagttgaagatcgaaaccgatgcagctcaacccgaaagcaagaactcgtcgaaacaaaacgaaagtaaaagggtggcgatgcgccgagattgtattgaacgtgtgttgttgtattacatggggctcggggtctatttatacccaagattacaaaatatatccgtgtcggacacgacacttatctctaacaaactctaagataccataagtctttgcggcagatttttgcccaaaatatctctaaggaaattacataaaataacctaattaatagatacaattgtcgtctcaggactcaatccatgcatggcaactctcatgcaatacattaactcaacccgacaatgt

SEQ ID NO: 15970 - DNA, 1580 bp, Oryza sativa
ttcctcctcttttttatatgacaggtattataatacctagctttcagaacgaaagccaaataggatacacataagtcgttttacagaaaaaaagcaatagaaaagaccagacaaaaggcatgaccagcatctgtaggatcgaaacacaacaactaagccaaccagaggggggtgaatggttggtataaccaaaaaccaaaactttagcggaaataaaagttaccctcaaattcgatggagatcagtctgaccaagattgatctgccggtctgatcgtgcctatgccgtcggtctgaccggtgttgatctctcggtcggaccgccctggaatcgcctgtcgcccctgttgccaccgccggtctaaccgccttgcgcccgccggcctaacggccgcgatgccgccggtctgaccgccggtgtgtcgctggttagaccaccgaaacccggtgaaacacaaatcgaagaactcttgaagtggatgacgactttattgattctctctatgtttacaaagtgcaccaacagcagtcctcacaaaaatctcgaggaaactcgaaaccctgactcaactatcagctcaattgctcttaaaagcgataccgagaagtctcacgctccccctctatttataccctgaggtaggcagcctaaagccacaaaccaaactcatactagaaatcctaaacaccttaggaaactctctagtaaaagaaacaaactttgcatacccactcataccaaatttggactccttccaaattcgactccgcatcccatacgcacacaataactccatcgtatgccatatggaatcttcaccaaccacgtgtattgaactctagccttagtatcctgcatgatctccaaccaccacggatgtcgtcttatccgcaaaccgactcccggtccatcaccgcaaatactctcctgaggcatcgagtcacctacacatgaaataaacaaagaaaccatattccgagaccaagctatctccaacttgactcattgttagcaaacaacagtattacatacgcatagtatccatctagaagccataatcatgaaacaatcacggatatccaaacaaacaacccgaaaccgaaaccgacacagagtcggccggtcagaccgcgggctgcgccggtctgaccgtgcgatacacgccggtctgaccggcaaccgcagcccggtctgaccggtcacataaaataacagcacctgtaattcacctgtaaatccaatcatctccaaaaccacttcgtgaataaattccaaacatcaaaactgataatctccgatgccaattgtttatcacagaataataataaaaaacacctttaattttacagtctcccccttgatgaacactttggcaaacccataaaaaattttttggtgtttggaaaaaaacaaaagtggtaaaaaacacacttcgtacaaacgtacacatcatgctcaaaagtccaaaagaaaacttctctcacttttgaaaagaaagaagttcccaatcgaccaaaaacaacatgctcacttttcaactcatttacttctccaaaaaatttcaccttgcgtctccccct

SEQ ID NO: 15971 - DNA, 762 bp, Oryza sativa
gatagaatttaagtgtcatgcatcatcttccttaaaagcaaaatctaaatctcatgaaaagagtagtatacatacaaggtatgttagagacaaataaaccttcaaagtatcgctagcatgcacaagaaaataccatatgtataacacaaagctctcttttctcaatttttctcattatcatatttttgcttgataaagccatgaggtgcaaaactccccctcaaatcatgccaaaaggatgaaatattcccaattcaccatgaagaaaaacaaagcgattagaatccaaaggtttagtgaaaatatcagcaagttgcaactttgtgtccaaaaaatgcaattcaacatctcccttctcaatatgatccctcaaaaaatgaaagcgaatatcaatgtgctttgtgcgtgagtgttgaacaggattcttagcaatgttaatagcactattattatcacaaaagagaggtactttctcaaaagtaagacaataatctttcaaagtagataaaaaccaaataatctgtgaacaacaactagcagcagcaacatattcagatttagcagttgattgagcaacattagattgtttcctagaagaccatgcaatcaatgatgtaccaagaaaatgacatgttccactagtacttttcctatcaattctacaaccccaaaatcagtattggaatatccagttaggcatatggaagatgaagtaaaaaccaaattccaaactcaagtgtatgattcaaatacctcattatt

SEQ ID NO: 15972 - DNA, 566 bp, Oryza sativa
atcaaaaagatgcagaaccgggacacttattactagcggccttaatcatttgagcattagaaaaatcatactcatcaaattgttgggctactgctagctcccaattaacataagcggcggaatcatacttaccatcaaaactggcaatttagattctacccttgtaagatcattatcatgtatcatgatttagattctacccttgtaagatcattatcatgtatcatgcgtgaagaagtcgctatatctcgttgatggggaagatgttgacattgagcatgaccatcttgtttccccttgcgcaatcctgccatggttagcagcaaacaagaaacatacacaagaatatacacgctcctatcaactactaggtagtggcagctcaaatctcacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctatggagctctgggtaggcttaaatatgt

SEQ ID NO: 15973 - DNA, 564 bp, Oryza sativa
cataacaatacatgcgtaaatttgagtcacctagggggctaatgagttgtttttttatcaagtcgaccaacaactaatgctaaaatagttattttggcactgatgatatttattttcccaatggtcttcatagttgatttggtactttgcaaatatagagagcgtaaaattggtgccaagaaacatgccaatcatcgaggcatgggtgaccgtattgagaatggattacaatagatcgtaggtgttgtggattgtagtgaagagtgtgatgaccgtattgagaatggataacaatagatcgtatgtgttgtggatcgtgatgaagagtgggagctaccgcatgcttatgtaatacttgcttctgctttggctgactgccatgcgcatgtgcctaatgtgacaagcctgcctctgggatggattgccatatgcatgtaaccatgcgatcaatccttacgagaataggaggcaccagatgcatgtaaacgtactgatggttgagttatagatgtaggaggagatcgatattttgtggcacctttccaaactcttacgagaaatgca

SEQ ID NO: 15974 - DNA, 647 bp, Oryza sativa
tggtttatattagccctaatcaatccccacgtgcttgatgaatagtctgaattccagataatatccgtggtgattctctggcagatgtaatctgacatgacctcctcctactaatagatagattgaattctttactaagcagagcattgtgcaccaagcataattatatccgggccttcatcagcaatacgcagtgagctcgaaactgattgaattttcagtgagcagtaaacgtctctctcttttctatctctagcgtgattttcgagtagcagcaaatgattcttcccttcgccggtaaggttcgggtcacatacctatacgcgcgaaaaacataatggctcattacagcatgtttctcccgttacatattaaaccgctttatacttgactattttatagaatagtttagatcgatagcccaaaatgagtttcgttcaatatatcttgataatatgttttctgagggaaacgatgtgatatttttacaaacatccaaatggagggagtgatgaatgaacgatcagcttaaatacacttgagcagtagaatgaaggctgtttttaaaagtattgtgcgtatatatcttttgataaaccaatcacttaccggctgggaaagtacctaatacagagtttatgtagggc

SEQ ID NO: 15975 - DNA, 451 bp, Oryza sativa
ctgcagccccacctgctccgtgcggaagttggcggatccaccgaaggtgaccgggaggtcgatatgacctagcggccaagtgtgacccggtgtcacaccgataatcggctgggacggccggagcaccatccccggggccttgatggcgtaaaaggctgcgggggaaaagatgttgagggctgctcctccatcaatgaggacacgccccagcttcacgttgcaaacagtgggggaaaccaccattgcgatctgttctccccgggcaacgcacggtgggtggtcggtctggtcgaaggtgagggcaacctccgaccaccgtgcccggcgcgtagtctcatgagtaggggccgcggccagaaactctcgcttcatggccttgaggctccggcgagaaacgtgagcacacgctccctcatcgacagtggcaatggtggccccaggctcttggaaa

SEQ ID NO: 15976 - DNA, 587 bp, Oryza sativa
taattgagttgtattgggagttggctacttacaaaatatgctgaacattccattaatactgctgtgatgactagcagcagattcagaactttggagatcctttttatcttgctatccgtgaaggtgagactttagcagaagtaaaggagcgcatacagaaaaaactccaagtccctgatgaggaattctgcaaggtgatccatctgttgaaggtttctttattgaaaaaaaaggtccggcttggggggggaaaaaaaaatttttaaattttgggaaaccccaaaaatttggggggctttggcttgctctttatacttgtccaccttgggattatgctgatatataagtcagattcagagttttgaagtataccagtctagtggtttcttttactgtagggagctgagagttctcatattatactgcagtctaaaattccctcactaattctcaaaaacagtggccatttatgatacacttagactgtcgtgctcattatctcttatagaatggttagccatgtgtgttacgtgagccaaatctaatctatgtgggtgaaagaaaagaaataaactaacatgtatatt

SEQ ID NO: 15977 - DNA, 23726 bp, Oryza sativa
  unsure (1)..(23726): unsure at all n locations
nnnnnnnnnnnnnnnnnnnnnnnnnnnnnnnnnnnnnnnnnnnnnnnnnnatggatatgctagtttggctatttaaattgtatgtaggtgatttgctttcaaagacgaccttaaacggtaagtcaaagaaagaacttagtacatttttattatgggttaaggttttccgattcatgatctatacaattttatttcaactcttatgggagttagaaagattatttcgagcttgaagtgtatcctacaaaaactcattaacacattttttcccgaaacaaaaacaataatttgtaaaagtatcttcataatcaatccgtggttccttttccttctcgtctatgttttatactcttatagcatcagaaaaactttgacacttttaatttctttatattttactatcctatgtttcaaacctgccctcacgatttgagcttacgtgctataggaaaaggtaaggaaaaccaactaagaaaagcatcttgtccaaacataaaatctcaccaaaattctcattgtaatccattttgttttttcattagaacatatgtgagttggttatgcgaaatacgataattgtacggtgacgattaaatttactgagcttaataaaactttcatcattaagaaaaaaataaaatcacatcgaaattcgaggggcagagtaaaacggcaaccggcaaggaaaaggaacgagatttctgcttccctcgatctctctctctctctctctctctctctctttctcgctcacctgcgctgcgagcctgcggcacacgaaatccccaaaccacccccaaccttccaaaactcccaaactcctccattcctcgtcgcactcccccctcccttctcctccgcccccgactcgctgcttccacctccacccgctgctctcctctccgccgccgccgccgccgccgtcgccgtggaggccgtacgccaccgctctcaccgacgccgacgacctgcaggcgcccctctccatgactatgatgacgcctcccccgctcgaggtaagcaaccgcctctccgcgcgcgcgcgagagagatagagagagagagagagagagctctcccctctcctgtctacccgcccgatctccctcgctagggctgcaccgttctccggtggcccgtgcggtgggcgtccgatcgggtggtgccgcttttttgctagggtttatgcctccgcgctggatctgacccccctttccgtttttttctttttgtcgatatgttctttgcgcagccggaggaggacgagatgctcgtgcctcaccaggagctcgtcgctgctgacgccgcccagcccatggaaggtgccatgttgattgctctctatgggggttcactgtgctgctttcctttgcttccgtgtgatttgtacagcgtggttttgtaatgtgtggtgttgggagtgtttgtgggttggtagtaatatatgctcgtggtttgtggtagcagtggttgcgcaaacggaggcagctagcacggcggagagccagccagctgaggacccgcagacgtcgcggttcacgtggacgatcgagaacttcacccggatcaatgcgaagaagcactactcggatgcgtttgtcgttggcgggtacaaatggtgagctcctggtctcataaaaagggtagttaatggagttagttttctttttgaatgtttggatgatagtaatgtttggcgggctttcatgcaggcgtgtgctcattttccctaaggggaacaacgtggaccatttctccatgtacttggatgttgccgactctgctaacctcccatatggttggagccgatatgctcagtttagcttggccgttgtcaaccagatccaacagaagtatacgatacgcaaaggttatggtcctccatcatgatgtttacaactccttacgtgaatacacttaaaatgcaaaagcaatacatgataagcttgagagtatgatgatgctatactttgctatgtttcactagttgtcaaactgttatcacggcgtagtattcaaaaacttgctcctcttgaggtcagaggtcgtgctttcatcaagtaaatggatgccatatgtttgaaaatggttctatttgcttgtcaacctttatgatcttgcgttatcgagcaccttgtttggtcttgttggcatgcttgcacggaatatcctgatgggtacactatagttttctgttcaatgatttggttgaatcaaattgttcctctgttacacttacacatcattatatcatgatgaaccacaaaaggatatggttgtttaaatggacccgctagacagctgaaggttctactgtactcttctccttcgcagtttgggtcttttatccaagctcagattggcaatgaccatgattgacatttctatttgcaagagctctcacttctccaaggccaggttcccctagtgtagaaaaagaggttctttatatttcttgaacatgaaactcctctcagactcaagagtgttatatttgtatttgtgctttgcttcttctaggcttttctgttttataaggccacttttacttcctgtatatacttttgcttcattccttataatagtcattagatgatctcggagttgtgtggccccatgcttgcaaatgctaggcctcattgttttctttggtattttgagttctcttagctagttaaggaggcatactgctacttgatcaaatgatgctgagtagatctactttacgttggtctgcggatttcagtgatttgtatgggataaatctatcactgatggacctgtgattctctgtctggcagatactcagcatcaatttaatgcacgtgagagtgattggggtttcacatcttttatgcctttgagtgagctctatgatccaagtagaggataccttgtcgatgatactgttgttgtggaggctgaggttgctgtccgcaaaatggttgattattggacatatgattcaaaaaaagaaacaggttacgttggcctgaagaaccaaggagctacctgttacatgaactctctactacagacactataccatataccatacttcaggaaggtgtgagatcatgcatcataattcagagcattctagactattgtttccagaactaattgactaacttcattattttacccaggctgtgtatcatatgccaaccaccgaaaatgatatgccatctgggagtattccgttggcattgcagagccttttctacaagctccagtatagtgacaatagtgtagccaccaaagagctgaccaaatcttttggatgggacacatatgattccttcatgcaacatgatgtacaagagctcaacagagttctctgtgagaaacttgaagataagatgaaggtgacaaatctggtatagagctgtatatatgctgcatgttggctgctattaactttgctttcttcctagagaactgtcgtagagggaacgattgaaaagttattcgaaggtcaccacatcaattatatagagtgtataaatgttgactataaatccaacaggaaggagtccttttatggtaggttttgtcctggtaccagattgtgggttcacattagatgtgtttcattatttattgtcaagttaatgctgtattatggccatgcagaccttcaacttgatgttaaaggttgtcgtgatgtgtatgcatcgtttgataaatatgttgaagttgagcgcctcgaaggtgataataagtatcatgcagagaatcatggtttacaggtacccacatgttcttctcagttctcactttaagctttgaaactgaagctagagttggttgtttcataaaggtttgatataacttgtggacttttatgtatctatgaagataaagggaatctgcatcccatatactataacagcttgctccatctatattttataaatgaagcccatttttattggttttggtgccaattcttgactatgtttttttgatattgtctcaggatgcgaaaaagggtgttctgttccttgatttccccccagttttgcaacttcaactgaagcgttttgagtacgactatatgagagataccatggttaaggttgggactgccataaccttgccatttatattctccatccatttacctctattatttatgttgtcatgtgaatgcaagacctgctgtgcaaaatgacacccttggaggcttgattttatttttacatttggagaacatacaacgcaattgggaaaaaaatgaaatacttagaaattatgaaaatgactaatgattgctgtaaacatgttaacaacttaacatcttcatttaaaactatttatggttaacgtagtatgctattatgctatactatactacctccgtcccatattacttgtcgctttgagttttcctttataatgtttgatcatttgtcttattcaaaaaattttggaattattatttatttcctttgtgatttgctttattatcaaaagtactttaagtatgacttatccttttttatatttgcactaattttttcaaataaaacgaatggtcaaatgttgcaaggaaaaagttaaagcgacaactattatgggacggaggtagtattatatatgtatgttctctcgagcctaattgatcttaacttgaccaaccttgagtgtgtggctgtgtgcacaatgatttgagcttgaccttggtgttggttgctctcaaaactcaaatagattgcccatcccaaagttatatgacaagttgacaacccaacatgcagatactctgtggatctgatgagttgttcgctttcttgatgcatgatcttaattcctaaaaggcataagtacaccaatgcaaatagttttttaacttggcgagatccaattccaaatgctgtgcatctcctgttataaatctggagagtcatggtgtcacatattggtattgcccaccaaaagcttgcctgttttgtttcttatttattatccaaattgattgggccatcttttatgataattgcttgtgcacaggaccaccataattcatggttgtactctcactttgagacttttgacatgcatcccttatcctatatatctataaagtttatccccactaagtgtagttaatgctatttctctcctctcattaagccacatcacctcaattctttctagctcttagatgattgatctatggtccaaattatgttcctccttttcttctcttacgaagtcttatcaccctagttttatctttgaatgattaatctatattatctcccttacctcattgagccacatcaccttagttttgctgttggatgattaatctatatataatttaaattgttataaaccatgtcatcttaaattgtttgtagctttttcttcaatggtcggtcaaagatgaaaattatgtaaagtattataaaattatattgtctagctatgccacatattatctactattattatacaaaactcccacagcaacgcgtggggtttcatcttgtatggcagacatctattccagtgtcacatactaattctcaataagggatgagaaaatattttgggcttgaatagtaaagaaaagtttccttttgctttttggtttaggaattttaacagttactttagagctgcaatatgttttcttccaacatgactggtagtttcataataataaggtgagacatcttaggtgattatcttatgttccattttgtttccctgtaacttctgtctcatctgcttttccttggttagacagttaacactgagccatcatttccttcaattttccctgccataaatgatttcaaaagacagctaacgcaacattaattcaagaaacattaagtggatcaaacgtttggatcacttcttgagaattgagaagcatgtagccgactagcctctttaatatctctgctgttcaaatactttaaaggtttacgttccggttctgagcttgggatttctgctattatgcctatctgtgcagattaatgaccgctatgaattccctttgcaacttgatttggatagagatgatggaaaatatcttgctccagatgcagatagaagtataagaaacctttatgctcttcacaggtagtgttttttatgagtatgtcattcacaacttactttaatggctttaagatcaattaatttctccatcacacgtcctaatagttcattatggtagttagggaaaccaaagtatcagtgggttcgttagtaataatacctgtttcttttatctacatgctatgtatgagcatgggggtagactactagctgctgtctgtctgtggacaaaaaacttggaggaagaattggttgatagtataaaatgggctgatataatgcgctatacaagtatatacctgcacgaatcttcatgcataatgactgagtcaattcctgagaattccacatcacttgccattctcttagcagtcattgtattccatattggttttagagttatggaataacagggttttatgtatcttagaaaattcagttttggtgagacctgggatcaagcaaataccatttgttatttttgtgtaatggtttcttaggtaccattttcagtgtaacagtggtgctccaataggtgccttttttcctcctttccacatctttttctcactatgtttcactgctgcttttattcagtgttcttgttcatagtggaggagtacatggcggtcactactatgccttcattcgaccaacgctatcagatcaatggttggtttttctttgactttttttttgtctctagtactacaacaatacaaaattattcaactatttgccatttaccagataatattattaccctgttcctatgcatggccacttgatgacagctgaatagatgtgttctccgagacaactccctggcactctattcgacaactgaaactatcttgttaggacctgtatctattggattgcagcatttccgaggcagatttccaaaaaaatattagagtgtttgtttctacacaagagaatatcatatctcaactagagttagccaatgttagtgggacgtttttacacactaacaaatttacataagttctcttaactggacagaaggccctcatgtcaagttcaacatgttactttttcataatatagttggttataggattctgtgttggttctaataagcacctgactagcatggacttcaataacttctttcaagctgatggtcatcagttatcacttatcaaaagaagtatgtggtgtgagattacaggaggaaaatcatatgccttatgcacttttattgtaagtggatgccagtctagggagtaaccacgctgcaacaatataggtaacttgcatatagaccagctgaataccatatattaggcatcaaatgagttgccaataaatcttcttaggtttagtgctacctcatgcaaatttctgttgaagaacctggaaacaagtgcaatatcctcgcattataattaattctacaatgattatgccttttgtcgaactatgctgttgaattttacatcctagcaaacagttcccaattcattatagatttttgaaaatgttatcctgtctaccaggtataaatttgatgatgagcgtgtaactaaagaagatactaagaaggcccttgaagagcaatacgggggtgaggaagaggtgtgttctacctgataattgatattgaatgatatgagatattgaactacatatgtttgttttcctgtttccgtaattttaatctcttttgggctgaacagttgcctcaaataaatcctggtttcaacaacgctccatttaaattcacaaagtattcaaatgcctacatgcttgtctacatccgtgagagtgataaggacaaaataatgtgtaatgttgatgagaaggacattgctgagcatttaagggtatgtgttgttttgcattctcactcctccttgggccaatttcctcgataccacgattggaaaataccatcgcatgtgtcaacacacgtgggcccaggccccatgggtcattctcatatgtggtgatattttacaatctgcatatctttacgatggtatttcctggttttctcccttttaatgtcatggacttctgatacagtttggatgataaactgtggattttcaggtaaggttgaagaaagaacaagaagagaaagaacacaaaaagaaagagaaggctgaagctcatctttataccatcataaaggtcagcatctgactactattatgttcatcacttcatctcagtctggaacctctctgtgaatctgtttctcatagtgctctgtttggacaaatatatctaggtggctcgagatgagaatttgaaggagcaaattggcaaggatatatattttgacctggtggaccatgaaaaagttcgtagcttccgaattcagaagcagttactgtttaccactttcaaggtaaggtgtgcaaacaagttcttggttcgtagcattggaatgctaaatttctgctatacgagtacacatgcttctgtaaaatcaactggtaatttaacttctgttgaataaattgtttaataggaggaagttgcaaaggagtatggcatccctgtacaatttcagcgcttctggttgtgggctaagaggcagaaccacacatacaggcctaatcgtccattgagtcctcatgaagaaacacaatctgtaagctagtcactttcaattgttggaagcaaactgttaaacccacacttcaattggaaattaatcttaccttattatttcatctaacagccttaggtccaattgagttcttacgatcttcccctgtctctctttctctcactccccacttaagaattttcttttatataggttgcagttctggagtattttgttgtatagattctctgctgagagtgctttgttatgcatgttatcagaagatcatgcacttagcttatacgttttttctttcaatgagcttgcttgtttccattgtgtgtttattgcttctgttctctttcttatcatctccagttcatttttatatgtatctgcacaggtgggacaactgagggaggtatcgaataaggcacacaatgctgagctgaagttgtttttggaagtagaacttggcccggtaatgatgtgctggagctgctaccatttctttttctgttttttacttattgttgtctgttatggcttctagatgcaggatacttaactttgtttatctgtttgatacttatggttatgcaggatacttattgttgtctgttttatcatttataggatttgcggcctctccctccacctgagaagagcaaggaagatattcttctgttcttcaaactctataatcccgaaaaggaagaactctggtacatttatttgattaacaccttatcattcttccttattccttcacaaatggctgacacataacattctttcactgattgcagttttgtggggaggctcttcgtaaaggccttgggaaaaccctcagaaatcttgaccaaactaaatgaaatggctggatttgtgccaaatgaagaaattgagctctacgaggcaagagctaaattcatgatgctatatttatgggataatctagtatatgtcactccattgaggcgtgttctaggagtaggtccagatatctgtctggcgttcagtggcaaattattaagtgtcaatctttggagtggcaattgctaagttttatatcgactgccttaccaagttgactgtacttatgttgtgtttcattggtacatgcaggaaattaaatttgagccaaatgtgatgtgtgaacatattgacaaaaaagccactttccgtgctagtcaggtttataacatgtttcttttggttaaggaatgccaaatttgaattaaacacttattgatttgcaaaatgctccaaatattgtagcttgaagatggggacatcatctgtttccaaaaatcacctatacctgatagtgacactcaaatgcgttatccagatgtcccttcgtatctggagtatgttcataataggcaggtatggtgcttatatttcccaacttgattccaattctttgtactgtaggtacaaggcgtttatttctttgttatttatatttttgtctgtaagctaattgtacactatctatttatgctgctactctatagttgcttctattaatatttttgatgtacttgtgtttgtggttctatgttctcttcacccagattaagtcatctagttgtctgccttttttttctctggcttgtacatcaccttcttggcttttttggctcgaggaaattggtagaagagaattggaatttacgagctgggggttattaaaacatgttggttggttggttggttggtgggtgcaggaagccgcgatgggtggttagttggtcccacttcttaccattttaactgatggaaaggcttgtttgaattggtggggcttaggcttaatgcctttggatgggctataaatggaattaaagttcccactatctgaaggaattgggtctaatctcttcctatccaaacaatgatgatgaggggtggcatttgggagagaattgctgtttcgagagagagggatggatctcagcctatatccttaggtttgtttggatatgagggaatatctatatccccatcagtccaaacctatccgaagcgattagaagggtttctttgtttgccaaacaaacccagggatgtggaagggaagaagaggtgatgatggtggcagatgtggctatgatgcggaaaagtggcagtgcaactagaaaatgaaaagggaaagaacaaaaagaaagagataaagcaaagaagtgacgggcagaccaatgcacctgtggctaacagaggggatgtatgaccccctaaggccacaccacctcatctattattctctctgcttcactcctctcttgctatccgcgcctcccctctcaccctctgatagacatagattcatagtaacgggtctgccagcagtgacgatctgggagatgtctagatggagcttggaggagcagaagacggcaattgcaatggtaaatttgcctctcttcttttcccctgaatctgcctcaattctcgccctgaatccgtcccttgttttgtctgtctgaatctccttcctacccctcctcgtgcctttctaggaggcctagtcaatgttctaggtggaactgtgatgcgactgcttcataccagaacttctgtggaggcaaggccagcacctacactgggctcttgtgctccattaaaaaaggttaatctgggtcttatggaggagttaggtgaggcaatgctgaatttggtgcaggtttagtgtccagtggctactgggagcccagatctgcactttcctcactggcaacctggctagatctggttgatctcagctagtgattgcactacactgaccatgccaccatgttagtttactgtccaccatcacgttgcccttgcttgccaacatgctgttgccaatcagttggtggagagagagagagagagagagagagaagagagagagagagagagagagagtggggaagggtagttgcagtgtgaaagaaatagaaggctggggctgtcctcctagagagtcgtgtttaggttgtagaagagggttctgcctgatcctggttgaatggcaatttttttctgagcccattccactacctgaattgttctatggtgtagtcctagagtttatgtactagatcaacatccactgcgaacatggcagtaatcttatctcataccactttaccaggctagtctggtctgatatttttagcttcctcggttaagatggctgtgctctacagtatggggccattatactaatttccattgattgaagcatgtgctatggacgcttgaaatgcatcatctcctgtagactgaaatggaagattaattatgtgctatgaacatggcagccacattgcaatggatgtcaaaacaaatacagtaatatattatgctattcaaacttctataaagttgaaatgtaaacaaaataattaacttcaaaacttaaaaaatgttaaaatgattacattagatcaatcaacaacctatagacgtgcacactatgcatattgtcataactgatatttcaatcgacatatgcctatattagtcacacaagttcttgtgtgtgaggggatgaccatgagctcaatcacctctagctccttttatagtagtatgcttataatgctatgtgcctttgcattctgtggttcaaaaggaaatttctcttgctttcattcacccccttctaatcttctgctatcatatgttagatgcttgtttaattttggtttttcatgctcatgtaatattatagtgggtctacctttttaatgatgatgccacttgctttatctatgtaaattttgtttactgcaggttgtgcactttcggttattggagaaaccaaaggatgatgacttttctttggaattgtgagtgactacaaaacctattgggttcaaactgtttaattggctaattatctagcatgtatgtgtaacgttaatttcttccccattctttaaggtcaaaacttcatacctatgatgatgttgttgagagagttgcccgtcagcttggtgtggatgatccagcgaaaattcgtctaacatcccataactgctattcgcagcagcctaaaccgcaacctatcagatatcggggagtggagcatcttttggacatgctcattcattataatcaggttaacctttcacctctttttgtttttttttgggtcagttagcatagtttttctgcataggtaaaatacaaagggatttatactatctggtgcagacatcagacatattgtattatgaggtgttggatattccactgccagaattgcagggcctgaaaaccctgaaagttgcattccaccatgctacaaaggatgaggttattagctgcaaacaatacatctttatttatcttcagctaccaagtgcatatattcatgaaacatcctttttttctaggttgtgattcacagtatcaggcttccaaagaatagcaccattgcagacgtgattaatgatttgaaaacaaaggttctttttttgctatcctttcattctttattacaagttatttagtcttgctctccagttttacactctatttggtctgagatacaccaatgcatgacttggatatattcacatgcgttctttttagggtgcacttctaatctcctttagaggtaagggagaaatggatactaactttttaagagtggttttgcatagggatagttgactctccaggttaccaaattgtgatgcaaaatgaaagtatcaagtgatataacttggttcatttaatccatgttctgttaacgtgtaaatactctatataagtacaactaggtgttaagcattgatactaatatatagctcgttgttgagccgcatattcaatttccatgtgactgcatgactgtttcaacatacttactgtgaaaagtactgtgaaacctcctatccatatgctttttgtactagtcttggttggttaagcaaatctggccatacttaataacctgatgtcagcttattgtactctcactaacctgtcatctatcttaaatgggatggaatgtttcaattattttcattggtattaccaagttatgctgtgtaaaccggcttgttatgtctctccatgtgtttgtttttatgtaaaaattctaattatgtcactaatcatcaggttgaactatccagtcccagtgctgaattgcgcttgttagaggtcttttaccacaagatatataaggtacttgtacattagctttcagccttcaagagaaataaaataccatatgtcctgatgaattccctttttttttttaaaaaaacatctgtttataatttatggcatggctgttactaattatagtttttccatagatttttccactccatgagaagatagagaatattaatgatcagtactggacactacgtgctgaggaggtatgtaatgttctttttggttgcatttggtgctccatttcgtgaactgtaaagttgcaatctatttcatttcctgcttgtgtcaaaatgtgcgccttcattctatcctcatatctgcttctgcttattggtacagattccagaggaggagaaaaatctcggtccaaatgatcggttaattcatgtttatcacttcatgaaagaccctcttcagaatcaggtagtgcacttcgatatgatcttcattcttgtctaattgagttgtattgggagttggctacttacaaaatatgctgaacattccattaatactgctgtgatgactagcagcagattcagaactttggagatcctttttatcttgctatccgtgaaggtgagactttagcagaagtaaaggagcgcatacagaaaaaactccaagtccctgatgaggaattctgcaaggtgatccatctgttgaagtttcttatgaaagcgtggaattataacatgttttggcttgctctttatccttgtccaccttgggattatgctgatatataagtcagattcagagttttgaagtataccagtctagtggtttcttttactgtagggagctgagagttctcatattatactgcagtctaaaattttctcagtaattctcaaaaacagtggccatttatgatacacttagcactgtcgtgctcattatctcttatagaatggttagccatgtgtgttacgtgagccaaatctaatctatgtgggtgaaagaaaagaaataaactaacatgtatattctgatgagaatctctttgttgcattctctgccttttaccttgagtttcattacgtgccactatgtgatgcagacacagacactaaactaatatactttttaatgctatatgatcagtggaaattcgctttcatatccatgaaccggccagattacctccaagattcagatgttgtatctgcccgtttccaggtaaattattgtttgttccctacaggcttctctagttgtgcccataaatttgttgtgttctatgatttacaaagttttctgttctgatttcttcagaggagagatgtctatggagcctgggagcagtatcttggtttggagcatgctgatactgcaccaaaaagggcctacacagccaatcaggtatgctgctgtctggttgtgaacttgtgaagcgagcatagcgaattcttgtgcctgttacttttacctttattctgtcactcggcttgggcatatctatgctatacttcgtttatcttgctacctgcacttcagctggtttacaccgtggtatttcttgcaatctttttaaactttcatcaaatgatctttcaaaatatttgggctcgcctgatgttttagagaattctgttttaatccctcttagttatacatgaaaccaataatccggaattttattactccatgactccgtcccaaaaaaacttctggagtttgaattgtcacaaaaaaaccaacttctaccatcctacctaccctcagcacataaaacaagaagttttatcccttaaataccctttacctacctatcaccattactaccttttccaataatgaggggcattttggtcatttttactccccactaattttaccttgggatgctaggaatggtctttttgtgggatggagggagtacatgctgagcaatttatatttaggcatttaggtgtttacagtatccttatacgcaactttgagatggctttgctgctactgaagaaagatcttgtagttaactttgggtttccccgcaaacatcttcgcacttcacatacatttttctgcactgtacttgcactgtactgtagcattccaatgctcttttcttttatatgcatattgctatggttgcaaggacctcatcttaacgaaattttgcttcttccttttttgtttctggcttcaactaatgtgcagaaccgtcacacctatgagaagccagtgagaatttacaattgaaatcacttctgactgtgctggccccttggtggtgtcaaatctgaaagcagcaacagagagatgtagtatggagaagttaaactcgaacagggaaaagcagcaacaagttttggccatttgggtgccgtggcctctattcctttctaccggtgctgtttggatgcagaagtgcacttgatttcattgttcatgatgacaaatttttcatgattttccaccatgctttggggcaatggtgcgtgctattgaatttccttaagttgggtgtgaatgcccccttagggtagatgttgcttcatttttagagcaaagtttcggtacataagattttggtaggggggcatatgtatacagggtatagttctgactcatatcgacttcttgtctttgtgtggatgtaacaatggaaaacatcataccaatcttgctgtatggctcaattttatcttcctttcgcagaaaaaattaaccagaattactgccgcagttagtgcggcgctgggttccgtgatagtaatagctgatgtaagcgtggatatgatgtaattcaccagaaatatgaaatatcccgatttccttcgagaaacaaatatgaaatatcattgaaatgtggtacttcttttttcctgctgcttcggaaatgagtatattttgatcttcggatggttgtctcgttgatttaccttcacatgtggaattagacaattagtgttagatttggtctaagatctgctatcctggaggaaaaagattttgaattggagttttaaacactactacattctcaacccgttattgtcgtacggagtatttctctgtaaaatcgttctcaaactgtcgactgtagggttgtacatttcgtattcaattttccgtcaatggagaactacatgaggccgtacatatgctcatcccagtgaattggttagattcagcgggtcaatccgtacttctggtagacacagccgtataaattttcgtcgtcaccacaatttcttttttccttttttttaagaaacatcgtataaatgcttgtcaaacatgtgccctgagattgggtcggtatattcggtatattttgagattactttaccacaaatatcttgttataagtgaatatatcataaatggattattgtccctcgagaggtcgagggacgtcccctcgttttgtgcatgtcgttcaaaatgttactaaattttttaaaatttttttgtcaagatagatcaatatatgatatatcttttcacaaacatgcgagttaaaattcgacttatacaattcaaaacaaaaagaataaatttgactgtgaattacacattcacttcatagtcaaatttgttatttttgtttttacttgtataagttgaatttaaatttgcatgtttgtgaagtaacatatcatatattggtctatcctaccaatttttttcaaattttttaatgactttttaagtgacatgtaaaaataagtggatattcccttaaaggatgatttgagtgttccgaatatatggagtgtagaacctaaacataacatgcaagttccactataaatctggatggacaaaagttccacttccaccacaagtaactcacatgtctaataatatgtaaaaaaaattcattggtgctcacaaaaatttgtaggtggacgtgtttatactttaatgtcataaactaggtgttctttgaaaattggagttttccaagatgcaaaaatatatattaaaaaatacagcacttaaagtgcatataaacttgatttcaggaaatttttgcatcaacttatatattgacaatattgtccaaaaaattatatctcatgtcgcgtataaaatttggagtcacgcgttcgatattcttctctcgtcactacgatctcaacaaagctccagtccacttaacactgcaactcccaacctcaccaatggacaacccgacgccgtcgtcgagctccggcggtggcggcgccgccgccgccgccaatgccagctccgacgagcaccgcaagacgtcgccggcgacggccgctgatttcttcgacgaggagcacaccttcgacgatatcctgctcccggtggacttgttcgacttcacgcacggactcgacgccggcgacggctgttacgtagacgatcaggctgcgattgggcagaagccgctgtcgccggcgccggagccggcggcagagcagcagccgtcgccggcgccggagcacggcgacgatgagcggctggtgatgtactaccaaggacaggagtacatcttcgaccccgtgcagccgcagaaggtatctcttggtcttgctgcacaatgtgcttgtttcttggtaactttctacgttttttttttcattctcttccttggaaatataattatgtttcttcattctttgatcctagctagtacttgatgagtttcggctttaatttgtttgcaagaatttggttagaaggttttgctcttgtataatgtggtatatttaatttgctcttggataatttgtttcggctttaatttcattttgatcctgaaaaataaggagctctgttcttacttcttgcatttcacctaggaaaattagtagatacgcactgaaggcttttgacttaaaaaaggatcagactgttattatctccccttttgcattgttttttttgagatcactctacctttcttttgcattgacactgttagatacagtacttatgagcaacatttgtggttgctttttttaatatttgtggctctctgttggattcttttgctatgttgagttggttatcctcctgttgcattgttatgtatgcatgagcttggcatgaccaattcaatgtttgtctcttagcttgtagctaatttagaacgcgttgcactaattcttgtttcatcttttttttctctgatcattattggatagaagcagaatttcaatcttaaaatgttcttcttcgatgacaaaatttgtagtgtagttttatttttgcgtagccgctcaacacgagtatagtacttactaactccattccaaaatacaagggattttgctcggaagtagtgcatgctatccatgattcttttcctaccatgtcatgcgctcaagtcttctctgcattcttgtttccagtgcaatattgaaaaacttcactatatttattatgtattgctacagtttaccacttaaatagttaaataacatcgtattacagcactgacaatattgtgatactgttacacagattgaaaatatcttccaccatctgaatggacaggagatgattccacagagcatcaggccacaacccactaacctggtaattaaatcatctgcatttttcacaaccatttgaaaaaaataactgcattgcagatcactctctgcagcagttgtcctagcagattacaacttctctgaacttttcatcaggtaagacccatcactgttcccgaggacttcgacaggtttgctgcgctgacgcggtatagggagaaaaagaggaacatcaagttcatcaagaaggcggattacagtgcccgaaaggaagtcgctttgcggtacgcatcaaaatcttcattccgaaatgttaatttggtccgcatttgctagtacttaacaaattttggttcttgtgaatttgctcattcaggatgaaacgcagcaaagggaaatttgcacctagggttcagacctctgaaaattccttggcacacagaaaggggataactttgtaagttcttttcaacagatatatacttctgattttctgaaaccttcattgcattattgcaatgtggatgctgcttgttgatcgtatactatttttaattcatgcagctgcaccaactgtggtgaaagcagcgacgccacacccatgatgcgccatgctcccaatggaaccaaatcattttgcaatgcttgtgggttgatgtgggcgaactcggttagtgtccacatattccattccttccccttatatatcttgaaattttttttgttgaagcaaatgtttgcttgaatgtttatatgggttactgaattttctaccttcacctgcagagaaaaataagaaagatcagaaacccaacttccggggagcaagaagatcaataatactcaggatcgtttcatttcatcgatggcattcttctttgattcgagtgcattccaatcgaagtttagatgaaacagaatatagaacaacgctgatagcagctatagagacgggagagactgagagagctttgttcttgtagtttacctccggtgtgctaggcaccaagtcaatgatagtgagtagtgatgtcgtaatttgaattttgtagaggataatttaatctttgtaattgaccctgaaacctctgaatattctggatttttttaaaaagaaaaaactggctgttttcgtagcagtgacgtagaaatagtcatgcgatgcacttactatgcgggttaagtgtatttgtggtggtgtatatgcgtgtgtgttcaatgcaatgttataaaggaaaaaaataacctatcagctatggatatgtgcatgctcatccatccatgaatcccactgagcttccactgcccaagggcctgtttgtttcagctacaacataccaattttaaattttagaactaattttagttttttgtttgtcgtttttagtaactttgcttttgcttttgaattgctaaggatagaaatggaaagtcctattaaaaatattattctatatcaatcacatatcttcggaatttagagacagtcacacaaattttcttcagttttaactagaggtttagtcataggattgattcctagataagttgtatctgcttttgagctggtgttgtttaagactattttctcatcattctcctagaaacctatagacttggttcagacaagacttttgcaaggggttgtagctccctgacatgtgagttcttacctcctaaatcaacgagtcaactacggtcaacctgacacgtcagtaaaaaccgcttcccaaaccatcgaaggagtctatttgcactgtttttaagataagaaagacgttatacccggttttgtggttgaggtaggcgattcaaacagtagtaagagatgaaatagacttgtattccaaaaagaaaaggactcatcatccaaaaaggccttccaacaaggccaaggcccaaatctcctagtcctacaagcccagtagaatgttcggcccagcagcagagatccccttcccgatttcttctccatttccgttctttttttccgcggaagtcgaacagtttcagtccacagcacccgcgcaatcccccgcccatggcgacctccgccgcgcgcgccgccaagcgcgccaggatcgccgccccgccgccgccgacgccgacgccgacgcatctgcggcgcggggacggcggctacgtgccggggaacatcgtcgagatcgagctctccaacttcatgacctaccaccgcctcgcctgccgcccaggcccccgcctcaacctcgtcctcggccccaacggctccggcaagagctccctcgtctgcgccatcgccctcgccctcgccgctgaccccggcgtacgtacacacctactgcctccttacatttcccgcggcaactgtttttttcccccctcttatgcgaatacgacggctaagtgtatgaacaaatgcgtgcgtgaacggaatgcaggttctcgggagggtggccagcgtcggggcgttcgtcaagaggggggaggagtccggccatgtcaagatttcactcgcgggaacacacccgaacacattatccgcatcacgaggaagatcgataccaagaacaagtccgagtggcagctcgatggtataacctcctcctcactgcctcaccttccgtactcccgttagcactgcttgttgtgtggtccttcattctgctgagctatatatatgttaatttaaagaattatgaaaatgaaggaggcgcgtcactaatatttatttcctgcaggcgccactgtgccaagaaaggaagttgttgatctcatcaagaaattcaatattcaagttaataacttaacacaggtgtaccttcagtttatgttaccgttccctttgtttacattcgttatcattttgctttgcatcttaatcaagaggagccacttatccatttgtcgtgaacctattcctgatttctgttttcctgctcaactgtgttcagcttgaccgatccttcagcgtgcccttaattcagtgacttaataggcttggcactaaaaacttatgctcgtgtgtatatatatgtatcttctgtgttctaaacgccacgtcagtgataagtagtactgtcgtccttacgctctgaacattctatatttcttttttgaaaaaaaaaaactggttgttttcattggcatttgcgtgtatatgcttgtgatgtgtgtatatgtgacggtgtacgtgcgaatgtctcttcaaagtaataaaaaataaatggaatttgtgatggatgtgcacactctatgcttttgtgtggagctcaaactgatcttgcttcaggggtttactaacgggtacttaagggttccaagcaggtcctgtttgaaagttaagatacgctgctgacataaaatggatatctatttgattaatatgataatttagctttcaaaaataaacataaaagaactagtgttctaagcaatatagtagaatataaagcttttgaaaggatagactggcatttaggatttagaagcacaccatttatgctttgttttgaaccaaaaaaaaaagcaggaaagggcggcgttgggacccaccaactctgatgctaaaaaggaaatcaatgcttaatgtgccctgcgctgcttcttggggagaaggatgcatgcatggggtagattggaacatctgacgtgaagtcagagagacgtggtgactgaaacgtgggtcccaatgctcgcgagcctacctgtcagtgatcatgtcagggagcagttcacgttagaggatccggtttctatgagatactggaaggagaccaggtggtatagatggctagataggttgcccggtctggtctggcctatacatgactaggcccacgaccgagagcagtcagaccggcacgatacgtcctaaacgagcgggtcaggacatgtcagccaggggccctaatgggcgatcagtcgtgccccccgcgtgggacacggtcagtttttgaccctctcatctctcctctctactatatgtatacatacatatatattttatatatatacgtataaactttgtatacgtatgtatataaagtatatattatgtatacatattgcatatatttatatttttttaatatgcatatattttttatatacaaaatttgtttatgtatatatacgaaatatatcaactttatatatgtttgtatatatgtgtaatataaaaattacacatatataaactttatatacacgtatataaactttatatacgtgtttaatacgtgcatattaaaaaagggaaaaactgacaaaaatacagaaagaaaaaaaaagtgcaaaaaaagaaaccagactaaaaagatacgaaaagaaaaaaacaaaaaaaaagtgcgtaaaaaaacgaaaagaaaaaagagaaaccgcgggcgccgccgccgcacccc

SEQ ID NO: 15978 - DNA, 7268 bp, Oryza sativa
ccgcgacgcggggctcggcgcgctccgcccgctccccgacgacgtcctcctcgacgtgctcggcctgctcgcggcgcgcgacctcgctaggctctccgcggcgtcgagggcgctctacgtcgtcgcctcccacgacccgctctggcgggcgctcgtcctcgacgagctcggcggggacttcgccttctcgggctcgtggcgcgccacctacatcgccgccgcgtcgggcggccgcgcccacctccccccgcggggcctagagatcagggggttctactccgactacctcttccagagctggctctgcgccaacatggagatgcggccggagtggctccaccgggacaccatcgatcgccgccgcggcatgtccgtcgagcaattcgtctccgaattcgaggagcccaataggccggtgcttctggaaggctgcctcgagagctggccagcattgcagaagtggaccagggagcacttgctgaaggtctcggccgggaaggagttcgccgtcgggccggtgagcatgacgctggataggtacctccagtatgccgacaatgtgcaggaggagaggccattgtacctgttcgatgccaagttcaccgagaaggtgccggagatggggagggactatgaggtgccggcgtacttccgagaggacctattcggggtgcttggggaggaaaggccggaccaccgatgggttatcattgggccggcaggttcagggtcgtcgtttcatgttgatccaaactcgacatcggcgtggaatgctgtgatcaagggagccaagaagtgggtgatgttcccaccggaggtggtgccgccaggagttcatccaagtgcggatggagcagaagtcactagccctgtatctatcatggaatggttcatgaatttttatggggcatgtaagacctgggaaaagaggcctgttgagtgtatatgccgggctggagaggtggtttttgtgcctaatggatggtggcatttggttatcaatctggaggaatctattgcgattactcagaattatgtgagcaggttagagttcacatctcatgcttctgtgttgtttttattgtttcactagacgcaggactttgttgttagaaattaagcgaccatcaagaagtgctcttttatggccttctgtggtaatgaacataaaaaagggcatcaccatgccagtaataacagtgtatagaacaaattagaatctccagtacaaattcaaaataaaatccaatgttctaggcttgatgcttttaagcatatgttcattcacaaacaatctcagtggtgcacttatgcttttacttaattctatggatgttagctcttaagagattcaagtgtatgtatgttccttggtcgtttgtaggatttacaaatgacgatcaactgaagaaaagtttctgccaaataataattaatgtcaattgtctttctggttctaaaactatttaaggtcaacaaaggcttatttctatactttacaaatgatgccctcttcactcatcgagtcaaaattgactctgtgtgtaagcttcttaggagtagcaattaacaaaagtagtagctgggttctcctgatgatgccaggtgctaatggaagtatcgtgtagtgttgacgaaggtccctcctgatgatcctccttttgaaagaaggcatgaatcaggagagtgttctcatttcaatctgggttgctgtatagctttgatgtggaatcctcttgaatcttgtttaattgctgaacttgatgtgtccattagtctgcatgataactgttgcctaatcctgttacatctttataaatgacatgctatctcttcttttcccctttgaaatattcaggaggaatctgttgaatgttcttgactttctcaagaggcccaatgcaagtgaacttgtatcagggactacagacagggtaaacctgcatgacaagttccgcaatgccatcgatatgacttatcctgggatgattaaacagcttgaacttgaagctcagcagaaggctgctgctcgcaagaagaaagtctcgttctgggaatctgcggtagatgccaatactggaggattcaagttctcattctgatttcgtttctagcagctaggtctgtcagtctgatacttgattgctgttcttggtgaaagttcgacgattttgccattccatttaaatgctcaatcacatctgatttcctacctgaattcaggtttatgagcctatgcattgtctgaatctgtcttaactgtatcatcttaaattttggaggaatgtagtcccagacatgtatttcattgttgttgttgttgtaacatgtagcttacacaataataaattgatcattgaccttgtgcaatctcctatcttgtctgacttcccagatgtggcctctaatcttgtattctgatgtggcctctaatcttgtattcttagatgttagctttggtcctttggacgccttaagttgattagtggtacatctttttgctggtgaccgggcgccgctaagtatttgactctctgcggaatcttgcttcaaactgtatcatgattcatgacagggcaatgaattcacattaccaaaaggaatagagttgtatgtttcatatagacctagtttattggattaaacatccaaatcttagctaaaatacctccattctcttttaaatgcaggcaacattagtatctttcgaccaattacaaaagtactacgtattttcttttggccaattacagaagtacatgcctttgccttgtacataggttttacttagtttaatttgcttcgtaacattaggaggaagaacgctcctcaatcttcagaaggctgcaggtgtatctgactttgttctgttaaggcttacacatcatgtacagctgcatgtttgtaactctcaattgtcaacatgacaacatgggcatacaggagatactagtagattacaacaagttacatcatgtgtataaggctctaggtacatatatgcatccatattagtctttacgccttttgctcccaaataacaactgaaatctgtacaattattccaggaagcttcagcttttcagggatcactgcagctgaaaatccaacctcttgtatataccaggcagaagcaagatcccaagaggcaaaaactgctgcttgatccatgtatggctcaccaaaacaaatgtgcaatgaccatgacatgtgtgagaaggtgtttttctgtaatcgtaaaatcaatcgacggtcaaccaaatctttgtccgtatcatcctaagcaagcgttctcaaccatctgaggagcccaagaagacccgcatctagtacaggagatctttgttccagtcctggatgaggatcaaagcagcaaacaaacgtcatttttctgccaatatcagcttatgttgttcatcagcagacaaatctctctacttcttagtccctaagaccctaacataaataaagctcccaatccttcaaactcagttcattttagggggatgttagtggaatctgaacttaccaatatcagctgcaactcgatgagcacacatgatccctgaaaatgccacagcaattacaccttgcccaggaaaacagctgtcgccaacacagtacaagccatctattgactgtaaaataagcagtaaattttcagtccaacaatattgcagcacaagaagatttcaggacatcaagtcaacaatgcatattaacttacagtagtattgaaaggcattgctagcaatccctttggtttaccccgtggcatgggtccatatgtaccatcatttcgcgcaagaaatcttcggtgtgtttttggtgagcctacctgacaacaccaaatgttcaacaagtcgaaagcgtgttagcactagaatcaaaactatcccactacaattttttgcatgatagcagcatttaaaggtcaaacaaaaattagtcaagatctgaaaagaacagtcttagatcctgacgtggaagaactataagaacctacctccttgaggactattgaatcctgaagaccagggaacagctttttttcaagcctctttattatctctgtcgccacaagctcctttttcttctcataatccttcctggacagaccctgtggtggatattaggaataaataactaaataagtacattggtacaaaaggcttagtttctcacaatttgaaataaattagattacagcaagagcacagtccatacttcccaatcctctatccctgcagttgtaaaaatatgaagtatatggtgtccttcgggagccaaggatgggtcaagcactgtagggatacttaaaaatatgcttccataaggcttctccaaattagcccagtcatcctggcaattgtaattagaattaagttattatggactaaaactgttgtgtaccaacttagcattgtgtacccattgcctgtgatatctgatacccacagtggagtcatacctacctcaagtacaaaatggtggcaatcagtatcagcaggcaaaactgaggctttgacacccatatgaatggaaaggaatgatggtgctttaacataattcttttggaagtttttctcctcttctggaagctcttcaactttcaagagtttacctttgagtagaagtaattgttatttttatggacaagtacaagtggttaacaaataataactcaagaacaaaactgagttgtgaattttgagcaaaggttgtgaaactttcagcaaataatattgtaacaaatgaatttcaacgagccgcatatttttcaaataaaaatagataagcaggattaccaaatgtatcccatctggtagcattcgatatcactgttttagcaaagaactccttcccatttgataacctgactccaacctatagtaatgaaatgctcagctaacaagtcgataaaagctccagatatttagtctaagtaagatgaacttacagctttgccattttctaaaattacattggtcacattagccttgtagcgtatttcactgcctttgtcaacaagcccatctgccaaggacatagcaataccaccaacaccaccaactggatagttaattcccccgaagtgcctatcgcacaagacctgttatttcacccttgagataacagaaatttaaatgaatcagaagcaaaattctgagagtcatgcattccacttaccatgcttgcattaatcatgggtgtttgcaaggcattgactgtgctcacaataaagcactacaaacaaagtgaataaactggtgttaacagagaatcacatggtcgacgaaagaaaaattgaacaagtgagtaaactcacaaatatctcacacctcagcatctatgaaggagagtaactgctgatcttttatgaacttgcgagcaatatccccagcattctgtggcagataataagctgcaagagagataaagtcatgagttccattgtatcaagtcaaccaatctgattaagcagtaaatatgatgtactgatcaagttctcctctcaatcatcctttcattggtttttggaattgcatttgattcagctggagcttttccatagggaatacaatgggtcagctacaaaatcttgtagaggaatatatggatgcggttcttatacctagcgtcaaacattccagaggcttttgaaaaaattgcccaaaaagatatagaggctcctcaagggacttcagctccaaagaatttaatgaattgaagatctgctcatatatgagaaaacaactgtacttgatatatgcttgcaaagagtgaattcaaaataccaaaaagaaaaaaaaagtagttgtagataagagtggagaatgaaaatggtatcacagtaccttccaacatgtgccatagaatttcaggattccttccttttcatgaggaaatttattaaccagctccgtgacgaagtcatcatactctctatgcacaagaactgagaggtcaccaggtaggtggaaatgaaccgtagaaggatccggtataacttccatcttatgcccaactgcttctagtgcttgtgtaatcaaattcaagttcccctggatcacagacacaaagtcatacttaagataaaatcaacactcaagagacaaacaaacattatcggccactagtcccacccacacatggcattactctcagcaacagcaatattgcacacccattcacccaggcatgcccactgccaagtgccaacctatattcctaagttggacacctgtagctgcgattttcgccatcatcgcaacattccactccaatcaggtaaagtaccttcatatcagggcattacgaggcataaatgcacttgaaaagcaataactttctcatcgtctagccaacaacatccaaatcaatccctactttcccttccccaattcttgccgtcctcgacaccgcacttcacatagtgctcccagcaatcaatcactcactcaaaaccaaattcgccaacgcaagatccccagaatatactagcagcaacgcaatcatcccaattctcatctacacccaaccgtgctcagtcactgtcctcaccttgtcggagaagccgaacatgacggaggagccgacgtcgaaggtgaacccgtcgcggcggtagtacccggagctccccccggggatgacgtacttctccagcaccagcaccctcgcccccttcgccgccagctgcgtcgccgccaccatccccccgatccccgaccccaccacgatcgcgtcgtactctcccccaccctcctcctcctcctccgccttcaccaccgtcttctccgccgccaccgcagccgccgccgccgcgcccgcgcctctcctggtccctcgtcccagtgggcgggcggtggacggccggcctactactgctccggcggcggagggagcgaggagcggggcgcacgggcgcgcggcggcgaggaggaggagcggcatggcggcgccggtgaagcgcgggagctcgagctgggtggggtttttatatgggaggagaggccgcggtggaatctgcagcgagaggattccgccgcgggaggtggtggaggttagtggagggaagacgagggcgcggcggatgaggcgaagtggggggccccacatggcagcgagaggccggggcgaagtgggccggtgaccgttggtgggcccgccatgggcggcgacgaggttgggctgcgcattgagcagcccatgggccccgctttgcttcgcttatcgtaattgcccacgtggcacacagtaatagcggg

SEQ ID NO: 15979 - DNA, 713 bp, Oryza sativa
aagttcctccagttaaacaaattgccaagtatccagtgtgaatgatttcagtccccaaaaaccatagtacaaagaagaaaatccacgacagcatgaaattcatgcttcacattagtatgattcaagaaaagacagatagtgaattgtacaacatgctcagctggacgaaagaaaaatgtgatcatataaccttttacctttatcaccgcattgatttctttgtgcgtcaaactttttataataagaacctcatcagctgcaacaaaagcaggacagttagactcctgtttaaaagctcatctagtggtgactactataaaaagtgatctcatgcatctaaaatttattagaagagagcaacttaagtgaagtataataaattcctataagaactagttaagctacaaataaaagttatctggtgttattacacaaatgtccttgtatggaataatatattaacatgtgagaccaattattaatgatgtagtatatatttgtagttaactattgtattaattgactattagattgactataaatgatttagagttagtagttggctatactattaaacttgctcttaggccatcattactccatcactttacaagaaacttgctcttaggccatcattactccatcactttacaaggaacgaccagtgcaacgaacttccatccatacatcacagtggcttttaggtggctcaa

SEQ ID NO: 15980 - DNA, 2432 bp, Oryza sativa
  unsure (1)..(2432): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggcacaagccaaccaattctgctgctgctgcttctgttgatggttctgtatcatgtgagagtcctcggagcataactaatttggccaaattgaccgaaagcacagaaaataacaaacctcatgctactgccagaaagcctgctcaaagatcagtcacaaaaattccttcccaagcatctgccactgcaaagaccgagacaaaaccccttgtgacaaagcagaaaacctcaaacacaaaaccaaaagctccaagagccaaggtagagcaattgcaagacaactcggttgaaatccctcctgctgaaccttctggcccagaggggctcactgttgaacatggtgttgaggatgcaacagggccagaccgggccaccactttggttgcttcgaatgaagttccagtccaaggttgattcgattgcacatttggttatttaatcccttcttgcagtcttgtgaatagtgaggtgtgtgcttcatggaaagttgattcgctcaaagtaccgtggatttgtcatttccggagtagacatcccctttttttcagcttgtcattaagcattccattgtatattgcttgaaaatttgttcatgttaaaattttatttcttgtgtatattggagttatatgtcaatgggcaggctaggactgttgcagaacatcaatgcaacttgtgaattattttgtgttataagttgattctccttggtccttgcccagtatatccttcttcacctgttgcaggcttgcagcagttggtttccaaatgtccaatgctgtctgtttaaattgggagttaaaagatacatgaatcattagtctagaatttgccttcagattctgcttgccttgtatggttgtaggggattgctatgttgagtatgttctgaaattctactgaataccaaatctgagactaccatagatccgatagagcgaaatggctagaaaagaatctgagactaccatagatccgatagagcggaatggctagaaaagaagtggagtttatatttagtttccaacttgtaagtttagcttcaagagctaggtaagagctaggtctgaagtaaagttgtaggtctgaagtaaagttgtagagtaatctaaacctaactccatctttcaagtttattttataagaacacttcagctagctccattcctattttgcttgtccaattctcctcacctggtttctctcgaattctcaatctaagtactagctccattcctattttgcttgtccaattctcctcacctggtttctctcgaattctcaatctaagtactagctccattcctattttgtttgtccaattctcctcacctggtttctctcgaattctcaatctaagtagtgtaattatattgtaacttgtatataacttttaataattgttgaattgttaaatttgtttcaagatttatacgagcaagaaatgaaaaaatcatagcgttcgtataggtgagagaagatccaaatgaaaactcaaaggtatgtataggatgaagtaaaatttaggggtatagaagaaattgtgaaacttttcaagggtatgtagagaattttctctataatataagttatgagtacaatgtaattagttgcattacaattgtattattttttttaaaaaataacaacaatatatagcttatcacacacctttgaattggagatgcgctaatctagcgatggcgtaaaccaaataggaggcggggaattatcttgccatggatggtggagtggccacatgtcccgcagcttcgtcaacctcccgcggtagttgctcccgccgaactcccacagagcaaggtccagccgcttccacgacggcgggttcgcgtggtcgccgtcgccgtcgctttcgtcggtgaggtaggcgcagttgccgcgaaacatggggtagtcctccacgcggaggcaggcggcgccggcgtggccgacgaacagcgcgaggtcgccccccacgccgccgggcaggctcacctgctcgtagaagtagaggtcgagaggcctgagcatgacgacgtacatctccgtcgtgctcgcgtcgtcgtcgctccccgacctgcgccacctccgctccacgacgaggaattcgaggccgccggcgacgtgctgcgggtgcttcggc

SEQ ID NO: 15981 - DNA, 2610 bp, Oryza sativa
aaggacagctcccgtccggcatgtgcaggagcaggacgacgcagccggtggcgccggaagggctcgcggacatcgccacccggcggtacatccaccgcctcgcccgccgcgccatgacctgcctgacgtcgggggagccgcccggccgccggccgaagtcgacgtcgtacgcgacgccccggcggccgccgtcgccgggggagaagacgaacctcctgcccctgacgcgcccgagcgccgtggccggcgggagcgcggcgcgggcgccggtgagcgggttgagaaggtaagggttggcgtccctgtcgcttgtgaacagccacccgtgcgccgaaccgacgacgccgctggccgcctcctcgtcgaggaggggcacgcggaagtgggcgccggtggacgacggcgagtagaggcggacggcattgtcggcggcggcggcggcggcgtacagcaggcagggcgggtgcggcggcgaccggaggccgaggcggcggaacgtggcgaacgccgagtgccacgatctgcagacggcgccggagtggactaggtcggggagttgcatcgcctccatggcggtgagcaggaggtcctccggcagcccggaccaatcccggaagtcgtcgccggcggcggtggacgccatcgtaagttcgtgaccggcggcgagtcgcgtcgcatgcataaaactcggcgtcgtgtttacttcaaaactcaactggggctatgcgcgttggattcggatccaaatagaaaggggaaagttcaactagactccctcaaatataggtcgaatttgattcatacccctcaaccgcaaaatcaggtataacaacgcctccaacagtttaaaccgtacaaaacgactcctaaaccggtttttatatatggtggttttctatgacatgacacatcgaccctggtctttggcatctatataggcgccggcgaggctgagcaggcaggaggagagacgagggaggtggtaatgccaagtcacaagcccagcatagcgttgcacgcctatgtcttcatgacgttctacactggcttcgacgtcgtgcaacaccgtcggtcttggtgggtgccaatattgaagaatgtcggaatggtgttgcttgcttcgtctttttcttcttcattatcattccctctcgtctctctccccctatctcctctctctcattacagtgagcccttaccgttcgaatttgggattgtgctagattgcatcaagcagagatgaacaaaacctgttctaagtccaaaggatttttctttgacttcttcctggatcaaaagatgcaatcaacaacggcaattgtcgtagcaatgccatcatggtctcatggatgctagagacaggagacgtcattctgcttccgtcctcactgggagttgacgcctggaacggtgagcggaagattggggggaggatggtgtcaaggcggcactagaaggagaaaggagatgggacagctacaagaagaagagaagggtagctgacggagcgtggggctcctcaccgggagaccgcgcaggcccccctttgccggttcggccgggggccctgggtgaggttctaagctcttggtctgtggaaagttcgcgagagtgaaatcacacaagacacgggcgatgtatacaggttcgggccgctgagaagcataataccctactcctgtgttttggtggatctgtgtatgaagaagctacaaagcgcgagccagcccccgatcgttctgggattgtttttccccccttcaatcccctttctaagtgggcaaggtcctccttttatacctcaaggggataccacatgcaccatctctctcttttttgtggggacttatcctattttattcataaacagacggagacttgtatggttgccgtccgaatgaccttctgacgggaccgcccatacctacctccacttccgccggaagcaggcgcgacgtgggaacatggctgtctgtcgcgcccagaagttcttttccctagcaaaaattcaattaataaatggttggaagaaattatttctttagaggcaagagagaaaccctaaattaataaatgcaaataataatcggaatcggcatgtggaatttttcttggattctacatgtcaaaatatgctaacaggatttttagtggaattttcagagcattggaaataattttaaccaattaaaataagcaaagtgcaatattaaatccctgggaaaatcctttttccttttatcttttcttttccctcctttttccttttcttgggccgccggcccatttcctcccgcgccggcccgctcctccctcccactcccgaagttcacccggcctccctctccctctcgggcgctgacaggtggggcccacctgtcagccctttccctaacctccggccgcccacgcccgcgccaaccgccgtcgaaaccaccgcccacgccgccgcgtatcccgctgctcccgcgcccactccgcccgtaccgcacgcccacgtcgccgcccactttccccgcacctcccgccagctcgcgcgcccgcaaacggcgggggatttgaaatttcccccactctctctctcctcctccacctcctccactactccgg

SEQ ID NO: 15982 - DNA, 11193 bp, Oryza sativa
ggtcggcgggtttgaagccgagccggaccgacggggcgcctcgccgctttccccccccccttgtgacgctgcccggtgggtcccgcttgccagccgccccctctccctctctcctgtgcctctgacccgcgggtcccgcgtgtcggcgccacccctccttgtgctgacgtcagccctgggatgaattattgcgcaataaattgattaagggtttttcttttatagtaataaacacatataatcttctaaaaatcataactaattcaccctaaccaacgacaaatgggagaagatcaccttccgttccccagcgtcgcagaagtccgtagcgagtctgaatcaggctgctattgagggtcagacagaaacagtggagaaaagtcccaggaagttggaggatattcctatagtacaagaatatcctgaggtatttcctaaagacctcactacaatgccaccgaagagagaaatcgagttccgaattgatctggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgtgttgattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcaccactcggtatgggttgtttgagtgcacggttatgtcctttggactcaccaatgcaccgactttcttcatgaacttgatgaacaaagtgtttatggagtttcttgacaagtttgtcgtggtattcattgacgacatacttatttattcaaaatcagaagaggaacatgagcatcatcttcgtctggtactcgagaaattgaaggagcaccagttatatgccaagtttagcaagtgtgacttctggttatcggaggtcaaatttctgggtcacgtcatttctgctcaaggcgtggcagtggatccatcaaatgtggaatcagttacaaagtggaccccaccaaagacagtttcttagatccggagttttcttggacttgcgggctattaccgtcggttcatcgaaaatttctccaagattgccaggcccatgacacagttgctaaagaaagatgaaaaattcaagtggtcagctgagtgcaaccaaagttttgaagaactcaagaagaggttagtctctgcaccagttctaattttgccagatcagacaaaagacttccaagtctactgtgatgcatctcgccaagggttgggatgtgtgttgatgcaagaaggcagagtggtcgcatacgcttcgcgacagttgcgtccacacgagaccaattatcccactcatgaccttgagttagcagcagtggttcatgctctgaaaatctggcggcactatcttattggcaaccgctgtgaagtatacactgatcacaagagtctgaagtacatcttcactcagcctgacttgaatctccgacagcgaagatggctagagttaattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcacggcctacgctcgtggatcaagtcagagcagctcaagtaaatgatcctgaaatagctgagctgaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgaggagagaaatagctgaattcgtcgcactctgcgatgtttgccaacgggtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacgtatacgggcaaaaggttggcggagctctacctctcgagaatcatgtgtctacatggggtacccaaaaagattgtatctgatcgagggagtcagttcacttcaaaattttggcagaaactgcaagaagaattggggactcgtttgaatttcagcacggcttatcatccgcaaacagatggtcagaccgagcgagtaaatcaaatcttggaagatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgaacgtcaactgttcggaacagaagtgttaaccgaagcagaggagaaagtcaggaccgtcagggaaagactgcgaatcgcccagtctcggcaaaagagttatgctgataaccgccgaagagagcttacttttgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagctagagcttccacctaatatggttggtatccacgatgtgtttcatgtgtctcaactgaagaagtgtttgagggtacctgaggaacaagctagctcagagcacattgacatccaagaagatttgacctacgtggagatgccaattcgtatcctggaaaccagcgagagaaggaccagaaacaaagtaatcagattttgcaaagttcagtggagccaccactaagaggaagaggccacctgggaaagagaaaatgaattaaaggccgcccatccgcacctcttcgccagctcttccgaatctcggggtcgagattccgtttaaggggggtaggtttgtcgcgcccagaagttcttttccctagcaaaaattcaattaataaatggttggaagaaattatttctttagaggcaagagagaaaccctaaattaataaatgcaaataataatcggaatcggcatgtggaatttttcttggattctacatgtcaaaatatgctaacaggatttttagtggaattttcagagcattggaaataattttaaccaattaaaataagcaaagtgcaatattaaatccctgggaaaatcctttttccttttatcttttcttttccctcctttttccttttcttgggccgccggcccatttcctcccgcgccggcccgctcctccctcccactcccgaagttcacccggcctccctctccctctcgggcgctgacaggtggggcccacctgtcagccctttccctaacctccggccgcccacgcccgcgccaaccgccgtcgaaaccaccgcccacgccgccgcgtatcccgctgctcccgcgcccactccgcccgtaccgcacgcccacgtcgccgcccactttccccgcacctcccgccagctcgcgcgcccgcaaacggcgggggatttgaaatttcccccactctctctctcctcctccacctcctccactactccggggaaattgcgccgttcccggccacgactcgccgccccccctcctatttaagcacgcccgcaccttcctctctctttttcctttctcggccgagccctcccgagctctccatcgctcccgcgcctctcatcccgccttccgccgctcgccgccacgctccggccgcactccgccaccgctagagccgtcgccgcaccgcgccgacgacgccgccgggttcgccagcttgtgcgccaccccgtccgccgtttccccggtcaatcccgccgccggagcttgcttctcctcgcgcgtcggtgagtaccccatggccgccgccttcgaccggcgaatccgctcgctgttaaccacccctctccctctaatacctcccatcttgttccctaggaggtctcggagctcgtccgcctatcgtcgccgttccccggtcgctcgccgtcgccgttcgccgtcgtcttccccccccacgccggccaactcgcggtgaggcgcccctccccctcttttccccttcctctccctcctagcgccgtgccgggccgagccgccgcttcggctgtgtgccgccgcctttgcgccgccgtcatccgccgtcgcttcccgcgcctccggttgccgtcgccggcgaccgtgcgtgcgcggcaccgccctcgccataaccggtcggccggtttgaagccgagccggaccgaccgggcgcctcgccgctttccccccccccttgtgacgctgcccggtgggtcccgcttgccagccgccccctctccctctctcctgtgcctctgacccgcgggtcccgcgtgtcggcgccacccctccttgtgctgacgtcagccctgggatgaattattgcgcaataaattgattaagggtttttcttttatagtaataaacacatataatcttctaaaaatcataactaattcatccgagctccgattaaatccattcaagtctcagtaaattcataaaaatgtgtagaatccattaaaaatggttttgtttcctgttacagtagtcttatagcatgttttgcttgtgtgctttgtttgtcgcgtagatttcggccgtttcgtcgattcgtggtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaagcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagagggttatgcgaagggtcctgacacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgttttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagccttcaggcttagctcgcttttatctttttccgttgcatttgtaatcttttatatttttgtaagacgtggatctgtatgtcaacaattgtcgtttgtgtaccctggctggtcctggacaggggtttaatacacattcagcttagaaattctggttcgtgaatttctgggcgtgacactgtctgctgacgacatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaggagctaacatgccggttccggctagggacgagtgcttggaggctctcgtcctgacgggatggggcgaggcgtgcgtcagaccgcctgtcgccacctaacccacgatctgaccggtctgtgaccggtcacagaccggataaacgagcgcgctgcactgcgttacatgcggcgtgacgcgctcgtccaaaccgcaataaatgtggttaagtgagccccgctatgctcacctaccccatatacgcggcgcaaaacccacaaggggtcggggcacctcggccctcggggccgaggcggtagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcactgacagtagcccccggcgttatgccaaggcgatcgctctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctcaactgccacagccgcatatccacttcatgcaccgcaaacgggcgaatgggattagtggaagcgtgggcgcgagaaacgagggagcgagatagtggacgcgagaagcgaggagccgggcgcagcgttggcaagggtataaagacgccgaggaagagatttgcttccttcctctcgccattattccccttgtcttcgccgcttgcgccctaactccttgtttcctgtgccctaccttcgccacacgcgctcgctcttaaacttctcttcctccggcgtcatggcacggggctccgctttgcttgatggtagcgtgctgccgccttcccgcatcgtgagtgagaggcaggccgggctgccgcgccgcttcatgccggaatctgccaccggccgggagatagttacgctgggcgagggacgcccggcgccatgctacccggggcggtccgtcttcttcctcccttttgcaatggcagggctggttccgccattttcttctttcttcatggatgttctggagttttacgatctccagatggcgcacctcaccctcaacgcggtaatgacattggccatcttcgcgcacctgtgcgagatgttcatcggggtgcgcccaccccttcggctgttccggtggttcttcactgtacagccggtgtcgccgccgtcggtggttggtggttgctacttccagccgcggggccggtgttgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgtctggcgggcctgcgatccctggggctcataggggccatggtgtacggcgactaccttcgtcgccggattgcgccgctccagcggcgcgtccggggcgcctgggagtacaccggatccgaagactacatgaggacccaccagggagtcagatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggcatcggaggagcgggctcctcgaggccacgatggcgcgggcgggagccgcaggggggaacgatctaccccgggagggggtcgtgcttctgggccccgcgacgggggcccggggagcggccgccctgccgacgcccgggggaagaggaagcaggaaggaacccctcccccatctcctccccgagggggcggggcggcgcgtaccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgtccccctcgcaggttcgtcccacgcccatcgtggccgtattcattccctcaacgcgagttttcactcatccatcttgtttgtcttctggtctttcttctgtttcagcgagatctcgtcgcgtccctcctgccattccaagtccggccagtctgaggccgaggacccggcgaccacagaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcggcgacgacttccgaggcagctcgcgacgaggccgcgggcgcatcgcttgggcccattccctcgggcgacgctcaggacaagccaggtctgggggacatccctgagtccggcacgttcatcggcgggccgagccgcgcggcatcctcaccgaggcggctcttccccacgccttccgttgctccactgagcgcagaaccccttctgcaggccttggccgtcgcaaacaccacggtgttggacgggttaagtgcccaggtggagaccctgcaagcagagcgggcggagcttgacgccgcatgggcgcgtgtcgaagaggggcgacgctcggtggaggccatggtggaggtgggccgcaaggcacaccgccggcacgtctcaaagctcgaagcccgtcggaaggtgctgggggagatcgccaaggaggtggagaaggagcggggggctgccctcatcgccaccaccgtgatgaacgaggcgcaggacaccctccgccttcaatacgggagctgggaggcggagctagggaaaaagctcgactccgcccggggggtccttgacgctgccgctgcccaagaacggcggacgccggagaccgaggcggcgtctcgccggcgcgaagaggccctggaggctcgtgccatggcgctggaagagcgcgccggcgtcgtggagagggacctggcggaccgcgagcccgccgttgccatccgggaggtaacgctggcggcgcacgaggccgcctgcgccgaggaggagtgcgcactccgcctccgcgaggacgcgctcaccgatcgggagcgagctcttgaggaggccgaggccacggcgcaacggctggcggagagcgcgtccctccgtgaggctgtgctagaggaacaagcgcgccgcaatttggaaggtgcccgcgccgagaaggccgcactgaaccagcgggccgctgaactcgaggcgcaggcaaaggagctggacgcgagggcgcgcagcggcggtgcgggcacgggcgaaagcgacttagccgcccgcctcgcagctgccgaacacaccattgccgatctgcagggcgcgctagactcgtccgccggggaggtcgaggccctccgtttggcaggcgacgtagggcccggcatgcttcgggacgccgtctcccgtctagatcacgccggccggcaggcaggcctctggggcgggcggactgtgaagtacgccgccaaccaggggggcctcgctcagcgcctttcggagatggtcgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgagaatggcgcgcgcgcgcaggtccgggacgccgccgaccatatcgtccacagcttcgagggttcggcccctcggctcgcgttcgccctcaactccgacgaggagggcgatgacggcggtgtgggcgacagtggcgacgaggctggcgacccgggtggatcggagtgagcccccaggcccccgccaatctttaaatagtttcttcttttcttcttccgaggccttcgggcctccttcttgtatagactaatttaatctgcaatcaaataaagaggaaattttttgtgtcaattctatttgttgtgtgtatgaggcgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgacggcaggattgaacacaagtgacctatttcaagtcaaaatccttcaaaaggaaacaacagcacagatacagcctttaggaaatcgaaaatgcttttattgaaatacagatataagagaaatagggggatcc

SEQ ID NO: 15983 - DNA, 51121 bp, Oryza sativa
  unsure (1)..(51121): unsure at all n locations
ccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgctttcgctcttccaagtagtcgaggtcatctctgcgaagctgatcttgatcagcctcgcagtacatggtggcccgaggagacctcagggtgagctcggatgggagaaccgcttccgcgccgtagacgaggaagaaaggcgtttccccggttgctcggcttggcgtggttcggttcgcctagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtaatcgccaaaaagttcactagtgaattgggtgccgttatccgtaataatacggttaggcactccaaaccgggctatgatgcccttaatgaatttaagtgcggagtggttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcgccttcatggatatcggcaagaagctcgacgccttgttcccgaggaatgctcttcaggaggattccgttagccgcgcgccgatagagggtcccttctaccagcacgtagcgtttggagatgcgctggacgcattcactcccttcgcggtcctcgggtagagtcttatctgtgaggtatgcttggatctcagcgatccaagcaatcaatctaagggagctaggagcgctcccctcgggtcccgaggcctggactccgacgggcatcgggggcctgtcaggcgcgtccgtctcccctaaggggtcgggtcgcgccgacggctgggcaagcctttcttcaaaggcgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagaattggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggcggtgtgaggcagctgcgagggacccgagctggcctcggggactgagacgggctcgggagctggggtccactctgccacaaaatcggcgagggcctggctcttgatagcgtggcgtggttcaaagtgcaaatcaaactcagaaagttcgactgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctaggcctgagggtatcgggtcttggcgtcccggagggcctcactaacaaagtagacgggccgctgcacctttcggtggggccgatcctcttcgctaggggccacatcccttgggcgctctttgtccaagcggcctcgcggggcgcacttgtcttctgtgccgacgacctcggggtcggaggacaacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcaggcagaggaccagctccggtcgtcaggggccttgggccaccgttcggctcgggggcctctcctccctgctctctcccgagccaagccagcacagggtgggggtgcgcggaatgaggattgtcctcatcgcgctccacaaccaacaccgcactaaccacttgtggggtcgccgctaagtagagtagcaagggttcatttggctccgggacgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactttcaaaagtttccgctagattcgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacattccggggcctggcgtcgcactttctgccggactggccttgcgcccggccgcacggcgagacgatgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcgtcgcatgtgactatccgctgcctcggggcggcgggggcggaggtgccaagcatctcgtcgccaccctcgggcttggacgcggcggcgaggtggtccgcgcgctgctccatacaagcaagcgcgactttgaggttgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacctgctccgtgcggaagttggcggatccaccgaaggtgaccgggaggtcgatatgacctagcggccaagtgtgacccggcgtcacaccgataatcggctgggacggccggagcaccatccccggggccttgatggcgtaaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgtgcccggcgcgtcgcctcatgagtaggggccgcggccagaaactctcgcttcatggccttgaggctccggcgagaaacgtgagcacacgctccctcatcgacagtggcaatggtggccccaggctcttggaaacctaggtcatcatcgccgtcatcgatgtcctcggcggggtccttctgcttggcctcacttcgccggttgccggaaggaaccgccggggacttgccctctaggcgctcctgcctcctctcctcctcccacttcctcgtacgctcagccaaacttttgactgcgcggcagtccgcgaggtcgtgaagggaagtgttgtggacgatgcaccacttgccggttgggcgctccctgctgggagcgccggcctccttctttttgtcgcccgcaggcctcccctttcgggtggcccgcgaagcgccctcgacggcgaggacatgaccctcgtcgtcggtatgggctgacctcttcttcctcctcctgtcacgccgccctgtctgagcagcagatccggggacggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcgtcatcccttcgctgtactgcgtgcaggtccgcttcttcacctgggcgcggatatgtgccttgaaagttcatggtgaactgttggcacaaatcctcccaggagtggaccgacgcgggtggcaagttcattagccaaccccgcgcctgtcccttcacggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgagacactccggacgaggaggcgccctccgttgcgtgggcagcacgtcggccattacgccggcgctcgatatcgatgcaggcatccggccccccacgcagatcttcctgggtcggaggcgctgacaaaggagtggcggccgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcggcgcccttctccatcacccgtggatgtcgaagtcgcggatccttcgaccctctcgagcacctcctccctcctaggactttggcgtggagggggcggtggagtacgagctcgacggcgtgggtttggctccccatcgtcaccgctaacgctcggagagaggttgtgcgcctttgcttgttcggccattgggctgaacaggaaaagcttggcgcacacgaaagagtgcgagagctcagaagatcactcgcagagccccctacctggcgcgccagatgacggagcgtggggctcctcaccgggagaccgcgcaggcccccctttgccggttcggccgggggccctgggtgaggttctaagctcttgttctgtggaaagttcgcgagagtgaaatcacacaagacacgggcgatgtatacaggttcgggccgctgagaagcgtaataccctactcctgtgttttggtggatctgtgtatgaagaagctacaaagcgcgagccagcccccgatcgttctgggattgtttttccccccttcaatcccctttctaagtgggcaaggtcctccttttatacctcaaggggataccacatgcaccatctctctcttttttgtggggacttatcctattttattcataaacagacggagacttgtatggttgccgtccgaatgaccttctgacgggaccgcccatacctacctccacttccaccggaagcaggcgcgacgtgggaacatggctgtctgctgacgacatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaggagctaacacgccggttccggctagggacgagtgcttggaggctctcgtcctgacgggatggggcgaggcgtgcgtcaaaccgcctgtcgccacctaacccacgatctgaccggtctgtgacccgtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccatatcaccctcgggcccgacccccccgagggggttaggccacgtgggtgatcgtgtctgcctcaagtctctaagtcatgatactcccggtcccatgtcaccgacagtagctattacatatatggtcttattgtattttttttacagggatgccatattaaaaaaaccattatcactagtgatatgctcgtactaatgctactacgctatttagtaatgtaaaacaaacaaccaaatgtgacgatatatgttttaagaagcttctcacaaaaacttaaaaattgttactcactccatattcaaacaagaccgtatcaatcaaaaaaggcacatcataaagaaaaagaaaattaaataatctatgctacgagcctttaccattgatatcgcccctaagaactaaattacctacatactatctattgcattgcgctgatggatcatgcatgtcttccatattggaaaaacaaacattatgttctacagcagcatggattggttgttgggattccaaattgttatgctcctgaagctccctgttggtaacggtaggcacaaactggcacaaagtaaatcatgatcaattaaacaaaactcactaaaaacagtggtactagttcaaggaaattaaatggcatcataatttaaaagtatgctcaaggaaaattaaacaaccatgttatcaactattacaattcggactcatatttcattgtgaacttaataaccataccatgcttataagtcatagtagggtaataccatagccaaacttaacgcgtgacactgacctgaaggaggctaatacaggaaagaaaggcatccaaacaccataaaaattaaaaaagaattaacacaactactaaatggatatatatggtcaaaagttcatacacgagtacttatcccttataagagaaaccacaacttaaaataagagtttatccgactaacaaaagagaacaaaggattaaacttctagcctccttctataattccaaccatacttagaaaaaggaactctggaactctcttctcccttatacttcttcacctcgattgccttatcttcttaagtaccaaagactaaagtcatacccggtatgttactttagatataacctgcattaaaaaccacatcatttctatttaactgtatcgtcgaaaataacactgtaatattaacaaagattcggtttatgggcttaggatgaacacctttagccaactaccaaaaggttataaacattagtgggggtttcaatgccaaaagtaaagaaaattgctacatgtaaacattagttttattgaaaagttgattgcacatattttttaaggtttctatagtatttcttttactctttacaacaaaaggttaacattgttcttaaatttgctacttgcacgagcattacgtttgaagtctaaaccacattttttcttatcttacatcgaaaactcatttcagcatccaattaactccaaatacaaatacagccgttcaaattaacatttcaattcaatgattttgcccatatatagtatatccaaactctgttaccctcatccaaattttcttttatccctatacgatatgactttctttcatagacacatcaatcacacacgttgagagaacctaactcccttcgtcacataaaaagatgaatctaggataagatgtaatacatttttagtactatgaaactaaacagatgatatatgtttagattcatggtagtaagatttgtcacattcgatatatgtatagatttatcgtactataatatgtcaaatttaattctagatttatttttttaatagaatgaagggagtatgttggatttttacttgagagagagagaggacattgctacgagcaagagcaccaagccacaaaccccatcaaagcgaaaccaatgaatgtttgtgtcacgcacgcatccaccgatccatccatccagccctcccggccccgcccatctcgccaaaatcgcgcgccgcttcccctccttttcccccaaacccgggaccccctctcctcttccccctcgcgcgacgactctttccgaagcacacccccgccgcggcgccncttctcctcctcttcctcctcccctccatcccccccaacatccggtggtgactccgacgaggaagcgccccaagaagcgaggtgaggtcggagggagggagggaggaagcagggatcggctcgctcgctcgctcgcttccgcccccaaccttaaaccctagggcccccgcacttcacctgctcatcggctcgaatcttgccgcgctcgggtgtggggaccgggaagatccgggtcttctcttttcgggggattggagatggtgagtttcttgggttgggtgttcttcaatctcgcccgcattgtttcctcgttcgacgcggggagggtttcttggctgattctttctcctcccttttttgtgttctttgtggggggcacaagtcttcggacatcaggaaatggttcatgaaggcgcaggacaagaatggtggcgcagcgaagccggctgggacgacggcgttggcgaagaagcccgtgctcagcattccggagaagccgtcggcggcgccatctatggtacaatgccaatcctttttgcttgtgccttttgagttcttcctgctgtacatgttcccttttgttgaggaatttctatgtaatctgttgtatggtgaattggcttagcagatcaattattgctaacaatagacaattttatgtaacctgggagtttcttgtggccaatagtctcaccatatgatgatgatatcatgtgcctgttcatactcctcctgctgattaaatctgggcattattttgtgcaaatgtttgatgatatccctggcatttacaaactacaaagaatgtacaatggtggatttagtttttggcgtagaatatgtaggcgataaaagtgatgaattatcttcagtatgtcatgttccattgcgcatcatgaatctaatacaataacgtgtaacagggtactctgctctgatcctaggtttattgtactgctgcattagcctctgttagtttggctacaaacttactgcagtctgcaaattatacactgcttccattaccttaattgtttgatacatcatggtttcctgctgttgagtaatttaattactggatcatccaggcggcttgtgatcaagattgttcagctagaaggaagactagcaagtactttgcatccaaaacagaaaaggaggaagacaccagtgcaggaaaaggtaccgggagaggtttgcctaaaagaaaacttcagaaagtcagtgatgagcttgaggatgacatgaagcctttgccagcaaaggaagtccataaagaagaagaagatgatgatgacgacgactttgtggcaccttcaaaaaggaaaactccggtgaagccaccaccatcaaagaagttgaagggtgcatctactgctgaagctcatggaaagactggtcttgatgatgataacgaggacaagatggatgaagacgctaagaccccttccaaggcatctggaagtggaaggggaaggggaagggggagagggaggggaggaagaggagcaggagcagcccatggaaagacaattggtcttgatgacgacggtgaggaggataagatggatgaagatgccaagaccccttccaaagcagctggaaggggaaggggaggagcctctgggggaagagggagaggagggggtgggagaggcttcatgaactttggtgaaaggaaggatcctcctcacaaaggggagaaggtagcttattccttcttgttataatttgccagaaaactcaatcctaaacttgttattcgtgttctgtaggaagtcccggagggtgcccctgactgtttaactggtttgacatttgtcataagtggcactcttgacaggtgctttctattgtcttcatttcttcatattttaatttgttttatgttcatgtaaatggtggatggtcggtgcaccattaatatcctcaaatttcctgattgaaacaatgccgcgaataagctatcataagtttatatacacttgcagtcttgaacgtgaggaggcaactgatctaatcaagcgttatggaggccgtgtgaccggctctattagcaaaaagacggtatgaaataatagtatgatacttgcattggtaatgttttttagcctatagtttgcttacatcgcttatttgacagaattacctattggctgatgaagacgttggtggagtgaaatcaaataaagcgaaagaactggggtatcatttgctcttttcactcaagaaaactatattttcttaattgtcatttctaacacatgactgtacttgtttgcagcgtcccattcctaactgaagatggtttatttgatatgattcggaaatcaaagcctgcaaaggctactgtggcaaaacatcaaagcgacaaaaattcagaaaagcagcaaaaatcaccaatgaagagttctccagttaaagttgaaagaagaggtaactgaaagcgtaaaaatgcttcttagttgtatagcgcatgcacaatcctgcttagcataacctaactattagatacttgtattctcaaagttgcatgaatttgagacatgattctagtgttcattgtgtcttttacccattgtagatgctagctttatccagcgattgttgtatccattgctgacatcatctgatgactaagttttatttgatttatttgtttgatattaacatttcgcaggttgtttatgcttacatatatcttgattttccaattttcagatggtaatcaaattaccacaggcaaaaatatttcaccaaagagtaataaaggaagtgcctccattgacaaccaaaaggtcaacattgttgaccgtggttctttgcaatggactgaaaagtatcggcccaaagttccaaatgacatagttgggaaccaatcaatggttagtgcttctgctttcggttaagctggtcacatacatctatgcacaattacttagtatgaacttatacatgcaggttaaacagcttcatgattggttgagaagttgggaggaccaattccttcattctggccagaagggtaagggaaagaagcaggctgatagtggagctaaaaaggctgtgttgttgagtggacctccaggtattggtaagaccacaactgctaaagttgtcagtcagatgcttggattgcaggctattgaggtaattctgctgttttgcatactttgcaaccttccaggcaactctttgtttcttactcaactattgaggcataaatgcaatgactaatgttcataacaggttaatgcaagtgatagccgtggtaaggcagactctaagattgagaaaggtgttgggggcagtacatcaaattctatcaaagagcttattagtaatgcaactctgaattatagtaacaaccggtcagtattacatgaagtttcatcaacctttttggacctttggttttatcttgtatataaatttggcaagaattttgacagattaaaacgacccaaggctgtactagtcatggatgaagttgatggtatgtctgctggagatcgtggtggtgttgctgatcttattgctagcattaagatgtccaagattcctataatttgcatttgcaatgaccgttatagccagaaattgaagagccttgtaaattactgcttgctactcaacttcagaaaaccaaccaagcaacaggttatctgttgacctctggacatattctcaatttcttgcaatttttaggcagttacgatacagttgcatgcagcaacttatttaggggtaatataagtcctatttgtttgtcaatctgaagttaaacaatggctatccccaagatcactcaaatactcgtacgtacggcagatttcacagccaacatagcttttcacgcacaaatgtattcctgattgcatagaaaccttctttataggcaggaattcttgctgttctaagtagcacatttatttcttattttaatttttccatctccttacatcgtatatattgtagactgttacatggaagggtaagcattattactcttggtgctcgtgacccaaaagttgtaatatagggttggttttaacttctgtgtttaacagatgggtaagaggttgatggaaattgccaagaaggaaggtcttcaagctcaagaggtgtgtttagagttctctgcttctaaacttccatcaaaagttttgggaaaaagaaaagaaaacacaacaaaaataaaagcaaaaccatttatagttctttttctcttcttttcttgtcattaccttttctccatgttactaatatatggtttcctcatctgctagaatgcaatggaagaacttgcagaaagagtacacggggatattcgcatggctcttaaccatttgcaatatatgagcctctcccagtccgtggtcaaatatgatgatataagacagcgacttaatagtagcacaaaagatgaagatatttcccccttcacggctgttgacaagtatgtgcattgattatactttttataaattctattcaattgtcctctatttcctcatcagtatttctagatatttttatgttcttattgactgacatgcaataatttcttagtgtataaatgtgaattatgtgaattttcgtattccaatcttgtattgattatattaatattttctgtcaaattgtacatccaagtttcattgtatttctactttgttatccattgataaggcgcacggcaaatattcaattgctagtttcattcattgataaacaaaagagaaagcttgtagatatacttggtaacttctccatatatttgtttattttaatggattttttttgacatggctttcagaggggctaaaaaagtaatttcttactctatactcatattttatttacctggaagttgtagctattttggctcttttgaactgttaatgttcatgctgtctaccgatttttatctgaatgatgtgttttgctcaagtgcatacgctctgctattgaaccagctgtttctggatctataatttgtggatttttggatgactttataatttgcaatgcaagagttgggttgtatttttcccgctactttaaattcataatagatattgattcaactttcaggctgtttggttttaatggtgggagactacggatggatgagagaattgatttgagcatgagcgatcctgatttagtccctctgattatccaggtaggggacactgatggtgcaaatctgtttttgtttatttttctgtagaattcttgtgggtcctgtgtcctgagatattttctgctatgaattgtttcccgatactttttgtattaaaagtagctcatcaggcttgcaacttggtttttccttcatttttgaatgagcatcacagccttctcatatcattgacatgtatcttgctagtgggttctgtagttgcaacagctgaagcgccattatttgttgcaatgctatttatgttctcttagtaccaagcaatcgttatatagtttgtgcgccaggtaacttgatcattacttttttgttggttgatacataggcgtgcacactccctactgaatgcgatatcccaacttttcctctaatggcaccccattctttttgaaagctgggatgctagccatctataatctatgcataaatactagctattatggtaagtaaattccagatgtgttgcattggtgtttggcccaattttttgctgtgtaaaaatatgcgctttattatgatctttttcaattgttatggtcatttgtagcatgttacttcatgtaactgttttcaatcacttctgtttggtccttaactgtgtgattaagcttgcatattaacacatgcctggtataggaaaactatatcaattatcggcctatcactgttgggaaggatgacagtggagttaaaagaatgaattttcttgctcgtgctgctgaatctatagcggacgctgatattgttaatgtacaaataagaagatatcgacagtggcaattgtcccaagctgcttgtttgtcttcatctatagttccgtaagtatatggtggttattatctgctgtaatcgatttaattcaaatgtctcactgatccactaatctatttcacatcttacagtgctgctttgatgcatgggaatagagagatccttgaagcagtaaagctcaaaccttatcatcaattactttttttgtttagtttatttttggtaattctggctcattgaattggataataaatctgtagggtgagcgaaacttcaataggtttggtggatggttgggaaagtactcgaccacaaataaaaacataaggctactggaagatgcccatagtcatattcttgcctcccagcaagcaaatttggacaggtggatatacttttacatattctacaaatttatcctttctggcattccatggattctgtttttactcttcacacgtatgatgcatcgtgtatcaggttgtaaagcaaggtgattgattgttttcttctcttgttttattctgtcacaagcggcatcttaaatatctgactaactatataaatttgccaaacaaacccaagcttttttttttagtttggtaaggatttgaatattgttacatctttgggttgatatgatcttaatcttccattgtgcttataaatctgaatggatttaggccagttcatggtttcaaatagattttcatgttattatctgaataaaaatgttttgtgtattagtcctaaatcgtaattccaaaccctaaggataatcagctcatcagtgaatcggctaattagtttagcacttggaagttagaacttaatcaaataacatggaattccagcatgatataccttgatacctccatctatgctcaagaagacaggcactaaatttccattgaatttctttcaatggctggcaacatattaattgatggacatgtcatgcttgtttcctgatgttactatgtttgaaaatcatggttttcttaacagtgagcaaattaaacaagccttacttttcttaacttgcctgaatcagtcaataagccaaggaaaatcaccattggtttttgaactttgttttagcaacattgaataaaaacccatgccttttcaagatgttgtggtccacatgagtacaatctgatctttaagatgattttcgatggtttatcatgagataatccaatcttatattgttgagaactgcagggagtcattgaggctggattacctcactcttctcttgagacaattgactgatccactgaagacaatgcccaaggtatatgtagatgtgatctattaattaactccttgttttgttctatggcattatacttgaatgtttcatgatgaggataatgacctggacactggcattttagaaatttatcttgatacctctaaatgcattagtgtactagccatcttctggagtattctgaagtaaggagtctctttaatttcatttgctgaaaaaaaaaatctgcaggagagcgtccataccttgacttgtgtacacggctcatcaattctgagttttaacatactgttatcttgcctttatgtaatagtattaccagtcttcttacaataattccctgttaagaatctttacctgagctatctgctggttatcttatatttgtaaaatcacaggatgaagctgtgcaaaaagtggtggagtttatggatacctactctttaagccaggaagactttgacacaattgttgaattatcaaaatttaaggttggtagttattctaatagaagccctatgtttgtgccatctattttatgttcattattaatctctttgaatggttttatacttattacaatatgtaatgtgctactgctaggtttgcccccttgtgtttgaaaatacttactctagatggtaggttctaggttgcatgcaaagttgcaaactgtatatttcactacactaatgatggcatttcaattgatttcgggaatgcaaaagctcatttgctataagttcttattgtgcaatgcaattttttgagaaccaaattgaaatttataaacatgtgatcgtgtagatatgaaatcagagaacaaacattttccaaagtactgaaagggagtgtttgcctgtgaatctttagtgccacaatggttgcatctcttgactgtttgtctatactcaactccctgcttgatatattttttctagaagcattaatgcatgaatcttttagctgagtaaacttgctgacttggttgtcatgattagtaatgccttgtcattatacttccaatggtgtttctgaatacatattttgttctgtagggtcatccaaatcctatggatggtattcaaccagctgttaaaagtgccttaacaaaagcatacaaacaaggaagtagttctcgtgttgttcgagcagcagatctagtaaatatcccaggcatgaaaaagccattaaagaaacgagtggcagcaatccttgagccagtgggagagagtttgcctgaagaaaatggagtagcgtcatctgaaggcgatgaagaggattcctctgatgctgaaaataatggtaagtttttctttttcagcaaatgaaatgactatcacataggaggctatagctgtgttttgcaaaaattgaaataatggagtactttctccgttttacaatgtaagtcattccagcattttccacattcatatcgatgttaatgaatctagacatatgtatctatctagattcattaacatcaacatgaatatgggaaatgctagaatgacttacattgtgaaacggagggaatacatcggatgaggacatgcgtgaaacgaagggaaacagaagttgataagtgagcatttgtaaatctggactagttttgtttcatactgggaaaactgtggtacagtaacatgtcatactgccatatcatcttcatatacatttgtgcttttattctcaatctttagttatgcaacttaggcctatgtttgtcagctgttgtgctagtagtgtttggcataacaatgccatgtcatgtcaattatattagcttcagcccaattttcattaggacatttaaatcgataatttgtattcagtgtatgttttgtttgaccaacctgctttgtttatttctttcagatgaactggtgcctggtgacacaaaaccaaaactggacctgcagagtgataagaagaaaggttctcgtactttgactagttggattctccaccagtcttaccttctgctatttacggtcgggcctgactctttggtaattttggttttatatccagggatccaagtgcagctcgacctgaagagcaatggcaatggcttgaactcgaagaagatgccggctggtagatcaaaagcttctggctctgctgggaaggctgctggaggctcaggtgggaagaggaagaggtaaacgtccgccggccgccgtcatttagtcggtggtgaatctacatgaacatcctctgatattctggggcagaatgcggttcaaattttcttgcttgtacataagtcccaatcatctttgtaggcagtagtaggcaattggtatctgctccagatattttgtttcctcccacttgtatgagcttcatttcgctctactggcatttggccagttttcagctttgcaagacaacgtccattattgttgacttccgttcaatgaaattgtgtcatgtttgttgtccttttgatatcttgttgcattcatctcccaaatctgccgtagggtgacacattaaaactgcatgattctataaacctgtaattccatcttttcgttaatactagtaaactaggtgttacttttcttttttttagaaaataatgggcttacggaaaaatattatactcttgtcttaaaatataaggacttagtactagatgtaacattaacttagcactatgaatttggataacctgcctatctaatttgtactagaaatgtcgtattcaatcatacgttcttatattttgggatgaagggagtagtattttcaacacaacataaatatattattaaaatatattcaatgctaggtttaataaaattaatttaatattttagatgttgctaaatttttatataaactagaaaaatgttgcgttgcaacaggtgaatgctattttaatattattattgttatatggtttagttatggtaaatttattgtgggaatttgcttggatttttcttttggaaaattagcgagtccgacattcattcaagttagcatgcggagtttgttaaaagagatttcttatatgaattcttttgtgtttacaaaagcaaatgagcttaaaatccaactcaaacacaaatatgtattttcaaaaacgaatatccttaaaaaccgactcaaacacggatgacgtatcaaaatattggtaaaaatatctttaatttttataataagtagagatttgatcaaactcggaaaaaaaatcaaatgacttatatgatataaaacagataaaatatttattagtcccacgaaccgaacgaattcgatgccaggcaacaaagagttcctggccggcctacataaactctgtattaggtactttccgagctgataagtgatttttttataaaaagatatataggaaaattactttaaaaaacagtattcattctactttttaagtttatttaagctaatagttaatttattactccatccatttcaatgtttttaaaaatataacaacatttccaacagaaaacatattatcaagatatatttaatgaaactaattttgtgttatagatttaaattattctataaaatagtcaaatataaagaggtttaatatgaaacggaagaaacatgctctaatgagccattatgttttccgtgcgtagaggtatgtacccgaaccttactgccgaagggaagaatcatttcctgctagtagaaaatcaggctagagatagaaaagagagagacgtttcctgctaactaaaaattcaatcatcgtcgtgcttactgcgtattgctgaggaaggtttggatatgattatgcttggtgcaaaatgctttgcttattaaaaaattcaatcaattaattagtagtaggaggtaatatgagataaaatatgccagataatcacgatgcatataatctgaatttcagttaattcatcaagcacgtgggaattgatttgttttaatataaaccagattagttaacagtatggtaaataaacctcatgtttctacttcgtttggagcatttcgtatttgacataacacaaaacatatttttaagcgccacaaagagtcagctaccaggtatcgaactgttttttttccgattttacaagaatatatcaaatttgatgatattgcaaaaatataaccgtgtcaccgaatcacctagcgacacctggtgttgccgaagggccaaattggaccaaattcccatttgttatcgcctacttcctccgtcccataaaaaaccaatctaggtgggaatgtgacaccagctaggataacgaatccaaattcattgttctaggtggtttcacatgcttacctatgataacgaattgtctaggtggtttcgcatccccacctaagttggtttttttggaaggaaggcaataggtgaaaacagccatgcattttgtgactttaccttcgctttgtccatgcttggtgcagtggctcatagcccaaggcaatgtccacatttaaataagctacatcacacagtgtcgcgtgatgaaatggtgtcatcatgtaaattgacaacacaaatatatttttatttgaatttcatatattcccacaagataatatatatatatatatatatatatatatatatatatatatatatatatatatatatatatatatatatatttaaaaatttaattcccgagtattttccttagatcaatcatattttcaaatattgagatatacatttattttaatatctacaaatgcaattatatttctaattaagaaactaataaattgtatttttctattactgcacatttattgttccttaaaatgattgatgagatgcacatatttacatgttatcatctttattttagtttatttccttggcaagtcatcaatctgaaacataagacatcaatattcttgacataaacaacaggcagttttaagatatgacaaggatgaggatgtgcatcattatagtaatatttagtcttgtccatatgtaggcatcatcaatctgaaacatcaatcagtaggcatcatcaatctgaaacataagacatcaatattcttaacataaacaacatgcagtttcaagatatgacaaggacgaggacgtgcattataatagtaatatttagtcttgtccttatgttgctatcatcaggtaaccacatgagttctatatattagtattttattctctttcgaatccttgattaattttatactaaccgattgtgttcatagaaatggtgatgtcggcaatgataatggatgatggaaggacaattgacaccccattctattacaagacacacttcaaaatgcattgtgatgatattatcaatacatgcgtccgactatgcatgaacctagattcttcatttcctcgtaccacggttacatctgttatgctataatggcatataatgtgaatgcaagtttttcctaagagctactagaaactaaactagcaggcatgtgttttatgaatctaagtatttttttattttggtgcctatgtacatatggtggtgtgagtgtgacatgcatgtattactattgtccaaatatctattttactcttcacatctaaactagtcggtataactctccaaaattatcctccttcaatatcgagcatggtttcatggttagattgatagtataaatatagttagcttccaacaaactaaaagtgcaaaaaaaaaatttgatatctaaaattctatggagtgcatttctcgtgagagtttgggaaggtgcctacaaaaattgatctcctactaatatctaaatatctaccatcagtacattttacaacatctggtgcctactattcacgtaaggattgatcacatagaaacatgcatatggcaatcaatcaaaggagaaggattgatcacatagaaacatgcacatggcaatcaaccaaaggagaaggaagtatcatataagcatgcactagctcccactcttcattacgatccacaacacctacaatctattcttatccattctcaatacggtcatcacactcttcactacaatccacaacacctacgatctattctaatccattctcaatacggtcacccatacttcgatgattggcatgtttcttggcaacaattttatgctcactatatttgcaaagtaccaaatgaattatgaaaattattgggaaaataaatatcatcattgccaaaaaaactattttagaattagttgttggttacttgataaaaaaacaactaattagccaacaagctgactcaaatttacgcatgtatttttatgcacactatggaccaattggtctatgaaatggtctctcggcactaataagcaatatatgttgcaatgaacatttttatataaggagcatgcatcgtactgaaagagagcatgcagatttaaatgtaagtgtggaagtcaacaataggcactgaccggttgcttgaagaataatctgtatgccaatagagaatagtgctctgggtataaaggatttagccatatttgagaaatctttttggttaaagttggaagtcaattgaagtgaatagaaggggatgccgtgccatggacgatgacagggtggaacctatggaatttcatgacatctttaattgaacagtgacacatatggtgggagacggtaaacatatagatttctggagagggaactggctaccgactaggagtagaaacatgcacatcgcaatcaaccaaagagaaggaaacatcatataaccatgcacgagaaggaagcatcatataagcatgcactagctcccacactccactacaatccacaatccctataatctattctcttccattctcaatacgttcacccatatgtcgatgttttgcatgttccttggcaacaattttatggtcaccacatttgcaaagtaattatgaaaaatattggaaaaagaaatatcatcattgccaaaaactattttagaattgtttgttggttacttagtaaaaaagccaactaattagataataagttgactcaaatttgcgcatgtatttttatgcacactatggaccaattggtccataaaatagtctgtcagcactaataaaagtgcaatatatgttgcaatgagcatttctatataaggtacatacatcgcaccgaaagagagcatgcagatttatattcgagtggtagaagtcaacaatggtcactgactggttgcttgaagaataatttgtatgccaagcgagaacagttgtttgggtattaaggatttagccatgtttgagaaagctattaggttaaagttagaattcaatcggactgaacagaaggggatgtcggatgatggcagggtggaaacctatcatggaagttcaggacatatttaactgaatagtgggcaacggtaaagatatagatttctggagagggaactagctacggactaggactgttaggagaacattgctggtagcatgcctgcgctcttaagcttttcggcaagtctagactgacaacgctcttcagcttttcggcaagtctagactaacaatgggacatgtactgatagactagagatgggtgagagagaaaatttgaagcattgctttctaacagggccttgtctaaatatttgtcctttagaatgaccttcaaaatgttcaaatccaataggggatgaaggattcagtcggaagctgacaagtaatgatgaaattctggtatagagaactgatctagaagactaagtccccaaaaaacgctaacctgaataaggatgggatattaactaggataacgaatctgtacatgagcatgtccagattcgttgtcataggttatgttccatcattgcctatgttgattttttttggacgaatagagtagttttgatgttgacatcttcaattgaaattaaattctactacaagtgctttattcaaatttagtgaagcttttaactcaaattaaataaaactttcaacttaaatataataaagttctaactcaattttttttgactttatattcatttactttgggataagtttactttatgtcgctcaatattgagttgtctattttttgtccttatgaaacaaaataaagaaggcactccgtctacacaataccccatcgcgcccatttgagggtggttttgtgccacgttggcatgctgaatggtatgagttgtcattaataatcaatactcttagcaggtactccctccgttttaggttttaagtgttttgactttggttaaagtcaaacttcttcaagtttaactaagtttataggcaaatatagtaacatttacattaccaaattagttttattacattaataattaaatatatttttataataaatttatcttatataaaaaatatcactatttttttctataaacttagttaaacttgaagcagtttaactttgaccaaagtcataacatcttatgacctgaaacggagggagtacaataatagattataagtcagctataagcacatgtggaggagataagagatgagagagaagagaagtgagctatagatttgtagccagctgtaacacgaactctaaaacgttatgtgtatatgacatgtgagaccaattattaatgatgtagtatatatttgtagttaactattgtattaattgactattagattgactataaatgatttagagttagtagttggctatactattaaacttgctcttaggccatcattactccatcactttacaagaaacttgctcttaggccatcattactccatcactttacaaggaacgaccagtgcaacgaacttccatccatacatcacagtggcttttaggtggctcaaggccacttttaatgggaaatgccattttttacaattccaaaggtaccatatactaaacaataagacatttatttgacggttgaaacaatccatacaatgtattattttatttttgttattgtataggcatgcaatgcaatacatgcaacagctaagctatattaattagaaatagtacacgctggtttcatctcgataaaacatatttcatatcttatttattatatactataaatccattaaactttctacaaacgctctcaagacgcaacatgtcactcttacaaacactcctagaccgccacataacactatctaatctaactatcgattttcatttaaattgatggacccggtattttagaccattagattagatctattatttaagaaaataatcccttcctctgccgtgggccataaaaagaaaaaaacttatgtacgtatgacttcgtataagtgtgggccggaaaaaaaaaagaacgtaggtacgctctccctatccctatctcttcctcttcctattcttttacatctccatctctttctcttcctaattctttatgttatcaaattaaaaagagaaaactaaaattttagaattaagctgaccataattttaaatgtacatatctaatttatattctatctaaaatgttgctttatttataattaaattgacaattttagatccaatgttttgctatatataagcaatatgtcattgtggtatagaccgtgcattttacaagtttgcatgccatctaaataaattaaatacttaaaatattaacaacatatattgtgttattatacatcattcttcaaatatgtatatatagtttcaccgttggttccaggacaggtgcacttagattttgtgttttgcttacaccagggtgcagggttcaccatgtggaaaataaagaactaactcaaatatgaatagcacaaaccataacataaaaaaaaatccaatgtctttaggtagaccaaacaatacaattggttcatgattttcctaagaaaatatgctcaaataataaaagcaagacgaatgaattagggaagcattataaaaattacatcccataagtaatgatgcatctttagttatatttagccatttgtgctctgctgggctgcttcaatcgatcccaaatgggtgttactcacactctgtaaaacaatgggactctaagagaccattgaatttagcgtagccttacgtcccacgcccaatctatccattaataaacaacgagaaaatatatctatcttggctgcttacataaaaggtgattgatttttttttaaaagttgacacctaaggtgtaacaatgtcattatttatcatctcacgacatttgaacttaaaaataatacttgcataaaataaaacaataaatagcaaaaccaataaggagtaaagcaaaccaattagagaaattcttatgaagtcttggaaaaatttggttctttcttttcaccaaaactggaacacctgttaccataaccattgcatcattgcgacacatttttgttcttagattctaatacccttcactcagtcacatatggtggtgttattagtttctccacatcatacacatataacccactaagggtaatacaccttctttccatcataaaaaaatctcccatgaaatgaaaccgaacacccatcttgtccagtggatggatccatctactgatctgtatgcacaaaaggtagtcaacttgcacataaaaaaaaactcataatcgcaaaaccactcgaataataatcactcccgaggctaatatatatattaaaggtgactttagagtaatcaattactacagcatatccaagggaatctaactccaaccagaccataatcccagctaaaatagtattcctccgtttcaaaatatttgacaccattgactttttagtatgtgtttgaccattcatcttatttaaaaaatttaagtaattatttattcttttcatatcatttgattcattgttaaatatactttcatgtacacatgtagttttacatatttcacaacttttttaataagacgaacggtcaaacatgtgctaaaaaatcaacggtgtcaaatattttgaaacagatggagtactacaatactacgcactagcgagtataattttttttagacagtgggctttcattaatccggcccctatgtacacgaagaatatatacagaaaaaaaaaaagcacttaaactcacatctcgacaaggaggagaacactcaaccaaaaagaaaagaaaaataaatgatgtcggcacacctctgcttctcaatatacgtactcttctgaacggttagatttggtgagtagaagtcgtctagtggccgccgcctctagtgtgccgtcgctgtcaacctctgttggtgctatctttatttgctttagatgagctgacggcacgcatacccaaatagcccactttcatccgttgtatgggtaacttattagattagctataaacgatgtgttaatttttagagctagaggttggctataaaattaaacttgctttaaggttacggatcggaagtggggaggtacagaatgcattgaccagtcaaacggagaaggggacacggccgggcggttaatttactgcctatcttgtgatgagtcagtgataacgcctcgtctgcgtgccagcgtggcacaaaaccgtcctcaatgaagacagaaaacggtggtgcgttgtagtaaggttgagaagaacatttaaatgattgattaaaacaagtaaagtagcaaaacaacgcgaagatacttttaaaatgtttgacaccgttgaatttttaacacatgtttgaccattcgtcttattaaaaaaaattataaaatatgtaaaattatatgtatacatgaaagtatatttaacaatgaatcaaatgatatgaaaagaataaataattacttaaatttttttaataagacgaatggtcaaacacgtactaaaaagtcaacggtgtcaaatattttaaaacggagggagtactatcatgtccgtgttggctttgggtcatgggttccgcgcacatcatgcactcgccgaagaaaaacatcatcaaaactccatatatatggaaaagaaaggttcacccttcgaatagattttgcaacatatcttccagatcctcgggggtatacgtggctgatgttcctaactggccgccctgtccctgagtctccaggtaggctcggtaagcagagattaccttcccgcacaccgaattgcgcagcacggttcgcagctgagggctattgatcttccagagcttctccgtgtggtaggttatctgcaacaaggagttgaactccaccagcgccgagacactacggaaaagcgacgacctcctgcggctctgccctgcgtaccccaggcacgagacgacatttccccaggacagatcgaggtactccttgatgcgccgatcgacccgctgcttccgctttgcgtaccagtaggcgcccatgaacgactgcaacgaaggctccgcctgctgcagtatgaagtggtcgttgttgagcaggaagatgtgcatccgcccgccggcggctgcgtacatcttggacctgtcctcgatcatggcgtccaccgagttgatcagcctggcgacggtgctcgtcagcgacgatttctcctccgcgagctggtatagctccccgatggagaacagctcgtcgtcgccgtcgtcgtcctcgccctcctggaccagcacgtcgcgattctgcagcaccgggttcagcacgtcgcgattctcaagcagcaggttgatgtagttgagcacgtactgattgaccgggtggatgtcgttcccctgcgccgtcgtccgccacgaatcctcctctcggatcagactctccagatcatggagtatgcccctcatcatgccgctcagcgtcttgagcacggccgtgatcctctcggaaaccaaccatttggtcgctccggggagcagcgccaggaggctcggggagacgcccgagaccaccgcgtacatgtcgatcacgcggaggatcttctccggcgatctgctcagcgcggcgatagcgtccgggaagcacatcatcttcaccaggcttgccttggcgaagagcgcgaattggaattcaggccctgcagctccgtgctggtcgtacctgtaggacctcgatgacgccgcttgggaatacgctgttatagcttgcttgaccgtagcaatggcaatgctcctgctcctgctcgtgtttggagccggatctgagctttcttggtcgagattcgacgagccagagccaggacttacatcatgtaatgtaacaccggcgtggtcgtcgtcgatccacgccggtgcagatatctgtggcctgtacttctcgatcggaagcaccggaatgacaccgccggagtcgccatcgccgctgctgagggtggccttcgtcagacggagggcttccgccatgacggtgagcgcggcgagccaccccttgatcatctcctccacgccgctccatggcttctcctgcaggttcatctcgtcgactctgagaacccagtcaacgccaaggtcggagaaccaggtctgcagtatctcgtcgccgccgccgccgccgccgctgccgctccccagccgcggccgggagaactccgttattagcctctcggtgtacctgtcgctgaccatatgactcgcgatctcgctgaggccccggaacgcctccccgcgcagcaacctgtagctctcgggcccggagcttggagtaccgtgcgcctccgagccgggagcggaggaggtaaaggatgccgaagacgagctcgtgaccgagccactcgacgggaagacgagggtggtgctgctggtggacgcggcggcaacggacgcggtgacgacccgctggatcgagttgcggtagctgcagctgccgccatccgattccgagcgatgaggacttggccgccaaacacggtcgaacttcagcgctcgcaactcctctgcgagacggctttgcattatggtttgggtttcccttcctatagagatagattagagtagattgaacgagcgaggaatcaagcaatcagctcagctcagctcctccttttcttctctgcacttcggaggaaggagacggaaaatccaaagtcaacggtgtcaacgcgctcttctatattttcctctcattaggcatgtgaggtagtacaccttaccagaggagcaagaagaagacgcggcagccgccgaaaaacaagagagaaaaaaatgtaatgtcacgctgtttcgtccgtccgcgtgatccgatcaaccaaaaacgactggcacacatgccgtttcgtgacgtccgtcgtccactccttagacgagggcatggaagggggacttgacctggacgcgagggacgcctcgaggtaggtatgcaagcgcagctggggcgagtgggctttcttttccgttttttcttttaaattttatattaaataaactaaaacacgggtttttatatgggtagtgcgacagcgcacttacatccgtaccttgagacttggagaccttggttgagatctggtagctagttgcagtggcggtgttccatctgcttggtcacagttggaagcgtcgatctagggataggaggtcatctacgatgccattggcatggcttgagggcatcataggggagtggattctaaactttgtatctcatccaaatagttatggaaaaaataaaaaaaatcaacaagatagattagtatatgaacatcatatagatgccatcactataggtactggaaatactaaaaccagcacctataggccttttccctcctctatgggctaaaaacacaaaaaaggccggcatttttatataactataggcatcggttctaaagaaaaaccgacacctatactatagatgctggttttttgaaaaaaaacctttaatttattaaaggtgccgcactgctggtttctttagaaaaccgacacatcttaaaacgagccgagccaggtggagacaagccggccgggtgggcgtctttttatctctctcgatattgtgaatctctctcccttatcttttcttcttctcctcctcccaccggctctctcccactgtctctctcccttatatcttattctcctcctcccttatctcttcttctcatcctcccaccggctctgcggtggtaggccacggtaggcgtcgggctcgcggaggagacgcgacggcgatagcagttggaggagccctcccttttgccagatctggcaggaggggaggcggcggcggcagttggaggagccctccctttcgccagatctggcgggaggggaggcggcagcggcaggtggaggagccctcccctctgctagatccggcgggaggggaggctgcgacaggggcggcggggctcgcggatgcaggtggtgggctcgccgaggggaggcggcgtgatgactcgaagatgacgactacggcggcggctacgcgaccatgcgacgacaacgatggcgggacaacgacagagaggtggattctttttttttattgccaagatctgggatgaattttgagtatcaaaatttgtgttgtggatgaatagattgatatgtggatgaatccatctatggatttttttttattgccaagatccaggatgaatttaagtgtcaaaatttgtgttgtggatgaatggattgatatgtggatgagtccatctgtggattggatatgtgatggatagatgatgatatgctcgttcttgctgtggtgtggatggatgtgggaggagggactgctcggctcaatgcatcggctcgtcatcgagccagatttttttttattcagggaacctcaaaggtgtttgttcttaaaccggcacctatttcttttcatattagtgctgcctccgtggtgccgattgggaaaaccggcacctatttgtgttttctgtagtagtggatagatcacttcacaaacatataacttaaaatttaacttctataagtcgcaatgaaaaaaacaaatttaactgtgaatatatattagctagctatagtttaatttgtttttctattgcaactagtagaagttaaatttggctttgcatgtttgtggagtgatttatcatatattaatctatcttgttgattttttttaaaaaaataactatttaaataacatgtaagcaatcaggaaatatcccctcaagagtttagaacccctatggtaggtgagggtggggatgctggaagagtaattgttctatatggcaagaagcagcgcaggtgcaacggattacggagatcctctcgaaattggaggggaagcatggagaatgtgatagacctcagcctgcagcacggagtgtgagcggggggtcgtagtgttgtcgctcgtgagatcatcgtgttagaaagggcttcctttgcaacggtggccgataagatcctgtgttggctagggcttaagggattccctagccacccagcctagtgccgtcccccgctgaggtcgacttgctatgctccatgcttgtgtattttgtccctttgtctctcttcttctttacataatggatagaaatttggcatttatatccatatacgtacgtagccgaaagttacatacttagattctaggtctcataactagaaaacaacaaaataaaaaaaatgtttcctcactttggctctcctattcttttacataatggataaaaattttgcatttgtatccatagctagctaaggatacatagccgaaggttaagattctaggtttcgtaactaagaaacaacaaaataaaaaatgtttcctcccttagtctctcttttttcacatattggatagaaattaggcacttatatcatccatgagtggatatacacagctgatggttacagaaatacttagattctgggttttataatagagtaacaaccaaataaaaaaaaagaaaaacggaaaaacggaaagactaagcttctagagtgagggtcctctgcattactacaaactgacatgtgggggatctgaattgaagcttctatcgtctggtgcttgacgagtcctaccgccccaataaccatacttggtcgatcttagtacgtagtttggactcatcgaattccatctgtctgaccagctctttcgtcacactgcctctcgatccagatccggaagctcccaacccctagtgcatttgcttgtttgccagttcacaaggcttgttcctgggtgagtattatcaggttcagttcctttccatagaaaggctcttctgttcctgtcaattttcttgatgacccattgagggattagcaaggttgtcatctggtaggatggaattgaagataggagtgacttgaccagagtttcatgtgcagcagaaaccaacctttccaacctggtattctagagaaaatcttttcaaggagaggtacaaagtcattttttcttagtttccttgtgtgaaaagggagacccaggtaggttgttattttcgagtaaatttcacaaaaccttgtattttacggcttctgtaacacaaaaccctgggttttgtaatttgtttcatgaaaccccaggttttagagtaaaatgttttataaaaccccaggtataaatttacatcgtttatttgactaatatatttatctataataattgtaaaaagaatgtatgagatactttttagtacatatataacgttagttgctttttaacaagtgttgttaatcatgttttgatcatttatgtgtatacttaacctattattatattataatcagccggtattatgttaagctttttcggcgcaaaattgagaaaaaaataaagtagacgagaagagtatgtccttttagccaactaatgtgaattgatgaaaaaaacaatcttatgtaataataaaatataagtagtctatatgaatatgaggtttcttgaaacattttgactcaaaacatgtgatttcgtgaaacaaatcacaataactagggttttatgtaatggatgccctaatacctaggattttgtaaaatttactcaatctgctagagaaattctaaatggtttgctccacattgatgtttgtacatgctaaaaatggcaaatggttaaatgccccccaaaagtaggcagatcaccactcctgttgtctaacgccattggttctagtcgggcccactcaccatccttctcatccccttcttctttgttcctttcactttccttttcaaaatcatctatagtgggtgtcactgtatagtcttgagttacccacagccggtaacctaattgaagttatgtgatcagagatcctatgaagtacggctttgggaaaacaaactgtttaggttaccatcgttgaggccattcccaaccaaaaacactagacatggttttcacaaactccacatcattaagaaactagtactagacactcctcttccaatgtaaacactactattccatacttaaatttaatgcttcttatctcacatgatgtcttggatattgtgtagaaaccatgtctcatgcaagacatggtttccttctctttcctcatttattcacttgccacataatttttcatcctatgtggcatcttatttaatgttatggacaccatcctagtcattggattgggaatggcctgatgcaaagcaagatatcgttggtgttgtgggcctcgttttggaaggttcgctcgctggtttcgcagcatgtgtagatgaagatgcattgtcaccaccagcagttgcttctttcatcaaggggtaaagatactagcccattccacttccaggctattgaaaagatacaattcagatagttgatcttcagcagagaggccatgaaagtaaagttcaagtgaaggttcaagatcttggtcttcccattccaaaccatcccaccattcattctcaccgcgtatacatttcagtttgctcggaacggtaagaaagggaagtttattcaacaaagggcatgcagagatctgaaggcattccagagaaggaaatgagaagaacgggctgcagatcctaaccaatgcaccagcttcgatcagtgtcatccttttaagactggggaatgtattattaactgatggattttccttttcctgatttgtcttaacgacaccatcttgtgcagtagcaataatctggtgcaatgttgaacatgaaaatagcagcaaatcctctagaagcgggagatgaataatccatgaaatatgattcaatcttgaacaccgtactatatccaaacgtctgagttttgcaaaaatatctccagtgtgcagcttctggcatatgatcctatcaacgaaataaccatggaggtatgctttctcaacatgctgaacattccacattgaatgaatgctgtcaagcacaatagtcttttgtcttgtgtaaataccaagttcaaacaggtttgtttgtctttcaggattgatacaagaattttcagaagatacatgagtctcatacccatcttcatggttataaatgacaatagagagggaccgtattggtaaggttgtcttactaatcccttgaaacgaggtttctgaacgaacagtaattccaagggactgcaatttatccatacgcacaagctcattaattggcgcctcataggatgagcactgcagtaaattaaatgagcaaacatccagcacctccaaattctggagttttggtagtataccatttggaataactagatttggattattccgaagatgcaagtgcctcagtctggtaagacagcctaactccactggtaccgtttttattctgttatttgacaaattcagatatcttaggttgacctgcatgcaaatctctacaggtatattggacaatttattaaaagagagatctaggtactgcagtgaaagcaacgaggggaagttcccgaaagaaccgtcttccaaataattgtgctggagtatcaagacttcaagggttttttgattgctaggaatacgaggcagttctgtaattttaagccccactaatagaacttgctctgccaatccccaattctctttggtttggattctccatttgttcttgtcctcgccttgactgtgtacaacccataaggcaaaatcacggattgtagattgcatttgcactgcctctccatcttctgctggctctaaaaggcaaaattcttgcaaggtggtaatatgagagaaaccttcgttgtaagacgcttcaatgtcatccccttgtattaatcctgaccctatccagaagtctactaatttccgttgattaaatatatggccctctggccataaagaacacaacttaaagcaatctttcagaattcctgtcaagctgtcatacgcaagttttaatctgaaaaatgttgcctcttcactacctgaccattgagtgtcacgaaggcatgattcagtcagataatgaagggcattttgccaatatattgcatccttcttattgtgcatggcctttccaattgttaccagctccaaaggtgaaccaagcaattccgcggaaatatttcttggcaggtacacatgcttatggcccaagtaatcaagatcagcattctgcttgaaaatttcccatgattctgtatgatcaagacagtgaacctcaattctgttctccacttccacattcatttgatcacagacatggctagagcatgccgtgaaaaccactcttcggttgtagcagcttccaaccaagtcaagtgatggaatcccaacttcttctagatccagtctctgccatacacagtcaagcaataaaaggaaatttctctccttcaagaagtcgaaaattcttgctctatgttgcatgccgtcacagttagccaacatgagtttcttggcaatttcactttgaacctgaaagtggccaagagttacatgctagaaatgcatcttatgatggatatggaatgaaagggccaaattgtttatatctgtccatgcaatggttgtcaacaacatatccagtgcaaagtatcatacatttgctaaaaaaaattatatatttgtagatgtgctatttctcttcattttgtaaatacctcaactgaatatcctacctctcaaaaaaaaaactgaatatcctagtgttatactactcgcaataaatcagtatgcatgtatagatagtaccttggctacggaggaatctctcggagaggcgattcgcagcacgagatcgaaggtgtcatctcgggagaagtactcctcaacgagcttgagtaggtaagtcttccccaagccggcgcggccccagatcgcgacgatgccgttgggttggatcgtcctcaccctctcgatcgcggcccggagggtacgatccctgctcgcgaaccccgtggagatctccatcggttggggcagcttgctcctgcgcacgatccttcccccttcttcgcacagcctcttcacctgcggcatcatcagcgacgcgaccttgctgacgcggtagcagccgagcagatcccagaagatgagcctggggatccggccgtgcgcgctccgcagctcgccgaaccggaggaggtagatctccgcctcctctgtccaggctgccgccgtcgccagcctcctgccccgccgcgccgccacgcgggccctcgtgcgcacgcagtccctgacgtgcgccaggtgctcgcacgcgccacggaggacgtggaatcgagcgccggcgaaataatcccggttcctcaccattgctatcagtggagctagctcgagctccgtgctccatatgatcgtcgcggcgtcagatggagtcgccatggagaggcctccttcgtggtttctccaaagtcaaaccacggaaccgccagctctccacttttaatttccggtgtatgcccaactggggattcctatttagcgcgcgctagcgcttgatgggtaactcgcgcaggcgcgcacgtaccatcggcgccgtttttcttttctttatagagaaaggtattttttatccggcctcttcatccaaccggatatatgtagtctttgtaaattaagaatttagtctatcatacagggaacttagccctcaaataacacaatttgaaatttgctcctacgtagatttgaacttaggatcttggggtgctactcaggttacatgcccttttacattcacaccgtcctagccgctaattacggcaattagtctaattaacttaattatggtaattagcattttaaaaatatataaattaatagttttaaaagtatagttgaaagttggagcttcttctcctcaatgatcccctccgcttgccgcacggcgccatgccaagggcgccgccggccaacgacacgtcgaacactgttgcccttctccctcgagcagtacgcgtacggccagaggtacgacgagcttctcgctcccggccaccgccgcccgccgctccagatcttacccgttgctcacggccgaaagggagaggaagaaagacacagatgacatgtgggccccataatttttagtgaatgacgaatggattccacgtacatgtttttaattctaatgccacgtcaatgtcatgaatcagctcaacattgccacgtagacaccacgttagtgaaatagtcctctaaaactgtcaagggagtcaaatttgatcgattttaatagttgagggagggggccgatatatagttaaggaagtcaaagtgggcttattccttagggccaaccgtgtaacttagggccacatcccactagcccactagacatgaaccttacccaacaaaaatattaggggcaatttcattcttgctcctgctcctgttttgatatatacaatattgattttgctcctattttttaggatttcatttttgcccttgtttttttaaacaaatccaaagtttatccctattttgggtggacatgttgacggtgttaaatctttggcaaaaaagacatccatgcccttacatgctattgcacatttgacactattttttttatcatttgtgtatttgcttccatttgtacaagtagcaattttgataaacttccacaagcgtggcaattttgacatactatggataaattttgatttaaaatttgacataattttgctagaaattttgacacattttgacaaaaaaaaaagaaagataaaatggcacaaattagacacattctttacacaacatatagcaagcataagaaactcaagaaaatccaaaccaaagtcaagcaaatccaatctcgcaaacatggtatcgcggccgttgccgctgctgccgtcacttcctccccatgctgcgtcgcgccgtcttccaccttggggacagccgatctggactcgggggctgtttggttgtttgccacactttactacgccacactttagttatgccacaatttcttacgtatgtgtttggttcgctacggcaattgtgtcatgccacactttcatagccttgggacccacatatcacactctcaaatttgaagctaagcttgccacacttgtggccaactatttttaagccacactttgtgccaccatgcctcaactagcctaaacttagttacggcaaggttaggcatcaaccaaacatccccttggtcccctcaatctgcagggtcgctgttaccatcgtcgtctcctgctcacatcccaacaccaacacaaatcctccccacagctcctcccctaccgccgccaagccccttccctgccaccaccttcaagcccccattctgctgccgccttcaaaccccttgcccgtcgccgcctagccccctcccagccgccaccaagtcccctcaacgccgtcgcctagccccctccctgccgccgcctagcccgcgcaaagtgccggtgggaggggtctgttcctgactgacgcacgctcgccgccacttgccgcgccgccggatggggtttctttcgggagtgaacccgtgcacacgagaggctggaaggtttcccctacttggatatttcctaagggtaaaaaggtcaataacaaattaaaaaaaatattttctttttttctctatttctttactgccataaacccggtcccactcaattccgtctaaaccttacccttttggttaaaaaagtggggataaaaacaaaaaccctaaaaaaggtaaaatcaatattagacatggcagaaatgaaattatcccaaaatattatcagctgatagttaaatatttctacttttgagataggattgaatgtgttcatgagccaagtcctgtctttgtatcccactggtctctggcggcttccctagagcctctggttaatggatttgttgatcctatgtcaaaaagaaaatttctgcttttcagatactccctctatcctataagacatggtcaaatttgacatggtctccaaaactaatatttgtcttataatttctcatatattatagggaaaattggaaccatgccattataattttgcaaaatttgagatatgccatcctgaccatatgaaagtaaattcaaatgtgaatccaatgatatattttttagcaattaaatttaattcatattgtacttgaatgttggtcaaaatattttaaaggtagaatctggaaatgtgtggacaccttatattatgggatgggggagtaggatctaaatcaaaatcgaattctcctagattaattcaatagcatcccatttggccatttgcaaaaacttgtactagtacagttgaagccaattttgacatactattttctcttttatggattgtagtatcaaattaaagcaaactgatcatgtttgatgaaccatcattagttcaaattcaaatactcctagcattatgtttcaaatgattagtcccatttaggcccgttcgaatcctctataaatgaaggataaactttgattttcgtggtacgcttttcaaacggttaaacggtgtgtttcgtgcgaaaactttctatataaaagttgttctaaaatatcagattaatccatttttcaagtttgtaataattaaaaattaattaatcacacattattactacctcgttttacgtgaaacacttgatattcatctttatgggtctgtttggttcacagcccaaaccagccatcaagttgtggcgtcgccagagattgtggcgagagaaataatcgccacagctgtggcggaaataagcatgcaaatgaactagcaaaaagtgtggctgccacaactcacgtattaatcaaacatcagtcaaactgttgtggcagccgcatgtttggcgaggcaatgtgtggcggggatccaaacaccccctatatcttcagaaattcaaacaccaccttataagcaactttgagtgtaaaaacaaagaaaataaaaggagagctttaaccccctcctctctgccttttcccacgagtggagtgaagcggaggagaaggaagcatcgcatccgcctccgatccggcgatggcgagggcgccgccgccgctgtcgtcgttgccgccgccgccgcgccggcccacggtggtgctgcttctggggctggccctcgccttctgcctcgccgtcctctccatccagtcctcattcttcaccgctccgagtgagagcgctctcccgaaaacctagctttcgttccccttcgttgtgtgggattgatggggagggatggattctcttgcagggctggcgagtaggctggatctggactccgacgaggtccgcgcgctctcgggcttccagtcccgcgtccagcagtgcgtggtgcgtgaccccggcttgctctgtgctctcttgaattcaaataattgtcctgccatggaagccttgattgtttttaactaagcacatttctgctttgaagagatcaatttgagttcacagtaattgtggattgtgtcatagtgaagggcaggggcagtgaattagctactagtgttatactgttatggtctacccgtgtgtcgtgtccgctgaaacaaccatgaattgttcatccatgcatggtgtctttgcaatcagtcaatcgtgggatcacattattcatcaaattgctggttcttatttgttacgtttagttcttgtttgttatgcatgaatttggtcggagaaaggatgcgatttataggacaccattccataatgaacaatgaggcaatctgcaaaatggtcatctagaatctatgtgaaactcagtttcagttttagaccttctcaagtattataagttacagatttgcagcattttcctttgatcagcagtagaagtttcatttacatgttctttactctcttgcttcttttctagcttgcttctgaaatctcaactttatttaggcaagaaggggacttggcctcacagcagatattattgatcattgcaagctagtccttagatttcctaaaggaaccaacagcacttgggtaagtattccctgtcatgttcacatgcagttacttctgttaacggatttgtgtccttcaacaaaggtccactcaagatatcacttctcttgacttatgcagtacaacactcagttcaaatattttgaaccactagaatacaactatgatgtctgtgaaactatccttctgtgggaacaggttagtacatggtttatgaattatgaaatagcgtgtttattagaatatatacttatgtgttaatgctaatatgatgccagtaccgtaacatgacgactgtgttgacaagggagtacttagatgtgcgacctgatgggtggttggattatgcagccaaaaggattgcacagctgtaagtttgatacttgttgcacatttgcactattcttcgtaacgaagtgatattaatccgcatactggttaatgtgctttaaaaaatatgcagcggtgctgacaaatgctacaatcgtactttgtgcgaagagcttcttagtgttttactccctgctaagcctccttttcatcctcgccagtttgcaacatgtgctgttgttggtaactcaggggatctcttgaaaacagagtttggacaagagattgatgcacatgatgctgtgttccgagataatgaagcacctgttaataaggtaatctcattgagttcttcatatgtatctaagctaacacttcatatgtatctaagctaacttatgtgaatggcctattttagtgtgttcttgttgaccccgtaggcagctaagctcctcctgttaagttattactccattctctcttcttaatgcctaccctgaaccccttgccatcttattagcttcttgttattttaggtgtcttctatcctaactccggacatctaaaaattatattttcttctaaagttggcacagattgacactcgtttactaattttgctcttattttatctttggcctgcagaagtatgcaaaatatgttgggttgaaaagggactttcgactggttgtcaggggtgctgctcgaaacatggcgccaatactaaagggctcctgtaatgctgtaatcctggtttcttccagataacttcaatcctgatagtgttttaatttactttttcataaatgagagaaaatataatattcgtattggtgttctctattatcctcgaactattagaaagcacatggcaatgtcgttcatttctggttttcgcaacttggaagatgccttgttaagcttgcagagacaattagtattgtgcatcacttgaggactaatatattattccatacaaggacatttgtgtaataacaccagataacttttatttgtagcttaactagttcttataggaatttattatacttcacttaagttgctctcttctaataaattttagatgcatgagatcactttttatagtagtcaccactagatgagcttttaaacaggagtctaactgtcctgcttttgttgcagctgatgaggttcttattataaaaagtttgacgcacaaagaaatcaatgcggtgataaaggtaaaaggttatatgatcacatttttctttcgtccagctgagcatgttgtacaattcactatctgtctcttcttgaatcatactaatgtgaagcatgaatttcatgctgttgtgattttcttcttgttactatggtttttggggactgaaatcattcacactgaatacttggcaattgttttaactggcaggaacttccaaacccagtttatctttttcaaggcatagtcttgagaagaggtgctaaagggactggtatgaagtcaatagaattggccctttccatgtgtgatattatcgacatgtatggattcacagttgaccctaactacacagaatggtaagtcaatgcatggatgtgttatatgtagatatccatggtactattgttctctatgatttttgtgcaaggatgttttatgcccacttcattgtttcaggacaaggtacttctcacccccaaggaaaggacacaatccactgcaagggcgggcttattatcaacttctggagtgccttggagtaagcctccaggctctcgcccatgttttcgtctgatttgtctatatgaagttgtcttgtctaattgctgtttcctgtatgtaggtaattcgaatccattcccccatgagagcaaagagggtagaagattggtcggatatacctagcagggaagagatcagaacagcgcatgctgcggcttttcgtttaaaaaggcatgaaactggtcaatctgatcaaatggggccatttagcaactgcaaggtatggggaacagttgacccagattacggacctgtatcaggaactccagacatgagcgaaacacgaaagagctcaaactacaagaagtgggaggtactcccattcgacagcttacgaatggaggctcaggaacaccatgtccagatgggcggcgtatctctgtacaagatggatggaaacaagctagatgatcttgtttgtgtgagacatgaacgttcatctagttaagtcagcacttaatctttgcctggagatggcatcttgaccctgtggtaatcttcagaggcatatctacttgtcagttgtaagatcacaagaggcaaaggattgaggctattctttagggtttctcattcccctgacagaaaatattcttttattggtttcttagcgactttgtagggatatttgcttaatcagtcggaagaatgttccgctatgggtacagctgtaacgattttggtgccacttgcaacatgtactagccatcacgcaattctgaactgcagttttgttgttgagctagtaacctacaccctgaattgtagtactatagtttttgttgttgacacatgttttcatttcacaatgccatataagtgaaagtcatgtttgttttgttattgacaaatatatttcacaatacggcatttaacgatgccatatgttgctgagctagctacctccccttcaagttccagtttttgctgccagcaaatatattctgttgtggtcttgtggacttaacttttcaacttgatagaacgtgatataagtttgcctaatccgaccttgaaaatattaagtgcagtagcatttagggaaaaaaaagttgaaaaccatgaagcttgtttcaaattagccaggttctccataaaaatttgacaaggctcaaagataactactttcagaaacgtgagcgcagggcaaatctggcaggtcagcacttaaaactacagaacggtgaggtttgcacacaacggcaaaaaaaaaaaagaaaaagaaaaaagagcagcagctagatttcgtgcgaatttacatgatttttttaaaatttgtgggttgctgagagcaaatcttttatgaaaacaatttaacgaacagagcgactgttcaaacatcctgtttaacaggaggtagaaagcgatgagtttggctttctcgcacagtaggaaaattttgctgtatcaatcatatttatcacgattatgattgctattatgtcaccaaatccattatttataccggtaaaaacttgtccctgatttttttccctttttacatagatgaagcagaacaaatcggcatcctaaggtaatacctcgggctgagcccttttatcaaaccaatacatcaaatttgtcattccgattttctggaggtgatttatgcaatgctgaggatgacaacatgacgttgcttttggtcacctgcccatgcctggcaatggcaatcctgtaatccgtgtaacatgaatcagttgtgagcaaacagacagttgaactaagataatcatttggagctaataaatggacgtaacccatatccatatttgtttaactaaacataattgttggcagcgtctcttgcttggatgtaaaaaaaaaatgaaattcccgtttctacataaatggcattttctcaaatgtgagagtcaaccaataactaacccttaacctaactagaactaaatgactaaattacaaggtaagacagccacggttgagtgcataaattatccttccgtctagaagcaatgcatactaaaactacatatatcgcaataattatctttcagttgaaaatgtagtacctttgatggagaagaatgggaatgtgcaggccttctttcggaacctataacatgctaatttgaaccggttgttgtaacacaaggggcagaagacgcagaagtgttgccactacttgtcgctgcagtagttggattgttttctgtaactctctcattgcttgattctgtactgggaataacttcagaagtggatattgctgggccatcacttgttctaccattactacctctagtttccagacgctccatcatccttgatacggatgcaattccagcattaacttctcttcttacttcagaaccaagatctgccacagatgaatgacgcgaaaaaagtctctccttccatcctcgagtactttttgtaatagattccttgtacctgaatcggacaaaaggagaaacagatttaacataaaagttgatagacaactttcgaagcaacttaagaaaataaaactccatacttcatagagacagcatttaagcgagacttcagagagtctgagaaagactgaagatctgaaggcccagctctgtcgttgtttactggagttgattgcccagtggaatgcctcctgatacaccaggatcatcatattggttatcataaaaaaaaaacataaggacatagtgcatgcatataggtgactcaatttacctgttgaaaaacctagggctagatacaggggtactatttccagatgaaacaacagcatcttgatcagcatcgtaggtaagcatcccaggactttgattgcctgcttcttcatgggtgttagcatgcagtgataattcaccagttgtgtggacaggacttgattcattatccacttccccttgaacggacgatgaagaaactgaaccagcagaaggcatgtttggatgcgaagaaaaaactaagaactgtggacgaccatgagagccggaacgacccctgtgtccttctcttctaccaaggtggtgtgaccttcccattgcagcggctgctgctaggtgctgtaatatacgctcttcaagttcagcatcattaccaacaacaggtaactgcaaaagttcatcttgctaattaggttaacactagaaaatgcttcactagtcaaatcaggaggaatatatcaaaactcaagttagtttcataacacatacatgctgaacctcaaaatctccaagagcaggatgatgaaatatagttgtatttcgagtttgattggtccttacattcctttcacgctccactgcctcgagcagctcttgactgacatattagtaggacagaggttagtacccttttacatgttaaaattctgcctgatatctgtataggcaaagaaaacataaagtattttgacgacttgcctggtaggatccttcaaactgataggctgccaacacataggacactgagaacttctctgacacctatgcaaaaggaccaccgatcatcaatatgaaaaatctttttacacagaaaaaagaactgataatggaatttgccatgtgaagtctcattcataatctctggagaaatccccttacaagttacagctagttaactaccactgaagtttcacaattccactatatataagaaggatctatataaatatatagcaaatcttatttacctatactgtaatatgaacaaaactatgaataattctataatacagcaccccttcaattaataaaggagtacattttcataaaacagcactacatttgctaaagctatcgcaaactgcaatcttgagaaaaaaattcataacaggcctcatttatttattaaaaaaaggattcacaaaattacattttaagcattatcattgtattctatcgacaccagctgttagtctcacaaacctagccaaattcacaatggaacatatatgctagtaactatcaagcggggccaagtacattgagtatgatggaaataactaaagttcagttttgtcaaatgtttcgaaagatcaaatgttgtgaaacaatcacttgaaaatgtgattttgtgatggttttaccaaaggtagtagggctttcagaaatttaatctcaataaaattaaacaatcatgatatgcatgcatccataggaatgtatggaaatactgaaattagcacatggaaactatactaataggtagatactttgatagttgaaagtatttaggtatattgtctggtcacactgacgtttaatgcaaactggaagaagtgtaaaaagttgacagtaggtgtatcatggtcatcaatgcacaaatatatgggattagcaccctagagagagcaggatattatgtactagaagtctggttcattccttcactgaattttataacaactcctcaatagaaaaagaacagttgatagtctacccaaaacctcaagcatgcaaagctgaccacatgaaatcaaaactgacccaaatagtttgatattgatatataatgtcaacatgcttgcagttgatccaggaacaactcaaataaattcagacagacaaagtacagcgcacagcagaaatataagaatttttcaccaatgatatgcataaactggggtcaatattataccattcaagaatgcattggaggtggaactcgtgtttgcaaccagtcaactacataacaaagaaacacagtaaaatggttaaaagaatgtcatatatgagaaaaaacatacaattgaagataaggcatcttactgtggaagggtcactctcacagaacgcctcaaggcagatactacatgcatcatcacatgcatcctgaatcccaccctcaacaaaggctgcagctgatgtcaaaccctccatcttggctttctcatcagttccagatgccattgcaacggaatcacaacactgatatctagaatatggagaaaagaagggcttagaatataaacacttcaattgaccaaagtctcaaaatggcttcacgatggaaagcaaacacatcagttattcacagctgaggccaaaatgatcccatgaaaacaaatatagtatacacttaaacaaacatgttatattgttgaaaaaaagagcctgtaaacaatggcacaggtgttcaaattcagttttaacaaagtatagctttccgaagttgccaaaaaaaaaaaactaccacagataagttgtgtagccaagtaaaatgcattgttaaactcattttcatttgctgtatagtgcatacgaattcactgctcgctagtcaccaagtatgatcttttgcacttgggggagttagttgaaaatgatcttgagatattgtaaaactgtagtgcaaatcctccctaatccctttcaatagttcattttttttcaagaacttctatccctaatgaaaactagatttgcaagatttatgccaattttcataggatatatactccgagcaaatgaacatattagccaacaaaaactaccagttatgtcaaaactcatcaagccaaacatgggaaaaataagaaagttatattccccatatcagaattccagaagccccataatgattctatcaggtaatgctatgtaatcatagtcatagttccagcacaagacccatttttactcggtagagcctcaaccagctcaaattctctccaattaatacctccaaaccatagcaaacgccgaccaaatcaaacataaaccccagaacagaacaatttggtctaacgagtacccttccaatcagcgcgatttcacacggcacggctcaggtcccccggaatcacgatccaaagtcacgcccaaatcaattaaccccccaccccacaatagaactacctaaaatccaaaattctcacacaattcaacaaaagcacgcagcataccgcgaattcccctaatcgcacaacacgaacacccccccaattctcaccacatcaaaccccaaacccgaacaaacacatccctacttagacccaagcccagcaacccacaccacatcgtctccaattcccccccatccaaaccccaccccacaacccgaggaatccaaccccgcgccccccaccaaaattggacccagctcgcccaaccgcccccagatcgtcgacggcccccacaccaaccaccaccgtaaccgaacgggaaggaacgggatccgggcttaccaggggcaccggcggcgacgccgacgaggacgcccgatcggatcctgctgcgcgcgcaaggcgatggggagcactaaaccctaactaggtaggtagcctctt

SEQ ID NO: 15984 - DNA, 943 bp, Oryza sativa
aaaaaaagtggagtttatatttagtttccaacttgtaagttgagcttcaagagctaggtaagagatagctctaaaccaaacttgtaggtctagagcaaagttgcaaagttatctacccccaactcattgtttcaagttcccccccatccaaaccccaccccacaacccgaggaatccaactccgcgccccccaccaaaattggacccagctcgcccaaccgcccccagatcgccgacgccccccacaccacccaccaccgcaaccgaacgggaaggatcgggatccggccttaccaggggcaccgccgccgacgccgacgaggacgcccgatcggatccggctgcgcgcgcgaggcgatggggagcacgaaaccctagctagctagctagcctcttcgcctcctcctccaacctcctcttctctctgggtgaggaggcgatggggaaaggagaagaaaggtatcgagacgacgaggcgagcaagcgcgtgcctcctctccactcggccaccaccaccccaccccccagtggggcccaccctcaccccaccccccagtggggcccaccctcaccccaaccgagacacccgtcgtcaccccgacgccgcccccacctacccacacaccgacacgtggggccaccatcaaagctggtcccacatgtcaaccgcgtaggctagctgtagcagagagagagtgagacaagcgggtcgccttttaagtacgttttgaccgcttcgcctgccccgacccgctctccggggaccacctgtcagtgaccttttatggtggggtaggagtaggtgacggtggagattgccttttgtgggggggtagaggcggtggggccacgacgtcagtgagcgcggtggcggtgagcgcgtgcgaggggcgcggctttcgagagaggtaataacggcacgtcggccaccgtctccgaggat

SEQ ID NO: 15985 - DNA, 512 bp, Oryza sativa
gccttagcattctggggttcacaaagaaatttctcttgctttcattcacccccttctaatcttcggctatcatattttagatgcttgcctaattttgggttttcatgctcacgtaccattatagtgggtctaccttaaaaatgatgaagccacttgccttatctatgttaattttgtttactgcaagttgtgcactttcggttattggttaaaccaaaagatgatgacttttctttggaattgcgagtgacttcaaatactattggattcaaactgatataatatcttgttatctagcgtgtttgtagaacggttaatactttcccattctttcatgtcaaaacttcatacctataatgatggttgttagagagttgcccgtcagcttggtgaagatgattcagcggaaattcacctaacatcccataactgctattagcagcagactaaaccgcaacctatcagatattggcgagtggagcatcttttggacatgctcatttattataatc

SEQ ID NO: 15986 - DNA, 1509 bp, Oryza sativa
aaatacttcccttgctcaaataattcccagaaaattctagaaaatagaggagcaagcatagtatttaataaaattttatctaactcatttttatattgaaaattttcctagaaaattagggtttagcttgtaggcttttaaaataatttctaaaaatgatttaaaatatgcatttttaatttaatcgatttttagggcgtgacaatattgccagagattatataggatatatgataactcgatgaattacataaacaagattagagtgtcataaagatggaagcactaatcccgagaacgcaagccaccataacaagttttacctctagttgaagatcgaaaccaatgcagctcaacttgaaagcaagaacttgtcgaaaataaatgaaagtaaaagagtggtgatgcgccgagattgtattgaacgattgttgtttgatttcatgggttcgggtcatatttatacccgtcataaaaaatatgtcctagtctttgcggcagacttttgcccaaacttatctctaaggatattacataaaatatcctaattaatagatacaattgccttttcaggacttaatccgtgcgtggcaatccatatgaagcacattaactcaattcgacaacgtgtaccgagtcacattgtcggaatcggctcaatcggctaccttgtctgactcgaactctgccgatcctgatcgtagccgattcggacttcggccgattcttgctctgtttccggaacaatctttctcttggattctgcttcaattttatcttcatctccgatacttgaattaccaaatttggtcgttaacaaatgccccccaagtctggaatatttggtaatgtttcggatttgccatattttatctccaagaaaatcgctcattgccgtttttcctaccgttaccacagcgctttaaatactaaccgtcacccctgagaaacttcacaccgttacttctgttttcacagcttaagaaaatcttgccttttctctccggcgatcccctcggtgcataaggcgatcttgagatgattttccctccgaccaaacttccgcccgtggcaatgtcaatttctgccagcccgtctgctgtgccattagccgaatatgcagaggtacgtatccatcggctagatcctctcctttgtgcagtagatcggttttcctctgtctcatcttgttttcttcttctctattcttttttgcatcggtagcatctttccaatctggttgcgattcccagtctatcccatgagcatcagtatttccttggtcctatcggcgattccgaccccattgagttcattatcaccgaaaccaataggataccttttagattggcaacccaaatctaggtcattggaaaaacactttcaaatcttggccttcccttgagaaaagatggcccgcctggtacaagcgcgtgtcggctagcaaacaagttcactgggacgaactcggaatcggccaagcgcttgctctcacaatagcaaattcgg

SEQ ID NO: 15987 - DNA, 438 bp, Oryza sativa
ctgacacgtctcgaccttttttgttgcaggggggcgatggtcttttgccattttggtccaaatgtgagtgcgttgccgttcgagagggaggaggagaaacagtaggagaggttaatgtgaaaagcgagttctacaggtggagtagcggagatggtccgcataatgttcgtttccaggggttgcggctgtgtttagagcagggtgaaaaattttgtcgcgttgtattggttatacggacatatatttaaaatattaaatatggttataataaaataaattatagattttgcctataaactgtgagatgaatttattaaacctaattaatctgttattagtaaatgtttactatagcattatattattaaatcatagagtaattaggtttaaaagattcgtcttacaatttacacgcaatctatgtaatcagggggatcc

SEQ ID NO: 15988 - DNA, 6545 bp, Oryza sativa
  unsure (1)..(6545): unsure at all n locations
gcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccattatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttaccgtgctcctcctgacggatagccttatccaccagcttctcaaagtcctcataatctctagagatcaactggttagtcaattcatcatcaagaccagacagaaacttctcctgcttctcggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcttcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcaccgttggcacgtgctccattgttcggctcttcgctgccactggcgttgttcgagtcgcgtgaaccattccttatctccatctgaaggggataggtagaaatatgagaaaaggaggaaaaacaggggggctcagaaactaatcttgcttatgaatttaagtgcaattatcttaatcttgattaaaacactgaaaaagaggcacgcactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggaccgacatctaaagtagacaagggataggaaccaattcatgctcaaatccaaattaaaccaagcaaaagaagactcaaataaataaccgagcatgatgatttttatgcatagaacatttttcatgaactcaaataaagacactaatgcaactaaacaataaattaatgcatagactagttgcatagaaaatgatgcgcataacattgcccccatcgaatatagacacgacctaatgcataacccccaataaattcccgactgactgtcgaataaactccaactaaaatttttctaaagccctagactgagctaataatttttttttaaaaaaaaaatccgatccgaatgaacgaccaagatttttcccgcaaaccaaagaggcaaaactccaaattttcccgaaacaattccaggtgcaaaaaggcatatgcagatgaaaaaaggggttcagagggctcttagggtttccagttggcttgtcttacggtcaaagtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagataaaccgggaagcttgacttaagcagcgagcgactccactccacaggcaatccttgacggcagcgacgaaaccaactttgacaaaacagcttcaactaggaagatcttcagctctggtgtgggggaaaagagagcaagactgagtactacccactgtactcaacaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgttgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcataaccatgcacccacagcccaccattcagtgtattttaattaactaacaccattgcggtggcaccaatctaaagctataccaatagacaaagtctatgtaataaggtgatccccatttgtgtgctagttgaactaagcatggctaagcatttcctaaaccaacatctagtcattttgatacctaagttatcaatggcataaggtaaacaataaatggctgaggaataggacccatcctacatgacattgtaaaaggatgcaacatttaatagaaatgcgggatatttgtaaattgggtacaatatgatcaaacgtattgcatgacttgccttgctctcgaactgacgagacctcagcaacgtcttcgagaaaccgcggatcgacgaaacggccgaaacctacgcgacaaacaaagcacacaagcaaaacatgctataagactactgaaacaggaaacaaaactatttttaatggattctttgcatttttcttgatttactgagacttgaatggacttaaacggagctcggatgaattacttatgaattttagaagataaactgcgtttttactaataaagaaaagtccttaatcaatttattgcgcaataaagcccagggctgacgtcagcggaagggagggggtggcgccgacaggcgggccccactggtcagcggcactaagggagggagagggggcggctggcaagcgggccccactggcagcggctctagggggaaggagtgggcggcggcatgctcggcacggctcaagccggccggccatggcaaggcgacgacggcgcacgaccgccggcggtgaccggcggcgcggggagacggcggcggccggcgcgaaggcggcggcggcagccgaagacgacggcgcacgcgcggagggcggcggcgctcacgggggagaggaaaggaaggaggaaaggggattcctcaccggcgagcacgacggccggcgcgaaggaagaaaacggcggcgacgaccggtgatgccggggcgcgaacgggcggcggcggcaccctaggagagagcatagaggggttagggaagggaaggcgaccatggcggcttgaattgccggccggagacggaggggagagagggtctcaccggcgcgcgaggagaaaagggctccggcggtgattcgcggcaatgaagcggcggccgaggtgcgggcgggctcggtgagcgcgacggcggcgactgcgcggcgcggcggtggctatagtggcggcggcgcgtggccggagacggcggtaggcggcggcgcaaggggcgagcggcgcggcgacgataggaagcacgggagggcgcggcgagtgcgaaaaacgagagaggaagacgcggggagcgatttataggtgcgggagggggcggacgtggccggggaggtggccgatttggccggcgacgtggggaggagagagagtgagagaggtggattcgaaatcgaatcccgccctctcgagcgcgcgcgcgggccgggagatgcgggggaagaggcggcgacgtggggaggacgcgggagcggcgcggcgtgggcacgggaagagcggaggaggcagcggcgacatgggcggttggagcttcggctctagcggccggaggtgggagacgaccgacaggtggggcccacctgtcggcgtcccgagagagaggagggaggggcggcttgggccggcccacaaggaggggggaccgcgggagagggatgggccgacggcccaacaaagaaaaaggagggaaaagaaaagaaaaagagaaaaaaggattttcctgggattaaaaattgcactttggtgatttttaattggtaaaaaattatttccaaggctctgaaaattccactaaaaatcctgttaatgcattggagcatggggaactcaagaaaaattccaccacgccgaattcaattattaattgcatttattaattaaggaattagctctaggttaattaagataatttcttcggacgatttatttagccaatttttaaagcaagcaaaggggggaaaacttcagggcgtgacaccgtgtccaggtgatcgcgggacatcggggtgagtccattgtaaaagttctacaggatcagccaatcgtccatcccatgatgaggacaggtggccacatactcctgcagtcgttcccatgcatccggaatagacttgtcccttgtctgctggaaactagaaatccttccacgaagggcattggttttgcccatcgggaagaatttcgagaggaatgccgtagagcacttgtcccatgtgttgacagcagcatggttggcatagaaccgctgcttcgctctcccaagaaggaagaatggaaacagccttagcctgacggcgtctggactgacgcccttgatggtatatgtgctacagatctccaggaactgttgcagatgaatgttggcattgttgacggcggaagtgctaatgggcgatcgatcgcccggcgacaagggtagcgatcgatcccccttccccctccctccctccacctggtttccttttttggcaccgtattactttcctattttagtaaatttatgaacctaaagtttatacacctcaggtttacacatctaaagtttagagaccaaaagtttataagtcaaaagtttatatatccgattcaaattcaaatttgaattcaaatatttttttatatataggatttctatacatctaaagtttatagacctgaagtttatagacccaatgtttataagtgaaaagtttacatgcccgattcaaatttgaatttgaattatatcgggattcaaatttgaatttgaattcaaatattaaaatatatatatagtatttttatgcatctaaagtttatacacctaaagtttatagacccaaagtttataagtcaaaaatttacatacctgattcaaatttgaatttgaattatatccgttcaaatttgaatttgaattaaatattttctatatatagtatttctatacatctaaagtttatacacctaaagtttatagacccaaagtttataaatcaaaagtttacatacccgattcaaatttgaatttaaattcaaatattagtttatagacccaaagtttataggtcaaaagtttacatacccgtttcaaatttgaatttgaatttgaatttgaattcaaatattagtttatagacccaaagtttataagtaaaaagtttacgtacacattaaaaatttgaattttaattcaaatttatatggtgtagtagtaagagaagaagggga

SEQ ID NO: 15989 - DNA, 4912 bp, Oryza sativa
  unsure (1)..(4912): unsure at all n locations
ccgcccattaggagtaccctgttgacggtccttaaatcataatatttgaccgtcaatgcctacatataatggaataaaacatggtatccaacttagtggtaggtattattactaatcatttccactagtgttggtgaaatatgtgtatgcaggtattttgaggagaaaacacatccgtcatgcgacaaaatgcacctctgcgcattcaagacgcatttacacggattggagggcccatatgtcaaccaaaaccacttagaattgggccaaaacattgtgcaagatgtttggggcccaataagcaacctaccggccaaaggagaggccggaaggacagatttttggttcggncnnnccnncnnntnnnncnnaccaannctngcnccnnccgccatctggcttcatgtggacggtttggatttctcccctatggcagttgcagggtgttttggccatttcccatacccctaaccgtcatttggagcctatataaggagatcttcatctcattccaatacacacaactttgagctgaattacaagagactctattgtatcttttatacattagaataaggtagagagtgagggggagctttggaggagtgcccggaagtttggcacttatctgacttctacctcgatgagtgtagcttcgtaggaggaattctggaggagtaccggagcttttgatacactctgctctggggtcggagaacttcttctataaagtaagcattcgtgttcctttcttatgttatttaattactttctttgagtaagatagatttccatctttgcgggttcattgtttagtatttatactaagtgctctagtactaggactctagataaataaggaagttcctgcgcaagtattagagtagtaattaataacttaggcgtggtgtctaggttagagattacctttgtttgttgtgtatcccatggatttgtcagaggtagacggcaggtggtgacagccctgaatcccgtcctagtaatctccacgttcggatgcatcatagagctatagccgaaaccacgctggcagaccagcaggggtcggtgcctgatgcaacagataggaaattacctttgcttagcttagatagttaagccacatagaaagtcctctcaagcctgccgaccatcggttgttgtccttagatcgtcttagccttaggtagattacacacattccctgagttcgatatccttttggggtcacccgaaagtgaagtgctacagcagtattccgtgcgcttgcggatttatctgtggtcgtaagaaataccaacaggcatcctcgttaggcttgccatagaatgggctagcctgcgccatcgtgatgagattggacttcaagtcgaaatccacgtctcccatgttgatctgcggcccaatggccacattgtcagtagagggagcagcgaactcgtgaagggtcttgtcagccatagtcctgaaagttggtggtgctggtacgactggtttctatgtcgtagagttttctgcagagcaacgactcgcggtctgacgcttcggacgaaagcttttggattttctttgaagttttccgacaagttgaaaccagtcatgcactaccctgttttcacaataaaagcgaaaacaaccaaggttatcctgctattagttcaggtaatctctattacgaatcttcctcggcaatggcgccagaaatgtttgttggtatttcttaacgacattactagaaatataattcccagcaatggcacagaaatacttctggtatattatggttacagagttcatccacaagcgcacggatataccattgtagcatttcactcgagagtattccaagggtattgtatttattttatcccatgggaaaatcatgtagactgataaacaagcatcagctactgagaatatattatctaagctaagtggaaagaaattagaaaaggaaatctatttctatacttctaatatacatacatacattcttgttaactaatacactagctaataccctatagccgatgtcctcctggtacttcgacaagccacacctgagtgccgagttccttatggcagcccgtcaaacggcggctgtacgtgaaacaagactaaaactcaaaaaaccagtggagctggtgcagcgcatagaatttaattcctagaagttatcagtggcaatggatagaggaaatatcgtgcatgcatgtaggcagtcggcagtggatatgcatgcagatctggagaggaaaacaaggatttgttgcatgcatagacaatcgagtagatcaaccaaataaatcaagagatatacatgcttgtccagtaaaatagcaagcagtacaggagatcgcggccagagggaaacggtcgtgcaacaacctcgtaatttcagaaacaaatccaccgatcagaaggaaaccacagatcttctatttttctgggcttaagtgcaagcgacaggaacaaggacgacgacacaatctgattagaacaaataatatgctaccaagataaacgggacccgatctgcatgcaatcaaaagcaaaactcaaaccacaactaagaactaaacgaagccagcactagagacgacaacggaccagcattcaaagacacaaaactgaatgaaatttgcaaatcacaaacctatgtttggtaaagggaaaagtggtgcggtaattttgtatattgataggtatggaaaataaatctataaaaaaaaatcctcaccatgctaccgaagctctgataccaactgatgacgctctctctcgtggcccgatcttctggtgagaggataactctcgttttgactgagtgcgacgtttgcgacatggctaccaaccagaacaagtccaggactgttgatacgaaaaatacacactggcctggaagatctgcttaacttcagtgcaggtccaaaaatcttacctttaggttcgtcagcgtgccagttgatttgatcctgcaatcaacaagaaataatgatagaaaaatagtggttaaatccataaacgatagccgatcggccagccgccgatgacatatcatttatctttgagccgatgtcatatttgaattgatcagcagtcataaataggcaagaaagaactaaatctattcgaccggctgtagatatctgatgaaccctgagttcctctcgacactcacggctgttgttggcccgatctttcggtgagttgatgataactacgatttgggagaaacgtcgacgacccgactacaaccatacaagacgttgcgttgcgccttagcgatcgatacacctttccgtgggttgttgatgttgccggtgcaaatcaaccttattcctgcaagcaaatcgaagaaacaagcaagaacaagataaaagcaatctgaaatgcaaataggagttgaatacgaatgataagttggggtttcaaatacaagcagacggacagtctagccgacacgcgcgctgcaaggaagtagcaatggctaaactttcatccaaacaaaacccaagaaaccctgaaggggtacctacctatttataggggtgggaggacgactaaggggtgccaagggtcgtcctccacctggttggggcgcaccccacatgggccccacttgggtaggggtcccaaacaaagttacaagcccagaggcacaagacaggtgacgcagcaccttgtttatgtgattgcggccaaacgacatggaatctggcgatgaggctagatccgttggaaagaaggctccaagagctttccatcaagtactcacgggccaaaaacgaaggtcgtatgcagattcggcggccatttgaaaacagcagtgtagctggtggccgaattggattccagcacttggaggacttgaacttaatatcgtgctgttcatccatgatgtgagcaatggttgtgtccgtagtagccatggtcacatcaatatcaatggtatataatacttccgtcgatatatacttaaatcaagtgatcgagacagtataaatcacttacatcgatatatatattaacaagaagattatagacgtttatggcatagccgatcaaatagatccagcatgcatcggctaatactcctatactattctatattaagatattaaagcaagcaaaatatatcaaacaggaagcttaatatacctaattgtgacaagatcttaacataaagagcggatttaacatgtcaatcaagcacataagatataaaagagttaaatcaggtaagatcggctgaaactccgatactaccctaatcggcaaccaaaaagtaggctagagattgagattctaatcacgacttataaggtcaaactcaactaatgcagctataagtatgaaaagaaggataatatctagacaatcaagccgttgaatgtttcatagggtggtggatatcctatataatctaggtcaacgttggtatttagcctaatcggctgccttccaatgatagatattacccgattaaaagttaaataacaatatttgtcacgcccggaatttctatccaaaattccaaacgcttacatgtgtgttaaaccctcgtccaggaatcaaccgaggcacacaatgacaatattgataatagagtacaattaaataactatttaacaatcgcaaataataaattattacagaggtagatagttcctctcaaaaaaaaacattctacgcagcagaaaaattaaactaaaacaatctacggaacagctatggcaactccactccacaggcaacttaaccaggacaagcctaatcctccagaccatcaccttcactcaagtactcctcttctgatgaatgaatattgcaagaatgagcatatgacatactcaacaagccacacagcaaatatgcaagtgcacaggataacaaaggatggcatagggct

SEQ ID NO: 15990 - DNA, 844 bp, Oryza sativa
  unsure (1)..(844): unsure at all n locations
atgtctgctgaatactagtatatgtaaatcatagccaatactacgtatctgttcatctctacatctcaaacacatggcgtgttcttcaaacttcacaagaaatgnagaatggatgatacagaacttgattttactcatacatatttgcactgtcgaattcgatctaattgactcgaccgatggccatggagatgtatgcacatcctaaataatttcataattanctctctctctctctctcattgattgattgattttttttaggaccgactatttgccattgcacataaatcatcttaaaaatttcgtgaattctaaaccattatattgctttgagattcttacggtacctcctaacccctcctgactcctagcttgatgcccctactaccactaccgtaagtgttgcccaaccttgccagcgaggctaaggcaataacatcagtgagaggcccctagctgacctcctccccctccgctctctcgccctcttcctctcctcaagttggtaatgacgaggtgctcttgccatgctgtctttctcatatccagtggctcttcgcctcttcgccactagtagaggtagagccacttgtggaacagcttgggcttaagccccacacatggcaaagaatttcaatggatatagaccaaattttagatagaatttcagtaaaaagaaattaaaacagcatggttcaacccttctcttggtgaaatatttcctccgcccctggttgctggagacactaccactcccccggctcatatccattcactccgctttgtgcctgtcgccaacactaggccacaacccattgttgacgggctgcaggaatacgag

SEQ ID NO: 15991 - DNA, 18850 bp, Oryza sativa
atttaaattatttcttaaatgcaattccatttattacaaatactttcttagctcaaataaatcccagaaaaatctaggaattatagaattaagcaaagtatttaatgaaattttatctgggcccattttatattggaatttattaattaaaactagattttcttttcaagacttttaaaattatttctaaaaattccatttaaacaacaatttatatattttgaattttcagggtgtgacaaacctaccccccttaaacagaatctcgtcctcgagattcggaagaactggcgaacaggtgcggatgagctgacttcaattcatcttctcgttcccaagttgattcttcttccgagtgattactccactggactttgcaaaaacggataactcgattcctggttcttctctcacttgtttccaggatacggattggtttctcaacataagtcaaatcctcttggacttctatctgctcaatattagcttcttcggtaggtacccttaaacactttttcaattgcgacacatggaacacattatgtactcctgccaaagattgaggtaactccaactgataagcaacctctcctcttctactgacaatcttataaggtcccacaaaacgcggtgccaattttcccttggtatgaaaacgatgaactcctcgtagaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcgacacttccgaccatacagtgcttcgtaaggagccatctgaagactagcttgataactgttgttgtacgaaaattctgcatagggtagattcttatcccaacttccaccgaaatctagagcacaagctctcaacatgtcttccaaaatttgattcaccctttcggtttgtccgtctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgctaagcgacttccggaataagttgtctttaccggaatgaaatgagccactttggtaagtctgtcgactatcacccaaatagagtcatggcctgatgacgttctgggtaaaccagtaataaaatccataccaatttcttcccatttccattcaggaatcttcaaaggttgcaacaaaccggcgggtttttgatgttctgccttgactcgctgacaaacatcacatactgctacgtattctgcgatttcacgcttcatacttgcccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaacgaaacctctatcgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgatgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatgcacttgaaaacccttctttggatcaggcaaaatcaaaataggagctgatattaagcgacttttcaattcttgaaaactctgttcacattcttccgaccacttgtacttcacatctttctgaagcagtcgtgtcatgggcttagcaatcttggaaaaattctctataaacctccgataatatcctgcaaggcctaggaaactgcgaatctctgaaactgtctttggttgcttccaattggttacggattccacgttactaggatcgacggcaactcctccggctgagatgacgtgaccaaggaatttcacttcagacaaccaaaattcacacttgctaaacttagcatacagttgatgttctcgtagcttctccaatgcaaggcgaagatgttcttcatgctcttctttggttcgagagtagataagaatatcatcaataaagaccaccacgaacttgtctaggtattccataaacaccttattcatcaagttcatgaagaaagcaggggcattggtaagtccaaaagacataacagtacattcaaacaacccatacctagtggtaaaagttgtcttaggtatatcctcctctttgattctcaactgatgataccctgatcgaagatctatcttggagaaaacagtggcacctttaagttgatcaaacaaatcatcaatcctgggtagtggatacttattcttaatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcgtagataagaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctgggcagggacaaccttcacacgtcggggcttcggacacttgtcagcataatgtcctggatctccacagttgaaacacaccacgggcttgttgccttgctccctcttggcaggttgttgctgtgctggagctgcaacaggacgtggagcttgattacggatgttgttgccagcattgttgttgaagaactgacgttgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggaaagcgacctgaactccttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttttggggaggtgcatgattattcccttggttttgctgattctgaaattgctgcatcatcatgttcataagctgtgtctgttgagcaagaacttgggccagagtgggattctctccattgttgttgttattggggttgttgggaccattcccattgctacgagtgttcaccatctggcatggacagggcacaagaagagaaaccggggaaactacttaggacagagaattactttaacttttattgatcttaactgagtttcattattacaaactgaagactctcacaccactaaactcaccaacttcctaacactcaaaagcaaacaaacacatgcaattacatcccaccactgatgtaaatcacatgcgagacacacacaagcaaacttaaagcaagcaaactaacacaacgatctaagacaacgacttaacaagtcactctagttcttccaagcatcggaggtcgattgaaggctcgtcttcatcatcttgagttgctacccactcaatcttggaattgttgcgcttagattcttcttcttcatcactacttatgatgatgaccggaggatccgcttgagctggagcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccgatcttcacgatcttgagctgctaacacagtctccgcacgactttcatccatagcccacaacatctcaaccaaatgtttcgtggtaacatcattctcaattccttcagtctcaaggtaactgccacggtcacttccctgaggttggcgaggatggtagcgatactcagtgtcggccaattgatcactgtagcgatcacggagctctcctatggcgatccttgccacctcctgacatgcatggatgtagtttcttcctccagcttcaaacatcactgaggggacctcttcactattgctgttcaaggtgactctgactcggcacttctcttcatgacgatcatgaggaatctgggcataaaaaggggcagtcccaaatccaatgacaaaggacatcgtgcgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaagaggtaagtaaataaagtaaaccaagctttgcgaaataaattaaaacagttggaaacgaggtcacaaattttgtaattttgaataactggtttcaaaagaaagttataaaatcaacatactaaatttattttattgcagcaagattaaataaaacagtattgtaaaacttttgctggtaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacaaaacagttaagtaattacacaatattaagccaacgctatacaacataccctgttgtataggcccaaccattctgaacaaccaccccggctgcacagttctatctccaaaccaggaatgtaccattccaaaccaggagctaatcaaattattatcagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgcccacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcaagtacgaaagggccataacaatcaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaaggggatttattgcgtcagcgggctagggtttggtggaccgggcgcacgggcggcggttcacgcgaacggacggccgagatttaaccgatccaagatggacggccgagatcgatcgggtccacggcggctcacggcggacgaccccgatgacgtcagcggtgacgtcaccgacagcggcggcggctcggcggagaagacggctcgaacggcgcacgctcgccggcgaacggcggcactaggacgcaaacggagggcaccaagacgtagaggacaacacggcgaactcaccggtgacctaaacggcggcggaagaccaacggacggcgacggcgacgaggaggaagcggcgaagctcttcgggtcgacggcggcgaagctgatccggtgatctccggcgacggcgaaggggcggacgaggacggcgacgacttggcgagcacgacggcggtcttcccgagcgacggcgacggctgaaacgacggcggcgcacggctggagcgacggcgacgacggcaaagctagggcacacggcgctagggcttttccgacgacgagaggcgaaggcgaaggtggcgacgggtagagaagacaccgggggtccttttaaaggggctcggaggcggcggcgaaggcccacggcgacggcaacggcgaaggaaactcgcggcttggagagagggaaaaccgatccgaatcgaactcgattccaaagctttccaaagcgatttaaccaaagattccaaaggagaaaaggtagaggagatcccagagatcatttcccctctaacaaatcggccggagaaggaaaggaacggccggatttggaaagcggcggcgacggcagctcggcggcgcgaaactagggtttcggcccgaggaagacgacgaccgacaagcgggacccacctgtcagcgacagcgagggcgcgcgcgcggctgactgggccggctgggccgaggagagagaagagaggttttgggccgactttcggcccaaagccaaaagaagactttttaaaacctttttcaatttaaattatttcttaaatgcaattccatttattacaaatactttcttagctcaaataaatcccagaaaaatctaggaattatagaattaagcaaagtatttaatgaaattttatctgggcccattttatattggaatttattaattaaaactagattttcttttcaagacttttaaaattatttctaaaaattccatttaaacaacaatttatatattttgaattttcagggtgtgacaccaagtctatccgaaactctatgtctctcttaggtggcatacctggcaaatcctcgggaaacacgtctgggtagtcttgtactataggaatctcttgtagagcaacttggtttaagttcacaccatgatatttaggggaggacacaaagaaagaaacggtttcccaattgctactggttaaagtcaccttacggttggcacaatctataactcctctgtgacgagataaccagtccatccctaagataacatctagatctttggattctagcaagataagcgaggatgggaaaagaacttcttctatttctatagtaacagaaggacaatactatgtcgaaaatacttgattgcctggggtattaactagtaaaggtctcccaagactaacaacttccatcccatgtttgctcgcaaaacttttagacaaaaaggaatgtgtagcaccggaatcaaaaagcacagttgcggtatagagttaacaggaaacgtacccaaaacaacatctggtgcattctgagcttctgctgctgcaacatgattaacacgtgccttcggtgctagaacattggagttgttcggggctggagcgttcttcacatgccgaggcttaggacacttatcagcataatgtcctggatcaccacaattgaagcatatcactggcttgcttccctgttccttcctaacgggctgattctgagctggagttgctgcaggacgagcaaccatgttgcggttgtcattgccacgattaccagtattgttattgtagaactggcgttggggacggacaactgatgaagatcctccttgagggtacgatggagcttgaggtccagtaacgagacgcggcctctggttactgccctgttgtgccttgaattgggcagccctgcgcttcttctgctccatccggttatacttgtcttcctgacgaatcgccttgtccaccaactgctggaaatcccggaaatccgtagacatcaaggcataagacaactcatcattcagtccctccaagaacttctcctgacgctcttcatcggtgcgaacatcttccggagcataacgagctaaacggttgacatcatggaggtactcggtgaccgaacgagatccctgattgagtgctctaaattctctcttctttagagctacaacacctgacggtatatgcgtcttcttaaaagcagtcgtgaactcctgccaagtgataagttctccttcagccctgccttggcgaaaatgatcccaccattcagcagcaggtccatgcaactgatgcgaagcaaaagaaactttctcctgctcagtacactggatcaaatccaacttcttctccaccgcatgcaaccaatctcctgcttctactggattggtggtgcttgaaaaggtagggggtctcacacgtaagaaatctgccaacttgttttggggaggtgggggtggattctgattctgattgtttgcctgctgattctgtgcctgctgcactaacagattgatcagttgtgtttgttgggccagaatctgagctagcgtgggatctcctccattgttagtagctccacttccacttccacttccgcttccacttccggtgccagtgcgcgtgttcaccatctgatgataagcagagacaacaggaaagaacgacagagagacacccttagaacggagttacttaattaatttaaattctatattgctcttaactgtgtatgattacatttaagtggcattaacactatctcaccaactatcttacactctgacaagcaaaagaactagactcatgctgttacatcccaccaatgatgtaagcaacaactaaaacccacacactcacaaacaaacttaaacaagcaatctaacacagcgaactacggcaacgatctaactaagcgactaatcccgccttgcgtcggaacgaagcgatggatcttcttcctctggagtagctggctctctttcttcagggtcttcctcttcttcctcatcacttatgatgtcgatgacaggttcagcacgatcgggcacagcttcacccatcacgcgaatcttcgaagctaactggagacgaggtggcggacaggttctctttcttgcgacgaggcgaagcttgggtgttggcggcggcgtttctcctttgagttcagctaattccttctgtagacggtacaccttgctctccaacttgcaaatcttgcctcgattccagttttccctgtcatgagctgctttgtctcgctccacacttactgcatccatagcactaagcatatgcaccacatgcatcagagtggcactctcttcaccatcaggacagatataggttccatagtcttgaccatgaggcttgtgaggatgatactggaaagctgatgaatccaactcttcttcaaaacgttgacgcaactctccaatggccaccaaagctgcttcttgacaagcatggcagtacgatcttcctccagcttcgaacttaatagacggaaggtcttctctatcactagccaacgtcacacgaacacgacacttctcctcgtcggggtcatgggaaatctggcgatactcaggagcaacttcataacctacctcaaaagccatcaacctcagctccctgacgaatcctaacacctcgatcaaatttctcggtgaatggggcggcatctaaagaaacatggaagagaagaattaatgcatattttttctaagttagctgcaccaactagacttaactgatttttgaccaaaaaggaagaaaataaaagaaaagacacataaaaagctattttataaatatttttagaatttaactttttagatagagacaaatatattttttttgacaaataactaaaacaaaactaaaatacttatgatctattttaagcacggtacagtgtcaccacaagaaagatgagtagtactagtgctaccatgattatgtcgataccataatagatgtacagtgccgactaatcaataagaaaaaagaaatattttgagaagaacaactttttgctattaaaagaaaagaagttgaattaaataaattttgtgcataaccttgcatgtgttgccaacttaattaatttataagagaatagagaagagcagttctattttcaaaatattttgaaggctacttaaggtttaccatttggcttatcctaaggtcaaggtggctctgataccaacttgtcacgccctgaatttctatccaaaattccaaacgcttacatgtgtgttaaaccctcgtccaggaatcaaccgaggcacacaatgacaatattgataatagagtacaattaaataactatttaacaatcgcaaataataaattattacagaggtagatagttcctctcaaaaaaaataacattctacgcagcggaaaaattaaactaaaacaatctacggaacagctatggcaactccactccacagacaacttaaccaggacaagcctaatcctccagaccatcaccttcactcaagtactcctcttctgatgaatgaatattgcaagaatgagcatatgacatactcaacaagccacacagcaaatatgcaagtgcacaggataacaaaggatggcataatacagttcatttgcagaaaacagcatttaataaatatttaagagaatagtaaaacagttgtataattaaccaatattaaataaacaccatacaacacacccgtgttgcataggcccaaccacatttgaacaaccaaccccagttgaacaaattaaacctcgaaaccaggaattatccattccaaactaggcatcaaattaattaccacattattaccattaatgggtagtgtgagactaatcacgaaaaatattgctcaactcacccataaccgcgggtacggctattcgaatagattaaactctgatcagaggtgtaccactgtacccacaagacacaaccccacatcatgtcaccatgtgcctcagtaccaccacggtacctcggaaaggagtcgtgacaatacccctcgcacaacataacccattacagtgctcctttcctggatcataatcaccccctttaaaacaaggcatggactccccagcgacccccatggacttctcgccacttctcagtcgggcgcactataatgaatcacgctatagaaaagataaagccgttgcccacgctggcttgtggttggcacgataaatgtttcacaacagtagctcgcgaaccggtccttaattgtcatgagcacaaccatcaaaaccatatgctcacaacccaccttatccaggttttaattatcaattaattaacatcacacgatttaccatcgtgagctaccattgaatataaccctaattaataataacaattatgtaatataatttatatttaactccttttgttagctaatgtttctaagcatggctaagcaaacttacatatagcatttagccgaaccaatccaatatataaggttcatgctaatcaaattataacccataggaaaataaagtcatcttcggccattaattaattgggaaaggttcaccacccgatgacattcgaaaacaatgcatagttgaaataaaataatagctttaaacatgatcaacatgctcaaagggtcgtttgggatctgtgtgacttgccttgggcttccacaaacgcgtcggaaacttcctcaacggaaacactctcctccggaacgtcgaaaactaaagcaaataaacaaaatcaacaaaacagtacaaaaacaagcataaacagtacatgtgaatatttttaacatgtagatcttgattttagaaaaatttagaaacttgaaccacctgaaacggatctacggttatttagttatgattttccgaagttttaatctattagaaaatcgggaaaaagaaaaagaaaaggagatgatgacgtcatgctgacgtcatgctgacgtcggcaatggcggccggctagggtttgcgagctcgccggagctagggcggtcggccgggtgattggagggcacctacgcgtagaggacatcgagacgaacccgatggtactcaccccgacttcaaacgacgaacgatggcggccggcgacgaggaggatggcggcggcggctcggcttgacggcgacgaggggactccggtggtcggcggcgaaggggaacgggcggccgagattcctctcaccacggcgcacctaacggcggcgacggcaagcggcggcgacggcggagacggcgcgacgacgacgccgaagacggccggcggcggcggcgagcttggcgcgcttggcggcggcgctacggggcacaggagagctcgggagagggggcaaacggaagaggacgacgaggggaagctttatataagctcggattgaagagatcgaactccaaacgagaggaatcggctcggaaaagattaaaactcggttttagggataaaatcaaaacgaactcgattcggatcaaatcctcaacgattctctttgattcttggggaaaaagaaagaggagaacgagaggaacaaaacccctcaaaaacccgaaggaatcggagtcggattgaggcgaatttggaggtggaaggcggcggctcgggctcggtcggcggctggaggtaggagatggatccgacaggtgggccccacctgtcggaatccacgagagaggggagcgggcggcgtcggcttgggccggcatgggccggttcggccgcgcgagagagagaggatgttgggccgaaaacggcccaacggcttagggaggggtttttaaacttttttgaataaaacaatttgtgaaatgttgtttcaattattaaaaatacttcccttgctcaaataattcccagaaaattctagaaaatagaggagcaagcatagtatttaataaaattttatctaactcatttttatattgaaaattttcctagaaaattagggtttagcttgtaggcttttaaaataatttctaaaaatgatttaaaatatgcatttttaatttaatcgatttttagggcgtgacaaacctaccccccttaaacggaatctcgtcctcgagattcagaagaactggcgaacagatgaggatgagctgacttcaattcatcttctcgctcccaagtggcttcttcttctgaatgattactccactgaaccttgcagaaccgtataacgcgattcctggtattcctctcgcttacttccaaaattctgactggcttctcaacataagttaaatcttcttgaagctctatacgatcaggatctgcttcctctgtaggtacacgtaaacatttcttcagctgagacacatggaacacgtcgtgtattcccgccattgacggaggcaactctaactgataagctacttcacctcttcgactcacaatcttaaaaggtcccacaaaacgcggtgccaatttccctttggtttggaaacgatgaacacctcgtaacggcgtaacccgcaggtatacataatctccttcttcgaaagccaaatctctgcgacgattgtcggcataactcttctgacgcgactgagcaacgcgcaacctctcttggataatctttactttttcttctgcctgtcgcaatatgtctgtcccaaaaacttgacgttcaccggtttgatcccaaaggagcggcgtacggcactttcgaccatttaatgcatcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtttgagggtgataagcagtactgaaattcaaacgagtacccaattctaattgtaatttctgccaaaacttcgaagtaaactggctacctctatctgacactatcttcttaggaacaccatgcaaacataccactctggccatgtataactctgcaagcttatgtcccgtataggttgttttaaccggtataaagtgagcgactttagtcaatctatcaaccactacccaaatagaatcatgtcctgccgacgttctgggtagaccggttataaaatccattcctatttcttcccacttccactctggaatcttcaacggttgtaacagaccggctggtttctgatgttctgccttgacccgctgacatacatcacatagagccacatattctgctatctcacgtcgcatactggcccaccagaattgttgctttaagtcttggtacatcttagtgcttccagggtgaacggaatacaaagtttcatgagcttccttcatgatagtattcttcaactccttattttctgggacgcaaattgtttctcctaaccacacagttccctgctcatcttctacaaaaccgatggctttacctcttctcatgttctttttaatttcttgtatatcaggatcattcacttgagcttctctcacttgatcaaacagagtaggtttagcttctaaagcagccacaaaacctttactgattattcccaagttcaacttttcaaattcttggcataactcccaaggtaaacgtcgaccttctgacatattacagtaacttttcctgctaagggcatcggctacaacatttgctttccccgggtgataatggatttccatatcataatctttaattaactctaaccatcttcgctgacgcatgttcaaatcaggttgagtaaaaatgtacttcaaacttttatgatccgtatatacctcagtacggttaccgaaaagataatgacgccaaatcttcaatgcatgcaccacagctgccaattctaggtcatgcgttgggtagttattctcatgaggacgtaattgcctagatgcataggcaaccacctttccttcttgcatcaacacacaacccaaaccgtgtcgggatgcatcacaatacacttggaaacctttcctcgaatcaggcaaaattaacacaggcgcagtcactagccttttcttcagttcctggaaacttcgttcacaatcctccgtccacttgtacttcacttccttctgaagtagacgagtcattggtctagcgatctttgaaaagttctcaataaacctgcggtaataccatgcaagtccaaggaaactacgaatttctgtaaccgtcttgggttgcttccaacttaatactgactccacattgcttggatctactgccactcctccagacgagatgacatgaccaagaaacttcacttcggacaaccaaaattcacatttactgaacttggcataaagctgatgctcacgtagtttctctaaagctagacgaagatgctcttcatgttcttccttcgtcttggagtaaataagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtcttcggtatatcttcctcacggattcgaagttgatgatatccagaacggagatctatcttggagaaaactgtagcaccttccagttgatcaaacaggtcatcaattctgggtagaggatatttattcttgatagtaacctcattcaacgctcgataatccacgcacattctctgagtatgatctttcttctccacaaagataactggtgctccccatggcgaagtactgggtctgatgtatcctttctgaagcaaatcatccacctgtttcttcacctcagctaactcattagctgccattctgtatggtctcttatggattgggttggttccaggtaccaagtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacaaaacagttaagtaattacacaatattaagccaacgctatacaacataccctgttgtataggcccaaccattctgaacaaccaccccggctgcacagttctatcttcaaaccaggaatgtaccattccaaaccaggagctaatcaaattattatcagtttaagcatcttttacaatgatgagaggtgtgagactaatcacgaaagacatttgtagaccccgccataaccgcgggcacggctattcgaatagtttactctgatcagaggtgtaccactgtacccacaagacacaaccccacatcatgtcaccatgtgcct

SEQ ID NO: 15992 - DNA, 8175 bp, Oryza sativa
  unsure (1)..(8175): unsure at all n locations
ggcctctgcagcttatttctggtccaacaccctcaatgcctttatgttcaatcaagggccgatgaccccctgttaacaaccaaatttggtaatatcggcatcgggaaagaagattagatcgaagtgaagtcgaaggcggagatcgaatccgaaaacagagtaggaatcggctggagtccagatcggctatgattaggatcggctgggtctgagttggactaggtaagccgatgcagccgattccgacaatacgacttgatgtatgacattgggttgaattgaggtggttcaagatgattgccgcgcatggatagagtcttgagaaggcaattgtatctattaattaggatattttatgtaatttccttagagatatgcttgggcaaaagtctgccgcaaagacttatggtatcttagagtttgttagagataatagtcgtgtctggtatggacatgtcttgtaattctggggtataaatagacctgagccctatgtaattttaaacacacacacgttcaatacaatttcggcgcatcgccaccttttgctttagttttatttcgacgagttcttgctttcgggttgagctgcgttggtttcgatcttcaacaaaaggtaaaacttgttatgatggattgtgttctagggataagtgcttccatctttacgatactctaatcttgtctatgtaattcgtcaagttatcatatatcttacataatcttcgacaatatcgtcatctaacctacaatcggctagcatctgtcgacagaaggcagccgattaggttaaatagcggcgttgacgtagattatataagatatctaccactttatgaaacatccagcggcttgattgtctatatattgttcttcttttcatacttaatgctgcatcagttgagtttgatctattaagtcgtgcttagagtttcaatctctagcctgctttctggttgctgattagggtagtatcagagtttcatccgatcttatctgatttaaccatattcgctctatatgcttcattgatatgttaaatccaccctttacgtcaagatcttactgcatttaagtatattaggcttttgtttgatatattatacttgttttgatatcttgatatagagtagtatcggagtattagccgatacatgctagatctatctgatcggctatgctataaacatatataatgctgttattaatatatatttcgatctaagtgatttatactgtctcggcatggcaaccgatctatcccagtcacttgatttaagtatatatcgatataagaactatatattgttaatatctacagccgatcgaatatatttagttctttattgtctatttacaaccgccgatcgattcacatatgacatcggctcaaagataaatgatatgtcattggcacctagccgatcggctatcatttatagatttaaccgcggtctatttgtctctatttcttgttgattacagaatcaaatcaactggcacgcttatacatccaaaggcgaggtttggacctgcactggagttaagcagatctcccaggcctcgtgttttctgtcaacacccccactctgcttgacgtcatcatgattactggtttagatgtcacctcttcaaccaatcccatgaccctgaactccaagaaccagtttgagtttaaaacaaaaaccataggtggctggtctggctatgtcgctgcaaacatgggcaaaggatctgtcaccccccaagagcacacaacctttctgctaatgtggcttgagaaattcctgttctgtggatcgagttgtggccctaccaccaactggcagttcttagccgaaagccttgaagcaaagaaacaaatctgtttaggcaaaatcctcctcggctatctgtatcagatgttgaacaacgcatcgactaaaatagccacaagctcgatagtagctgcaagtggaccatggtggttactgcaaacatggcttaacttagtcgtcatgaaagctgtgaatcagccagccctatcagagtcctagtttccaagtctaaagccgatcgccaatgaagatgggggagaactaactcatcgcagatgcatgtcctatggagaagttgcatcaacaccagccaattctggagcaaagctatcagctgaactgctcaaggactggttctctagcttctacgatggcttcaagaaagatgctcgagtctagttcgcatatgaggatacagtagactttgagctaccatcggacttccggtttgaagaaatcaactctgagaagtacgataagtctagagaagtcttttcagctgctatcagcccgtgtattcttcctattggcattcatcaaggaagaaatatacaagtatcctatgagttctatcacccaatgagctcggccaggcagtttgggatgggacaggtcccaatcggcttgtacttcactgataagatccaatgcagaggagaaatctcatcaacactgatgatggatcggctgctcaacatcccaggacctcctttgggcagcattgaaaatatagagctagcaaggttcaagagcaggaactttgacagatggtggggtgaatggaagcaacacttgttccaacaatcggcttccatgtacatgacagatctattcccggatgtcatccctcaggtatatcttgactaatctcttcttctattttgcagacaacagaatcctgtcctcctcgcaaaagcaatagtggcaaggatatagaatatgctccaggccttatcccaaatggaggtggactagctccccctgtcattggctaccatgccccaggacctcaagtttactccaagggcagctgggagaatcggccgatgttggcaaaaagaggaaaactaaggcatcagctattgattcatcaactctagcaccaaagaaaaaggccaaaaagaagaaatccaagcaaaccaatgatttgcctgccatagacccgtccatagaacaagccttggatgaagaggaaatcgaggaagatgttgaccaagcggcaaccgaactgagtgacttaggagaaaaaacaccatcggctttacccaaacagactcctccaactcctgcttctccagcccacttttcaatggtaaataactcatcttgatcacctttttgaaaaaattgtagagccgattatttgtaagtcttgtatttgcagaaaaagaaaactactgtgaagaagaaattgacactagcaccatctaaacaggttccatcggtaaggtttcttctgtaaaatcttttaaatttgctcgtagccgatgataattaacacttgtctcttttagcgtcctcctccttcacctcctgtacagctgatgtcaagtgaccgtagtccatcggctatagacagccacaacattgaggaagaagaagaaccagcagctcctgccatcctagtaagtctcattctaaaaattcccagatcggctgtataacatattttgatattcaattatctcaatttccacttttgcaggtattagctgatatgttctcctttgatatcaaggattatcttgatcaagaggcaaaagatgaaacaacangcaagaccctagcttctctagacgaagatgtcaaaagaactcttgaagatatatctcatcggctagaggcatctttaaacaatttgtgggtgattgtggtccattcgggcaagacttcgagaaattcacgctctgatcccggatgatctttcgaacaccatcactccagctgcatacctcgagccacatcaattcaagctagaaaaaactaaccaaagattacccgaatggcgagagcggaaggacatcgaagccacaatccaagccatcggcnaactcgtgcatgaagagaagtccaagcttgataaattatctgaaggtccgatccagtccaacatagatcggcttgaggcccgaaagattgatctcatggcacaacttgaagaatgcaatgctaaattggccttggaaacacagaagctagccaatctcccaaaagcaatcgaagagaaaaaatcatgacttaaatcggccatcaaaaatgttgctgatttaaccaagtctgtgaaggttatcccaggaaccgatgcccaagacatccaagaagtagaggaaattagacaatgacctatatcggctatcctgcaatacctctctaaatgattggctttgtaataagacttagcttgaaactcatttttgtaatcggctatttgtagtctaactcttaatccatctgccgattaatataattttcgcgttgaaaatccactttttttttcatatatctgcccccctaattttgcaatgacgaaggcattgataaaattataacttgtactaagggcgatatagcaaatatcggccatcatacatcggcaaaacaccatcgattataataatacagaaaaacaactaagggcgatataaccatatcggccgtcatacatcggcaagacacaaccgattatgataacaaaactaagggcgatataactatatcggccatctgaaggcgatctaaatacatcggctaacatgcatcggcaacacttagccgatcatgcaatgacccagacacttgggtaatatttcttcaagtacttgtcattaagtgctcgtccataaacttctccatcaaacccttgcaacatacaagctcctttggacacaaccttatggatttgaaacggtccttcccaatttggtgaccacttgtcacgccatgaaaatcgcctagtttaataattcattctttaaatcatttttagaaattattttagaagcttacaagttaaactctaataatctaggaaaaatttcaacataaaattgagctagataaaattttattaaatactttgcttgtttatctattttctagatttttttggaaattatttgagcaagggaagtatttttaataaatgaaacatcatttcacgaattattttaattgaaaaagtctttaaaattccctaggccgttgggccgtttccggcccaactcctcttttcctcgcgcgcggccgtgcggcccaagccggcccaagccgagccgccaccgcccccctccttttagccgccgacatgtggggcccacatgtcggggttgtcttcaacctccagccggcctgccgagcccaagccgccgccgttccccgccaaatccgccccaaccggccatctctgagtccgattggttgaggggtttttatccctttgttgtcctctatcctttccccaagaattggagctaattgcttcgtattttatccgaatcaaactcgatttcgagtttatctttccacctaaccctaggattttccggcttcgattcctctcgtttggagtccgatttctctaatccaagcctataaatagcatcccctagtcatcctcttctgtttgcccgaagtcctagccgtcgccgttgcccatagcaccgccgccgcgttgaactagtcgccgccgccgccgatgccgttccagccgcgccgcgccgccgctgtagccgtcgccgccgcttcccattcgccgccgtcgggtgcgtgcgaagaaggagtaccccggcaaccccttcgccgccgtcgcaagccgccagagcgccgtcgccaccgtcgagccgagccgcgccgtcctcggtcctcgtcgccggccgttgttcgtcgtcgtccgtcgttgttctttgcaccggtgagttcgcgtcgtcgtcctctacgcgtaggtgtccttggatagcccggccgagccctctaccaccggtggtcgcgtcatcccgcaccatggccggcgatgatgtcgtaatgacgtcataaatcttttatttaattcgtaataattttctgtatttgatgaaaatctgattaaacttcagaaattcataactaaatcatcgtaactcggattcgagtggttcaagttgctaaattcatctaaaatcgagatctacatgttaaaaatatccacatgttctgtttatgcttgtttttgtactgttttgttgattttgttcatttgctttagtttctgacgttctggaggagagcgttttcgttgaggaaggttcagaagcgtttgaagaagctcaaggcaagtcacatggatcccaaacaaccttttgagcatgttgaacctgtttaaagctaatgttttattttaacttatgcattattttcgaatgtcatcgggtggtgaacctttcccaattaattaatggtcgaagatgactttattttcctatgggttataatttgattagctagaaccttatatattggtttggttcagctaaatgctatatgtataattgcttagccatgcttagaaatattagctcatcaatgggatgaatcatattacattattatttatgtttatatatttaatggtagctcacgatggttaatcatgttatgataattaattgataattaaaaccttattaaaggtgggttgtgagcatatggttttgatggtcgtgctcatgacaattaaggaccagttcgcgagctactgttgtgaaacattaaccgtgacaaccacaagccagcatgggtaacagctttaccttttgtatagaatagttcattacggggtgccagactgagaagcggcgagaagtccgtgggggtcgctggggagtccatgcctctggttattgagggggtgattatgatccaggaacggtgcgctgtggtggattgtgttgtgtaaggggtactgtcacagttcctatccgagatatcatggtggtattgaggcgcatggtgacatgttgtggagctatgtcttgtgggtatagtggtacacctctggccagagtaaaactattcgaatagccgtgcccgcggttatgggtgagtttaacaatgtttttcgtcattagtctcacactactcattattggtgatagtttgtgataactaaattgactcctggtttggaatggtatattcctggtatggaggtttgatttgtacaaccggggttggttgttcaggtgaggttgggcctatgcaacacgggtgtgttgtatagtgttcatttaatattgcttaattactcaactgttttactgttctctcaaatgtttattaaatgttgtttatgcaattgagctgtattatgccatgctttgttatcctgtgcacttgcatatttgttgtgtggcttattgagtatgtcatatgctcattcttgcaatattcattcattagaggaggagtactttagtgaaggtgatgatcaggagggttaggctttgttcgggtcaagttgcttgtggagtggagtcgccatagctgtttagtcttatgtttatttccgctgcgtagaattttattcttttgagaggaactatccacctctataataatttattattttgcgaatattaattagctgtttgatagtattctattatcaatttgttattgtgtgcctcggctgattcctggatgaggatttaacgcacatgtaagcgtttggaattttggatagaaattccgggcgtgacaccacatgccgaatttgttatctgagttcctatcggcaaaattagcttccaaacaagctctccctcagaaaaagacttaggcaccaccttcttgttataatgttgagcaaccctttccttatccttggtagcttttgcaagagctctcaatctggattgaaccaaatcttccttctcatcggccatgagattataatattcattagctgacaactcattctgcaaatctgttcccatggtaaaactgcctcaaatcaatccgtggcaagccatccgataagaccacaatgcttcagccaacctagtatgccattgccgaggataatcagaaatctttctcttaatcaacttgatcaaactcttgttagacgcctcggcttgtccattggcttgtgcataatacgacgcagaattcaacattttgatacccatgctatcggcaaactgaacaaactcattagacacaaagatagacccttgatcggttgtaattgtttgaggaatcccaaatcggtaaataatatactcttgaacgagttgtatagcatcccccaaatcattagcttcaacattttgctcccgagatacatgctttaaagttaccagccgaaatccatccatcaact

SEQ ID NO: 15993 - DNA, 6888 bp, Oryza sativa
acttaatatcttaagccctgaagcagcatcaaccaatttatcggcaaccggcattgggtacttgtcctttggggtagccttgtttagatcccgaaaatcagtgcacactctgaccttgccatttttcttgataactggaactatattagaaacccactcagcatatcggcatggacggataaaaccagcatcatataaacgtgtaaccttagccttgacagcatcgagcatatcggctttgcatctcctcggcaactgctggtatggtctaacccccggtttaataggaagccgatgttcaacaatcgatcggctgagtcctggcatctcataatactcccaagcgaagcaatctttatattcctttaaaagctctatcagcttggctctgaattctggagataagttattgctgatgaatgtcggcctgggtctatcacctggacctatatcaatttcttccaaatcatcagctgacatgaaaccctgtccttgcttgtcatcgagatcatctactgtatccttggtgtagacgtttgaacccaccacgatgccctcaaaataataatttgggctctccatcttcaattgtgtcacgcccggaatttctatccaaaattccaaacgcttacatgtgtgtaaaccctcgtccaggaatcagctgaggcacacagtaacaaattgataatagagtgcaattattactctaattaataatcgaatataaagtcattacagaggtagatagttcctctcaaacaataaagatctaagcagcggaaaataagataaacgcacagacgactccattccacaagcagcttgaccaggactacgcctaatcctccacaccttcagcaacactatagaactccacctctgatgaatgtttgcaaggtgagtatatgacatactcaacaagccacgcagcaaatatgcaaatgcaagcgataacaaaggatggcataatatagtgtcatttgcataaatggcatttaataaatacttcagaatttaataaagcagtaaagtatttaattaagcaatattaatccatcgctatacaacatacctattgcataggcccaaccattctgaacaaccattcccggctgcacagttctatctccaaaccaggaatataccattccaaaccaggagctaaacaagttattaccaattacagcatcatttattacggtgagaggtatgagactaatcacaaaagacattgttagacccgcccataaccgcgggcacggctattcgaatagttttactctggtgagaggtgtaccactgtacccacaagacacaacctcaacatcatgtcaaccatgcatcgtgatacttaacaagtacccgaatagagatggtgacaataccctatgcataacacaattcaaagcagtgcaccgttcctggatcataatcacccccttataaacaaggcatggactccccagcgacccccgtgggcttatctccgccacttcatagtctggtgctctaaaatgaaccatactatacaaaaagtaaagccgttgcccatgctggctaatggttggcacggttaatgtttcacaaccgaaaatcgtgaaccggtccttaattgtcatgagcacgacagcaaaacgatgtgctcacaacccaccattatcagtttcagttgacaaattaattaatgaaccaatcacaattaaccatcgtgagctatcattaagccatcattaaatcatagtgaatcataagttatcccatttatatgagctagtgtctctaagcaaggctaagcatcctaagcactttagctaaaaccatataatgttctagctaatccaattattaaccaagtgacaaaggatagataatcaataaccaaaaaggctataacaaaggcaataggtcattcccacccaatgacattcaaaaatatatgcaatagttaaatagaaacaatagctttaaacaggatcaacatgctcaaagggttgtttgggatctatgtgacttgccttgctggcattggaactcttcaaagtcttctcctgcaaaatcagactctccgggaaggtcggaatctaagcagaaaagagcaaaatcaccaaaaaacggacggcctacgaaacggacggccgagatctaatctaatccaaaacggatggccgagatctaatcggtctaccgtgggtctacgggtaacgcaatgctgacgtcggcgatgacgtcatcaccaacggcggcttggcaactcacgctcgccggcgtacgacggcggtgctcctgcggtcttcggcggaaacggagggctggacgaggacgacgacgacttggcgatcccgacggtggccttcctgagcgacaacaatgaccagagcggcggcggtgcacggctggtctcccttcggcggcggcggcgcacgacttgacgcggaatcggcactacaagcggtggcgagctaaagcgagggtggcggcggatagaggaggtcccgggggtccttttataggggctagggggcggcgacggaggcccacggcggccggcgaaggcgaaggaaagcttagggttcgggaggaaaaacgaatccgaatcgagctcgaatcctacgatttccaaacgaaattagatgaagattccaaaacagaaaaggaagaggggatcccggggatcattacccctctactgattcgattggatcgggaaaagagtggtcgaatttggaaggaggcggcggcggcttgcgcgcggctagggcacggctgcggcgggaggaggaagacgaccctgacaggtgggccccacctgtcagagggagagaggagggagagcggcggctcggctcggcgggctgacttgggccgggcgcgcttgcaggccaaggagagagagagaggggttttgggccgactttcggcccaaagccaaaagaggacttttaaaacctttttcattttaaattattcatgaaatgcaattccatttattaaaaatacttccttggctcaaataaatcccagaaaaatctaggaactatagaatcaaatgaagtatttaataaaattttatctagcccacttttatattggattttattatttaaaattagatcttctctttctaagcttttaaaatcatttctaataattccatttaaacaacaatttataaatttaggattttcagggtgtgacaaacctaccgtcttaaacagaatctcgtcctcgagattcggaagagctggcgaaaagatgcgaatgagctgactttaattcttcttctcgttcccaggtagcttcttcttccgagtgattactccattggaccttacagaaacggataactcgattcctggttcttctctcatctgtctccaggatacggattggtttctcaacatatgtcaaatcctcttggatttcaatctgctcaagattagcttcttcagtgtgtacccttaaacactttttcaactatgacacatggaacacattatgaacacctgccaagcattgaggtaactccaactgataagcaacctcacctcttctactgacaatcttataaggtcccacaaaacgcggtgccaattttcctttggtgtgaaaacgatgaaccccccaaagaggcatgacacgaaggtacacatgatctccttcctcaaaacttaaatccctgcggcgattgtcggcataactcttatgacgagactgagctatacgcaacctctcttgagtgatctttaccttctcttctacttccctcagaatatcagtcccgaaaacctgacgttctcgcgtttgatcccacaacagcggagtgcggcacttccgaccatacagtgcttcataaggagccatttgaagactagcttgataactgttgttgtatgagaattccgcgtaaggcagattcttatcccaacttccaccgaagtctaaagcacaagctctcaacatgtcttccaaaatctgatttaccctttcaatttgtccgtctgtctgcggatgataagcggtactgaagttcagcttggaacccatctcttcctgaagcttcttccaaaactttgaagtaaactggctacctcgatcggatactattttcttaggcactccgtgcaaacacacaattcttgccatatacaattccgccaaacgacttccggaatatgttgtcctcacagggatgaaatgagccactttggtaagtttgtcgactatcacccaaatagagtcatggcctgatgacgttctgggtagaccagtgatgaaatccatccaaatttcctcccacttccattctggtatcattaagggctgcagcaaacctgtgggtttctgatgttctgccttgactcgctaacaaacatcacacacagctacatactctgctatctcacgctttatacttgcccaccaaaatttctccttgagatcttggtacatcttggtactaccagggtgaatggagtataaagtgtcatgagcttccttcaagattgcatttttcaactccttgttctctgggacacaaattctctcacccaaccatacggttccttgctcatcttccaaatacccgatagcctttccccttctcatgttcttcttaatctcttgaatatcaggatcattgatttgagcttctctaacctggtcaatgagagtgggcttcgcttctaaagctgcaacaaaacctctactgacaattcccaaattcaatctttcaaattccttgcataattcccacggcaaccgccgtccttccgtagcattgcaatagcctttcctgctgagagcatctgctacaacattagcctttcccgggtgataatgaattcccatgtcataatccttaatcagttccaaccatctccgctgtctcatgttcagatccggctgagtaaagatatactttaaacccttgtgattcgtgtacacctccgtacgagtaccaaagaggtagtgacgccaaatcttcaacgcatgaaccactgcggctaactcaaggtcatgactagggtagttcttctcatgcggatgtaactgacgagatgcatacgcaaccaccttcccatcttgcatcagaacacaacctaacccaagcttagatgcgtcgtagtacacatggaaacccttctttggatcaggcaaaatcaaaatgggtgttgatattaagcgacttttcaactcttgaaaactctgctcacattcttctgaccacttgtacttcacatctttctaaagcagttgtgtcatgggcttagcaatcttggaaaaattctctatgaacctccggtaatagcctgcaagacccaggaaactatgaatctcggagactgtcttcggttgtttctagttggttactcattccacattactcggatcaacggcaactcctccggctgagatgacgtgtccaaggaactttacttcagacaaccaaaattcacatttgctaaacttggcatacagttgatgttctcgtagcttctctagtgcaaggcgaaggtgttcttcatgctcttctttggttcgggagtagataagaatgtcatcaataaaaaccaccacgaacttgtccaggtattccataaacaccttattcatcaagttcatgaagaaagcgggggcattggtaagtccaaaagacataacagtacattcaaacaacccatcttgagtggtaaaatccgtcttaggtatatcttcctctttaatcctcaactgccctgatcgaagatcgatcttggagaaaacggtggctcctttaagctgaacaaacaaatcatcaattctaggcagtgggtatttattcttgatagtcacatcatttagtgcacgataatccatacacatcctctcagtatgatctttcttttccacaaaaatgactggagctccccatggagacgaacttggtctaatgtattgtcacgcccggaatttctatccaaaattccaaacgcttgcatgtgtgtaaaccatcgtccaggaatcagccaaggcacacaataacaaattgataatagagtacaattattactctaattaataagcgaacataaagtcattacagaggtagataattcctctcaaacaataaagttctaagtagtgcaaaataagataaacggcgcaggtgactccattccacaagcagcttgactagggctacgcctaatcctccacaccttcggcatcactgtagaactcctcctctgatgaatgattgcaaggtgagtatatgacatactcaacaagccacgcagcaaatatgcaagtgcaagggataacaaaggatggcataatatagtctcatttgcataaatggcatttaataaatatttcagaatttaataaaacagaaaagtatttaattaagcaatattaatccatctctatacaacatacccgttgcataggcccaaccattctgaacaaccaatcccggctgcacagttctatctccaaaccaggaatataccattccaagccaggagttaaacaaattattatcaagtacaacatcatttattatggtgagaggtgtgaaactaatcacgaaaaacattgttacacccgcccataaccgtgggcacggctattcgaatagttttactctggccagaggtataccactgtacccacaagacacaacctcaacatcatgtcaaccatgcgtcgcgatacttaacaagtacccgaatagagatggtcacaataccctctgcataacacaattcaaagcagtgcaccgttcctagatcataatcacccccttataaacaaggcatggactccccagcgacccccgtgggcttatctccgccacttcatagtctggtgctctacaatgaaccatattatacaaaaagtaaagcc

SEQ ID NO: 15994 - DNA, 29197 bp, Oryza sativa
acataaccaatcatgaccagtacatgtggatatttttaacatgtagatctcaattttagaaaaatttagagacttgaaccaactaaatccgagcttagatgaattagttatgaatttttaaagattaaatcggattaaatcatttatatagattttaattgaattatgacgcaataaagaattatttttgaaaaggaaaaaggatttattgcttcagcggctcgggtttacggtggaccgggtgcacaggaatggtctacggaatggacggctgagatctaatcctatccaaaacggatggccgagatcaacttgatctaccgcggtctacggctgacgtcgacgatgacatcggcgatgacgtcaccaccgggggcggctcggccacgcacgctcgccggcgaacgatggcgcggcggcgcaaacggagggcacctacgggtagcgggcgacgcggcgaactcaccgcaagcacggacggcggcggacggcaaccagacggcgacggcgacgaggttgaagtgacggcggcgttcggttcgacgacgacggcggtgctccggtgatcttcgacggaaacagaggggtggacgaggacggtgacgacttggcgaacctgacggtggccttcccgagcgacgacgacgacctaagcgacggtatgatccttttgcttcaatgccctgaactcacgcttcttcaaagcaacaactcctacaggtatgtgtgtcttcttgaatgcctcagtgaactccgcccaagtgattggttgtccttctgctctgttcacccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttagtagtactagaaaaggtaggtggcctcacacgaagaaaatcagctagcttgttctgcggcggtggagcattgttgtttccttggttgagctggttctgcatctgctgtatcatcatgttcattaattgagtctgttgagccagaacttgagcaagagttgggttatcttcattgttattatttccacttccactggtgcgagtgttcaccatctgttgcatattagagaagatagaaggagaggggttacactaaagacaagaccttaaccaggttaacactgatctgatgtgtgtagaccattatattgttcaggttgattaagcaagcaacctagtacagttacacactcatcaatgaactactccaatgatgggaatgcaaccatacctacacacaaagcaaacaaacgttctaccctactaactattcttcaaagacactttggcggcataggtttctaaggtaggatccaaacttcattccatcttgaccacttggcacttcggtccttcctcgatccacttgactgacctccataagtagacctcattggcgtcttcaagtttcaacaactagtttcagaactactcaagttgaaagcaggaggggagaggatgataaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcatgaaatcctcgtccaggaatcagccgaggtacacaaattgacaatttaatatacagattcatcaaattaactaaaacgataaatacttacttaagaggcactaagtcctcaccaagaagaaaactgcagcggaaaataaaatctagcgaagctccggctacactcccacaggcagctcaactggggtataagccaaacgtcttctccttctggatcctttttcttcaactgaggttgattgattattgcaaggtgagcatatgacatactcagcaagccacacaacaaatatgcaagtgcacaaggataccaaaggatggcataatataggctcatttgcaaaagcagcatttagcaaaacatttaagaggaataaaatagtggagtagttaatcagaaattttaatcaacactgaacagcacacccatgctgcacaggcccaaccatcctgaacaaccatacccggctgtacagatcaaatctccaaaccaggagctaagcaaattattaccagtataacatcattaattattgtgagaggtgtgagactaatcacgaaaaacattgctcaactcgcccataaccgcgggcacgactattcgaatagttttactctggccagaggtgtaccactgtatccacaagacacagcctcaacatcatgtctaccatgcgtcgcgatactggaaagtacccgaatagaagctgtgacaataccctctgcacaacacaactcacgacagtgcaccattcctggatcataatcacccccttataaaacaaggcatggactccccagcgacccctgtgggcttatctccgccacttctcagtctggtgctccgcaatgaatcatgctatacaaaaggtaaagctgttgcccacgctggcttgtggttggcacgattaatgtttcacaatagtagctcgcgaaccggtccttaattgtcatgagcacgactctcaaaaccatgtactcacaacccaccattatcaagttttagttggcaagtaattaattaaccaatcacgattgaccatcgtgaactatcattaagccatcataataatgagtcataagttatcccaatagtgtgctaatgtttctaagcatggctaagcaatcatatctaatatctagctgaactaatatatatagctcaactagttaagttataatatcccaaggtatcaaggaatagagtaatcaatgcaaacaggccataacaaaggaatagattcacaccacccaatgacattcgaaaataaatacacagttgaaataaatagagaatttaaatataggatcaacatgctcaaaggattgtgtttaggatctgtgtgacttgccttgcaataatcggtcttcaattaatcttcttgaatacttccggcgcactcgcgaacctttgcaatgacggaaacgacaagctaacacgcaaaacgaagaaaaagactaataaaaaccaaataaacaatacatataaagtaaacaaacatgtagattataattttagatgaattatgagacttgaacggcctcattctgacttcaaatgaatttattatgaattttacaagattaaatctatttaaagcccatttaaaaagaattaaataaatttaattcaatttatggaaaattttaatatgtagatctttattttacacaatttttgcaacttgaaccacattaaactgagttcaaatgaattagttatgaatttttaaagattaaatcggattaaaacacttatatggattttaattgaattatgacgcaataatgaattatttttgaaaaggaaaaagggtttattgcgtcagcgctagggtttgcggtggaccgggcgcacggcaacggtccacgggaacggacggccgagatcaaccctatccaaaacggacggccgagatcgatcctatccaaaacggatggccgagatcgaacggtccacgacgggtctacggcagacggccacgatgacgtcagcgacaacgtcagcgatgacgtcagcaccggcggcgactcgggcggctcgggcgcgcatgctcgccggcgaacgacggcgcggcgacgcgaacggagggcaccaacgggtagagggcgacgcggcgaactcaccggtgaccaaagaagcggcggaggaacaacggacagcgccggcgacaaggaagaagcggcggcggagatcgggtcgacggtggtgacggtgctccggcggtcttcggcagcggcgaaggggcggacgaggacggcgacgcgacggcgaccacgatggtgacctccccgagcgacgacgacgactggagtgacggcggcacacggctggagcggcggcgacaacggcggcacgaggcggcacggcgctagggcgctacaagcgacgagaggcgaaggcgagggtggcggcggttagaggagagctcgggggtccttttaaaggggctagcgagcggcggcggaggcccacggcgaccggcggcgagaaggaaagattaaggttagaggagagagatcgatccgaatcaaactcgaatccacggatttccaaaccgaattagctcatgattccataagagaaaagatagaggagatctcaaggatcatttgccctcaatcaatttcacccgatcgggaaagacgcggccgaatttggaagaagacggcggcacggctcggctagggttcggcggcgcgcggcggcgcgagaaaacgaacctgacaggtgggacccacctgtcagcggccgagagagaggaggaaggggcgcggcggactaggccgactgggccggggagggagagagaaagagagaggttttgggccgactttcggcccaaagccaaaaggaggatttaaaaacatttttctatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttagacttttaaaatcatttctaataattccttttaaacaacaatttataatttaaggatttttaaacaagaaaaactcttaacaattataattagatcattatttatcaaataattactgaactgttctttgtatcatttaggaattgagctccgaaagatccgagaatatttcagagagtgtaattaaccatggagaatttaataaaaaaattaaatccattcatgctttatatttaggaaattttatttcccacatttaacttcacttgtaaattaaagatcatttaatataaattctattattagtttattaaataatttataaatcctgaaacaaaaatcaggatgtgacagaggcccacggcggccggcggcgagaaggaaagattagggttagagggagaaaattgaatccgaatcgagctcgaatccgacgatttccaaacgaaattagcgagagattccaaaagacaaaaggaagaggggatcccggggatcatttcccctctattaatttgatcggatcgggaaaggggcgggcgaatttggaaggggcggcggcggctagggctcggctgcggcggcgcgaggaggaagacgactctgacaggtgggccccacctgtccgcaggagggagagggggagagcggcggctcggctcggcgggctggatgggcctggcgctagcaggccggggtgagagagaggggttttgggccgactttcggcccaaagccaaaagaggatttttaaaacctttttcaatttaaattattcgtgaaatgcaattctatttattaaaaatacttccttggctcaaataaatcctagaaaaatctaggaactatagaatcaaatgaagtatttaataaaattttatctagcccactttcatattggaatttattatttaaaattagatcttttcttctaggcttttaaaatcatttctaataattccaattaaacaacaatttataaatttggggtttttagggtgtgacatgtatcctttctgaagcaaatcatctacttgcctcttgacctctgctagttcattggctgccattctataaggtctcttatggatcggagtttttcttggtaccagatctattctgaattctatatctctcttgggcggcataccaggtaaatcatccgggaacacatccgggtagtcctgtactatgggaatctcttccaaacttacttggttcagacttgaccttaaaggctcagaaggcaatgcgtaaacagttacaacttgaccgtcattgctggtgagagttacttttctattggcacagtctatcacacctttatatcgggctaaccagtccatccctaggatgacatcaaggtctttggattctaatagaataaggttggccagaaatggtactccttgaatctctattctgacggaggggctacgttgtgacgagagtgcttggttgctgggggtactaaccatcaacggacgtctaagatcttctacctccatcccgtgatttctcgcaaaactcatagacaaaaatgaatgtgtagcaccagaatcgaaaagcactgttgcaggaactgagttaacaaggaacgtacccaaaatcacatctggagcaccttgggcttctgcagcagcaacatgattgacacgagccttggacactggtgcggtggagttgttctgtgcagggacaaccttcacgcgccggggcttcggacacttgtcagaataatgacctggttccccacagttgaagcacactcttggcttgtttcccggctccctcttggcaggctgatgctgggctagagttgcaacaggacgtggagcttggttgcggttgttgttgccagaattgttgttgaagaactgacgctgtggacgggcaaccaacgaagatcctccctgtgacactgcctgaggtcccatagcaagacacggcctctgactattcccctgctgagctttgaagtgagcaatcctgcgtttcttctgctccattcggttgtacttgtcctcctggcgaatggccatatccaccaacttctggaaatcatgataatccccagtcattaatgggtaagagagctcatcattcagtccttccaagaacttctcttgacgctcttcatctgtacgtacatcttctggagcatagcgagctagacgattaaattcatgcaagtattcagtgacagagcgagatccctgagtgagcgtcctgaactccttcttcttgggagacaccactcccgacggtatgtgagttttccgcaaagcagcagtgaactcaagccaagtgattggttccgcagtggtcctgttgagacggaagtgatcccaccactcagaggcagggccatgaagctgatgtgaagcgaaggagactttttcttgattagtgcactgaagcaggtccaatttcttttctatggcgtgcagccaatcactagcctcaactggattggtagtgctagaaaaagtgggcggcctcacacgaagaaattctgctaacttgttctggggaggtgcatggttgttcccctggttctgctggttctggaattgctgcatcatcatgttcatgagctgtgcctgttggaccaggacttgggcaagcgtgggattctctccattgttgttgttgttgttgttgttgttgtttgggccattcccattgctgtgagtaagcaccatttggcataggcaggagcacaagaagagaaacaaggaggaaaaaactacttaggacagggaattgatttttattaacttgacttttattgatcttaactgagtttcattattacacaaaactgaagactctcacacaacttaacttaaactccctaacactcgaaagcaaacaaacgcatgcatttacatcccaacaatgatgtaaaccacatgcaagacccacacacgcaaccaaacttaaacaagcaaactaacacaatgatctagggcaacgacttaacaaggcgttctagatcttccgggcatcggaattgattgaaggctcgttcggcttgcccccatcatcttgagtagctccccactcgacctttgaatgggtgcgcttcgattcttctccatcatcatcacttacgttaacgaccgaaggattcgctgagactgggacaacttcttcttcttccaccacacgaaccttaggcgccaactggtagcgagggacaaatagagctctcttccttgtggtaagacgaaccctggccttttgtggtggtgcttctcccttcaacgcggctagttccttctccaaacgatcaactttgtcctcaagcttacatatcttaccacgattccggtcttcacgatcttgagcagctaacacaatctcagcgcggaactcatccatggcccacagcatctcaaccaaatgccttgtggtagcatcattctcaattcctgcaggttcaaggtagctgccacggtcacttccctggggttggcgaggatggtagcgatactcagtgtcggccaactgatcactgtagcaatcgcgaagctctcctatggcgatccttgccacctcctgacaagcatgaatgtagtttccccctccagcctcgaacatcagcgatgggatgtcttcatgattagtgttcaaggtgaccttgacacggcacttctcttcatcacggtcatgaggaatctgggcatacaaaggggcagtcccaaatcctatggcgaaggacatcgtacgcaactcctggacaaatccctcagtaccgaacaagtactcaggcttgaagcgcggcatctaaagacaagtgaaaggagggagttaagacatttatccaattaatagcacaagtttttggattaatttgaataaagttagaaaatcaaagtaaaaggtaaataaataaagtaaaccaatcttgcaagataagttgaaacagttgaaaacagaatcacaaattttgcacttttgaataacaggtttcaaaagaaataaaataaaagagagttataaaatcaacatgctaaattatattgcaacatgattgaataaataaataaataaatgaaaggttgtaaaatctctgctagaaagtgggccattagtatagtaatagatgtacagtactaacaacacaggaataataaataaattttgaatgagaacaattaaagggactataaactgcatgtgccattagcttggtttaattaaaagagaaagagaggagaacagttctactttttcaatctttttagagggcttctataggtatccatttggcataacctagggtcaatgtggctctgataccaacttatgacgcccggaatttctatccaaaattccaaacgcttacatgtgtgtaaaccctcgtccaggaatcagccgaggcacacaataacaaattgataatagagtgcaataattactctaataaataagcgaatagaaagtcattacagaggtagatagttcctctcaaacaataaaattaggaaaataagataaacggcgcaggcgactccattccacaagcagcttgaccagggctacgcctaatcctccacaccttcagcatcactgtagaactcctatgatgaatgattgcaaggtgagtatatgacatactcaacaagccacgcagcaaatatgcaaatgcaaggcataacaaaggatggtataatatagtctcatttgcataaatggcatttaataaatacttcagaatttaataaaacagtaaagtatttaattaaacaatattaatccatcgctatacaacatacccgttgcataggcccaaccatcctgaacaaccattcccggctgcacagttctatctccaaaccaggaatataccattccaaaccaggagctaaacaagttattaccaattacaacatcatttattacggtgagaggtatgaaactaatcacgaaaaacattgttacacccgcccataaccgtgggcacggctattcgaatagttttactctggccagaggtataccactgtacccacaagacacaacctcaacatcatgtcaaccatgcgtcgcgatacttaacaagtacccgaatagagattgtcataataccctctgcataacacaattcaaagcagtgctccgttcctggatcataatcacccccttataaacaaggcatggactccccagcgacccctgtgggcttatctccgccacttcacagtctggtgctctacagtgaaccatactatacaaaaagtaaagccgttgcccatgctggcttgtggttggcacggttaatgtttcacaaccgaaaatcgtgaaccggtccttaattgtcatgagcatgaccatcaaaaccatgtgctcacaacccaccattgtcaggttttagttggcaaattgattaattaaccaatcacgatcaaccatcgtgagctatcattaagccatcattaaataatagtgaatcataagataccccatttatacgagctagtgtctctaagcatggctaagcattctagcactttagctaaaaccatataatattctagctaatccaattattaaccaagtgacaaagaataggtaatcaataatcaaaaggctataacaaaggcaataggttatttccactcaatgacattcaaaaataaatgcaatagttgaatagaaacaatagctttaaacgggatcaacatgctcaaagggtcgtttgggatctgtgtgacttgccttgctggccctggaattcttcaaaatcttcccctccaaaatcggactctccgggaacgtcggaacctaagcataaaagatcaaaatcaccataacagcacataaacaatcatgaacagtacatgtggatatttttaacatgtagatctcacttttagaaaaatttagagacttgaaccaactaaatccgagcttagatgaattagttatgaatttttaaagattaaatcggattaaatcatttatatagattttaattgaattatgacgcaataaagaattatttttgaaaaggaaaaaggagttattgcgtcagcggctcaggtttatggtggaccgggtgcacgaagacggtctacggaatggacgtccgagatctaacctaatccaaaacggacggccgagattgaatcggtctaccgcgggtctacggatgacgcggcgctgatgccagcggtgacatcatcaccggcggcgactcggcacctcatgctcgccggggaacgatggcgcggcggcgcaaacggagggcactaatgggtagcgggcgacgcggcgaactcaccgagggcttggacgacggtggacggcaacggacggcgacggcggcgaggttgaaacggcggagacgttcgggtcgacgacgacggcggtgctccggcggtcttcggcgaaaacggagggcgggacgaggacggcggtgacttggcgatcccgacggtgaccttcccgagcgacgacaatgaccggagcggcggcagcgcatggctggactccctccggcggcggcggcgaatggcttgacgcggaggttgcgctacaagcggcggcgagctaaagcgagggtggcggcggatagaggaggtcccgggggtccttatataggggctaggggcggcgatggaggcccacggcggccggcgacggcgatggaaagtttagggttcgggaagaaaaacgaatccgaatcgagctcgaatccggcgattaccaaatgaaattagatgaagtttctataggggaaaagatagaggagatcaaggggatcatttcccctctaccaatttgaccggatcgagaaaggggcgacgaaatttggaagggggcgacggcggcttgcacggctagggcgcagctgcggcggcgcgaggaagacgacaaccctgacaggtgggccccacctgtcaacgggagagtggagagcgagcggcagctcggctcggcgggcggactggaccgaggcgcgcttgggccggggagagagagagaggggttttgggccgactttcggcccaaagctataagagggattttaaaacctttttctatttaaattattcatgaaatgcaattccatttgttaaaaatacttccttggctcaaataaatcccagaaaaatctaggaactatagaatcaagagaagtatttaataaaattttatctagcccacttttatattggaatttgttatttaaaattagatcttttcttctaggcttttaaaatcatttctaataattccatttaaacaatagtttataaatttaggatttttagggtgtgacattttcgaaccgtaccgatgccgagttgatgagatggcaccaggagggtaggaaaaatgacggtaagattcaacaccctgccgatgctcgacagtggaaaaactttgatgcactacacccggaatttgcaaagaacccgagaaacgtaaggtttgcctggagcacaaacggaaagaacccgttcagtgacctaagcagcacatagagtcatgtcggaccatcaggcttcattccattccatttcatctcacatcagggcacaacgagatacatatcaagggggacagagaggctaccaagcttaacaacgaacacccaacaggggctcacacacctagcctttctcacagagatggtggaggcgcaagtggatcgaccggaagtggggggcttcctgcgaatccttcccaacctgtgggattggatcataccggacttaacgcttgcctgtgcgactagggcggaggtgttcctgcgattcatcttctggtagcgggcttccagatccatgtactgctctcgaagctcgtccagctcctcgagtgcctgctcgtaggcatcctcgatgctgcgggccagctcggagaggagggtgcaccgactttcttgggctggtccggtgaagcggaggtggtatcggttgtcgtcctcggagcggaatgggtacaagctcaaaacattgactatacctagggggacggagagcttgcagaatcgatacagggtgtcacgggacacatcgtaggatggcggcgtccaggatgatccgagggtgacgagtctggaaagagatcatgatcatctctttctcttcctctctggggaaggggaggaagagcttcaccttccagtacttctgggatccccggacgatttgctcgccacgatagattggcccagaaaagaaaccgaggtgctggagcagctgacccagctgccaggcatacccaattgtacacacctaagggagtacctgaggtggttgctgaggtggttctggagggggcgcagccatggttactgcgaggtctaccatggagctagggtttttctggctagcttagttcaaaggagaggggaggggaggactggtgcactttctcagggtcgcttggggctcctgttataggcaccaaccactggggctcctgtgataaggtcagtagctccagtgcttatcctgtggtatggtcggtcccatttactggtaatggatagtgctctgctgtagatctcgtcagtcagagttcctgtagatcctgtcgatcagggttcctgttgcgttcccacgagtgccgtcagcacacagtggttccaggtcttccggggtccttgaacggtcagacactgtgctggtccttattccttacggtcgaagcttcatgttggtcccatgcttctgttgcctcaggttgctaagcatacgaatggcttcttcgcggtcagctaatcataattaggcctggttggatcttggtgcagctggttctgagtgcccacttgttagtggttgtcctttatcttaagcagcaccagatttagaaaattggggaaagaatccaccgggaggaaagataaggatttgagtttgaaaaggggatgagaaactaacccacaaagattgcccaaaaggtggcagctacatagcaaggaaaacaatacacaaataatggatcgctgccccttattgcgagaactcgcactagtgagcggcttaatacaacgtctacaacacacatctaacgtttttagtcagttcagtcagtggttaggatagctctagcataccttctatctcttcaaccttaatccttatggtctgtataggagtattcgaatactggggataagtcgagatttatcaaaagaaatttttcaataatacttgagaagggagagtagtaagaatctaaggttttatcaaaataggttttgaaaatatgtggtttatgtgtaataggctacgcttagctgatcctaggtcttaagggtggtcgcaagggtccttaggtcctgcagtcgtctagctctgataccaagcttgtgggccctcgattttatgcaccggaaaccccatatgttttacaataccattccctggaccagtaaatggtacacacatggcacagttgtatatcaaaagctgacatcattatacaggttaaactatacattaataatacaaggataacccaaatgggacccaaatagaccgagcatggtcatatacattacaaaataccaaaagaagtagatgagataacggaagcgaagcagcggcggtccaacgtactccataggcatcgactggtgaacctaggtcccgactccaccgtcttcaatatctcttcatcaacattgttcccgtatggtcgactccaactcctttctaaaagatttagttaagcaagggtgagtaccaacctactcagcaagccactactacaggatgcatttagtgcacacaggggttcaaggatggcttggtatatttacataaagctagttttcacaattcatttcacaaacctatgacctagcaattttaagtgaaaaacaacattaagttgatgttgtcattaatccgtgagggttcatccaccttccccaagcctcgattggtccggtccaccttcctgtccaacgagcaaagtcacacttcattctcaatctaagcaagattaaaatctatgaggctaatcaagagtagtacaagtcccggcactcattaaccgcgagcacggctattcgaatagatttgatttactcacactgcaatggatgtacgcttttaatcctgcactccgcgacttgcctaacgaatgagcctagtcccaacaaatgagacgtgtcacggcccagtttttcagtaaaccctcgcattatggcacccactccaaggactatgaactcccattgcaccccgacgcccaaccctacctcgagtcggaaggtgaggggagtcctggcgctcccgatatcacaagaagttacattacatgtaggttaggtgtgttttaagttttgccagcataaccaaaccaatccaccacactgcaacaacattacatcatcacaagtgcagaaccaccatgataggggtgctgccccacgaggatttcttagtccaccggttctatacccactcgagaagtgtggtcgtactctgatcatctcctgcatagcttcttgaattggtccttaactgaccagggcctgcgccgagtcgtttccagaaccacccatattccattcgtgccgccccagtcgaaaacatttgttttattaggtttttggttttcgcaaagctttttgtgctgcggcctgcgagtggcgctcatgtctccacccgccttctttggcaatcactctcgacaagtgaccacccccaacacattcatatccaactagtatggagtgtacaatcgtctataaataagcagtactaagcaatatcaatatttgaccacgtataacaaatagactcgggcaacaaagatatatataaaggtaacaatatcaaggaaattagcatgcaactttatttataaacaaagcatttgtaacatgggttcaacatgccttgcttttagaaatcgatatcttcgagaaatccacatctgttgaatatccgcaatatccgatacgcagttaatacgcaaaatcctccaaataaggtaccaaacatttcaaaccagaagtgccgttggatatatctcgattttaaaagaattccggaagttgaacggagtcaatcggagtcacggtttgcaagatatgaatttccgaaggttatacggattaataatccgaggaaaaggtttcctttcaatgaatattcttcgtgaggccgctctgtcagtgggattaaagaagaattagggagatgtttcaaacttacagagaggaactcgggttgtaaggggatgtagtatgaacttgtagtggataaagaggccgcaagtgggctcggcaggggatgtaatagggagatgaaatagacttttcggcagcgtcaaggtcccgaggagtcacaacacagtaggccccaccggtgggtcccacagctttttcttttcttctttttattttcttctctctcttatccttccttcctcttgtcggtatcttctcttgctctctccccctcgtttctttctctgcttctcgcttcttgtgcgcgacaaattggacattacgccactgtaaagagtgggtttcatcagtatcgttaaaatgccactcccaatgaatgccaaacatttggttttgccatattcaccattttataaagttttcatcattttccacacatggtctgaccaaaatacccttcggtcggttaaagaagacgagttgggctggcattggagaagcagctcaccagtcttcgggcgcatccacgccgagccgacgacacgacaccgcgtgtggagcggcggctcagcgcgctgctctccaagggcccgaacacgacggtggagctgttcccgatggtggcactccgcgctgccaccggctgcttctggccgagcaacgcatcggctccggtagcttcggcgcggtgtaccgtggttcccaccccgctggcggggaggagggaggaggatgggttggacgcgacatagaaggggctgcccgagcttgactttgacgggagcgactcggcgttggcgggtacggcatcggctgccgcggtccgtattggtatttcttaactacattactaaaaatagtcattccagcaatggcgccagaaatagtcctggtatatttatagttacagaaataatccgcaagcgcacggatataccattgtagcattttttatcccaagctatcgtattttttatcccaaggaaagataataagagtgaactttactaatgcagtttatacatatattacttataattgtcagagcctaaacagggtttaagtataatataagggtagagtgacacgaagcaaagctatccaatcctcataacgaataattctactaagtggaagaagaaatagaaagcactcaattcctatacttctagtatacacttaaatcctaacttacatctgttaatgtacaattatgtggccgataccccctaacagtgtcctcctgatactttgagagactaccttgggttgccgaatttcttaagacaacctgtcatggtagtccaaccggggctaaatacggatgagtactctccccaggaaattgtcttagaaatatatactaacaaggaggaatacccgtactgagctgtcaccatcagcggcccacctctactgtcctgtagcatatatacctaattaattatgcttaataatctaagcaccatacttacattattaaatactactctatacccgcatgctagacatagagtaactgataaattagacattaaacccgcaccattacacctctctggtaggctacccacacaattaacacaatacagatataaaataagactagtacttaaacaaagtaggcaaaatttgctacaggacgtccgaaaaatatgtaattagctagaggacattgtaagaacgtgtatttgctgtaaggcatcataacaaaactggtaattaactgctggacaccggcgggattattttattatttttagagggataggagagagaaacaatcattaaagaccagtttgcccttggctcaaattaatccaatgtgggccccactatgagtatgtccttctcgtgtcgccatcgtaggtgaagtggtgaaccccacgtcggcgccatcgagcgtgcagctcgctagcctccgcgagaagtaggcatcgaaacggccgcaaccgcacaccctgagtggcacagcggctgcggtggcgttgacagcgcactcctcaacagcatcgctgggtgatgccctccatgccgtctgcccacggcctgctgatctgccggatgctgtgccagtggatggcgactttctccgtcagcagcgagttcttgatgttgatgacgatactgtccctctagacgacgctgatggtgcggctcggcgtgtggccgttgatggtgacggccagcttgcggacgcagtccggggacgtgaactggtaggtgatgtcccagtcgtggcgccgcggctgacgtgacgccgcacagcgccgcagcggcgaggaagaggctgcagaggaggcggcggctacaccgcgtcatgtcccctcttgctcgcagtcgcagctgcattgtttggtttgctccggttgctagctgctctgtctgtgcgtcgttttgagttacacaggtggatttggagctcgccaagtagcgagcttaggtttttgatgtttcgagatgtttggagcctgctccggtaccgctgcgatggcattgatggaacacctcgtactcgagcgccccgagcatcaccggtagagcagcgccgcacggcagccggaccagctcacgcgcccggtgccgtcgttggcgaccagcgcaatggcgtcgacgtcgtcggcgcgcacgcgccggtgagcatcgcgggaaagaatgagagagggagaaaaggataatgaagaaaaaaagaaaaaaaatcaaagggtagaaacgtacttacacatgtgtttcactcttcaattcttccagatataataaaataatcacgcgggtgtccagcagctaattaccagttttttgtggtgccctacagcggaacacgttcttgcggtgtctcctagctaattacacttttttggatgtcctgtaacaaattttgccaactaagtaaagtaccgaagatatataaagaagagtattccattaatttggaaagtattacagaagagattacaagagccgctagagccataccgaaaactcttccgaagactccgatgacttccgaacactattctattctactccacttagtactatactactaatactaaagtatgaagaggactttagcttgcttgagtgtgttgagagagtgaatgaactcctccttttatagagctggtatgacggttgtagaaacacgaaatgtcgattttgccattacaaccatcgttgagaagcaatcctggacgtccacgtgtaaggccagcgggagccgcagctgccaaggttcggccgaacctgggctggcccagcaagcctccagctttggcaagtcgctggcaagtgggtcccttaggcggttgtggtagttaaaagtcggtttccggcggttgcttctgatatgtgggccctccttatccatatgcttgcttaggagtgaggtctcttaacttttatctttattttatttgataaattcctgcaacatattattctccaagtacaaacggaaatatattattttggaaataaacatgcattgtaagcatagctaattctccattattttagttatattgatggtcgaaatttgtcggtaacgaccgtcaacaaccccaacacccatgtgatcgttctccccctcttaccaagaacaatggggttttgtttattagagttagcaacttgatacttgcattcagcgcgcgtgttggctaaattgtctgtctgtttgtcttcggaaccccaccatattgtgatttcttcatagtgaaactttcatattcatttagtgtttgttctacttgttcttcgattgcttgcaggaagagtgacctcgttgcctggttgttgtgcaccacaagctcgcgacaacagacgttgtattggttgctaaggcgcagcgtcattagatggttgtagtcgggtcgtgaacgtcttcttcatccaagtgagttatccccgcctcccatagaaagatcgggacacaaaccctcgcgggttcacatcatcactgctagagtgcctcttccaccgccaatccgaaccaccgccactgttgtagcatctggctgctcactgtcagcaattggcatcacgctaggctgcagtgcttccacctttcgctaaaatgcgcctagcagtagcttggccacccatccacaacctcaaatcggggcccaaacctgctttctcacactccctagtgagttccgctgcaaactcaatctccagctagcgtttctcgctgcgccgcgactcctctctctcccttaactccttcaccttcccgaggttgcggccatccccgtccggaggagcaccgccgtcggccaccttcccttctcccctacccgtcgcgtgcgaacggtgagaatcctctcctcgtctactcccgcgccacctctctcaccgccgctgaccgctgccggccacctcatgtgccgtgtcatcgtcttcttccctcggtaagcacaccgtcacactccttcccaccttcaccgcttcccatgtgcgccgtcgtgccagttggtcgtcactagtgatcatagggctacgcgccgccgctacccagccagccaattgtcgagccccactcccacttgcaccggtcatccgattcaactcgggggaatttgggccatccatgtggcctcccggtgccacctcactatgcccgcccaaagtaatagctcaagtaggctcaaatatgtgctaaatgaatagcaaatgctcaaatcagataatgtaaagttgaaaaatcattcaaagtcagtaccatgttggtcctaggctagaaaatactatacgcgcaagcctagatacaaacggtaccacaagatagcacttgtaggagatgacaataacaagcacacgatagcggcgatgacagtgttagtgaccctatcaaatgtaaaattgacagcgatccacttgtaggagattattaggtagttgtgagggcaataaggttaaaaaagagacgacggagacattctcaaagaatataagcatttctaacaatgaatctggacatatctatatcaagattcatagctagaagttgttatattttggaacgaaggtagtaaacacaaccattacttcatttgaaacgaaaataatctatatagcacatacaagggaaacattacggattaacaattgtcaaccttcctaatataggagaacagctgtattttgttaatcatatgtgtcggacatatatcgcatcagttagtatggctgttgtcggcatttagctttcttttgaacccttgacactaatgaactagagatccaagacttgttcatctcagcaatttcaccagagcgccaacaacacagacgaccatcttcgccacctgtccatccaaaaatgcccctgttttgcccagtatgagtgtttgcggctggatatacggttctaacaacgtctgtatggcctccttcaaggatagcttccgcggaacctattgccccttcaagaccagctcttacagggaagtaacctattgtccctgcagttgtgccgccaatcacccataacttgtcgtcgggcagagagtagtgacaatcaacaaaatagtccacctacaaaatatagtaaacagaattagacgttgagaataaattgtctaggtaatttgcctccctggactgctatattgcattgccaaccacgctaattaaacaatgaagcatcatgggcagccacatcgtgtagtttcacattgtggcagcaatccctctgtttcgccacatcaaccaatctagagagcaggaaaagctgagttgacgtttagactaagtaggtggacagcaatggaggcgtagtgagcatagttgaaaaaaccggaccggtggatgacccggtgaacacctcggttcaccggtccagcggtcgaaccgacgggttggacggttgaaccgcggtttaataaggtcatctagtttatatgttttgaacttttgatacttgcacataagggcacgtggtgggatggtcagcgcagccggcttacaacctggtgaccaaaggtcgaatctcctccgtgagcgatttggcattttttcaaaaaaaacaaaaaatcgtcttggtaggctgaagaactaaatgggccttcgtgtggcccatttacactctcgcatgtcttagcccggttcaaccgatagcagtttattgtccgtttcacctcaaaaccagccggttcaagcggttcaaaccggttcgattacatggccggtctttctattgaaccgaaccgagctaacctctggtttcggttatttccggttcaaacgctaggccggtccggtttttcactatggtagtgaggtcccgtaaacgggaatgtaacacttgcaacaacagtgacaaggcatctagaggagatagtcagttcagtaagctgtgaaaaataaagatcaagcaaattttgggttcatatgagaaaatgacaagagggtgcaacataaaatgatgcatgaggatattggattggctccatgattggagagaataggtttctgtagccagcaagaatggtgactggaatggagagttccctatagtgtctccacagtggaactgtgcaaggagtaaagaaagacggtcacgcactctatataccctaaacaagtgcattggagattatgtcaatgtcctaagcaacaagtaaaaaagaatagagggagtatatctaaaatttggctagttctggagttagttgatgaagacgattacagatataaggtgctacaatatcattcatttcgtgaagttctgtaatctttttgtaccatgagccaaatgaagaaagcaatgaactaatgaggtgtgattgtttgaatatcataactctctaatattaatataaaaaaaactgtcaattaccaaataccacactacatgccaacaaatgctgagtagctagaatgtataaaggcaaatattagaaactcacatggtcaaggttccacctatcagttgccaaggaacgagcatcatctatattcagttctctactcccatcattccagtcccaggtactgtgagaattcaacagcaaaaatcacaattagacttttgtccttatttatttatttgaactttgaaatataagtcagatgacatggcattgccaaaccagagaaagcaaaccgaataaactaccttaatgtttcaatgtggctcaagcaccagatcttctggtatgtgttgccgaaaaatcccacttttgcaacagaagtctccacattcataacctagggaagatcagatatcagagaactatcacccaaaattgacatcttcatacaaataacctcatgcagaaccattaaaattaaaaaaaaaatacttcaaaagggagatattgtaataccacaattgaatagtactaacaaccaagaaaagaataggcaaaactagaactgcatccgtaacatacaagaattgtaagctctattgtatgaagattaacaaagaactatggagattaacagtagcattgttataagaagcggtgaggaataaaattgtaagctctatcatgtacttcacgaacaaataacagcatattacacacatggccagttattgaagttacaaaaaggggaaaaaacatcatgcgcatttggcatcgtcatatgaaacaacaaaggaacataacttgaagtactaatgggatacttcagtaaacaacaaacatcaaagtatcaaaccataacctgacatagcaggatatgtaagacaaggcatttgggcacaggaaacaactaaaacatacagatagcaaatgattgtcctcgttcatgtcaccatcagtgtcaaaaacacatattaatccatcaactgctgcagaaatgagtttgctatgctgatgtggtgcaaattttacctgtccaaaaaaggtgacaacataaaaatttataatcacccagaatacagaaatagtatgagaggaacagtagcaaatacaagatattttcacaataaaatgcattcaagtgattcagtaagcacattatcaaaatgtttagagtaagtgatgaaagtagttgtctcctgtgatataaaaatagttgtctccatgaagagtagaaaacatacaaaaccatccaagcatcactttgtaaaatataatggtgcatatttgatatctagtccatcaatctaaatgctgataatgcatggtacggagacagcagatcattagatcatgatttttatataaaagtactgtttgcttctaggaccatttcgattggatatccgcatgctcacatattttgatagtatacacatgtagtctccagcattaatgccttcaaatatgccagcaggatgactcagttctcacttgattaaggctgtgttcgggaggaggttcccagcacgcaaaacaaagcttgtattattacatgattaattaagtattaaccttttttttgaaaaatggattaatatgatttttttaaaataactttcatatagaaagtttttgcataaatcccaccgtttagcagtttgaaaagcgtgcgcgcggaaaacgagagatgtgtttggaaaatggggggaagaacacagcctaagtgtttttatataaaggtgatgttatggaagggttccttcacaactgttcattggagagccaatgatcgtctacacaagattccgttggcatacagtttcatcgacatgggtcaccaaagacttcagccgtagttactgccacagcttgaggttgagatgccttgccacaacagatgtagtgcacgaacagtatcatgtactgtagcagtgtagcaatacaattaaggtttaggatttaccttccataataaatctattgcctcaaccaatcacatctattgtgtcaatatggcttagttatttggtattatatctattactccctctcccaaaatacaacttctagcattcaaaatttatcccaaaatagaacaacttcacctacaattccttttcaacaaaacacaaccttccaccattcaatttttttccacctacttcctcttcttaatcaatcattctcccatttaataccacctactttctttaatacccgtgcccaagtctacaactccttgtattttgggacggaggtagtagttaggaatgttcagttagaaattagaaatatggtgtgttaaggtagagatactattcatggtactgttcacgtaagtgcctccagtactgcagcaaaagaacctcccatataagggacccatgtaacccatgtaagtaagcaataaagaatcataaagtaggtgtagcttgatcagggtctactggcaatgaggacaagcctagtaccgatgagagtgatctcacttctatcccagtctttagacccttaacccatccatgaattagtgtccataacagatgaacacattcagtgtctgctccaaaagatgaagtcacaaggtgtaatgctcagttgctcacagcattaagccatcaagtcgagtcaactcacaaaaggtcagtttgggtaattagtcagatgactagtcggtgactaggcagcagcatgcatattagcatgacatcaaaattgcacaaatgatctttctgcacataagatataactattgatgcagccaggtgtccaatacctcttagattgtgaatactctccattcaccaggaccagagccctccaaattccacaaatgcagctaccaaatgaagcagctatgaaacagaacagcaagtaaacaagctttaacattgatcctgcttggtccatgattcctattcctccaattaggttaaacattacattcctttaacaggtgaaactgattcatgtacctagcctgaggctgcatcattcaagtcaacactaaacaagagctatctattgcaaggcgtcttttagttgagatagttatgctctaaacatgagcggttcaactgccggttcacatggttcgaatgttgaaccggaagtgctatattgtatgcatattctccatttgtcactgcgaaagttagctggacagtggatgcgtagagctttcaaccagctgacctgtgttcgaacccccattctctacctttttcttgctattttcaataagtacatgaaccgtgggccttgtgatctttgcatgcacaaggcccttgactggcccatcaaggctcatcctctcttggcatgattaaccggccggctcggtttgccttggttcaccggttcacatgaaaaccatccggtttagacggtttgttccacttcacatgcaggggcggtctttatagcaaaccaagccatccagacctctggttctggttttttcggtttaaccccctggcctgtccggttttttgtactatggctctaataatgcaatgagtcagctactttacataaatacacaataacataaaaatgtatgaccaattttatttgcggactacttgcacccacatattttcttgaacagattgttccattaatgtagagaaggaacaaacagtcctgagtaacaaaaagaatgcaaagtaaaatatatgacgtagaacaatacatacttgagtcacatcatccatgtgagattcctctaagcatgctagctgtttagaatttctccaatcccacaatagaacctacaaccaacaaattagaatgagacaacaagaatcaaaacgagtgtaacatcataagattcttttttctagaagtcacgtcacaaacatatggaagtaaaccatcctggtatgttaatcagatgaattttgagattgagatagttcatagttggaactggttttggagataattggtaaatatagctacaggggctggaatagagaggctattggagatgctccccttcccttgcaatggctggagacaccgatctacagctacaattgcctttcatgcaagagacggtgcacacaagcatcagaatggctgagcaaacaatagtccactattcagaaattgtacatctagccatcattctcaattctcagttactttgatgtttcatcttgatctatttgaacaccagattgaagcattcaacaaattagtttcatcaatttattatggttttagccagtttttgccaaacaaacagacttccgggattagaatttgtggcttataatccgaacagtggatggtgcagttcattacttttgctctagtgttttcagttaagtgagaatgtaaacagtcctaatatctgtgaaagaataaaactcaactcaattacctgggaattagaaccggcagcaagtaggttaccacttgatccaccaaaggagaagctgaacaattcttgagaaccccttagcaaagatatctatgcaaaacatttgaaccagtgatggttgaatttagaaatatatataattacttaaaccaattataatactaatgaaaacagctaacaaactggtcgtacaattaagccaatcgcactgcttaataatgttaaatcagtcctagtaatgttatattgaaaagatatggccaacaaatagagtatgaaaagcagtagtagatgcaaaattgtctgtataatttagcataagcacaaaaacaatatcatgacaatttataaccatatacaccgaatattgatgttagttccatgaaaaggcaacatcaattgtgatccaattatcagcagaacagagacaaacttaattgcacaagattgagtagactattagaatttaccagatataaaagttgcattcgggaaggtctttatgtgtaacaaaaggccatgcatttacattttaccatgtaaaagataaactcaaaaagatgatttcatggaaatactactgagcaagaagtgcataagctagcacagtggttgtgctttgggccgtatctcgaagagatataccaaaaaactggaacttaaaagaatcaaatttgattgtcctcaactcaacatgtataattcatatctgaccaaccatccaccagcacccaaaatatgtagacaggtctaagttgacccattaatagaagatcctttaggagaatgtgtcggggggttgcagaccacaacatcatcactaactccttttaagtaacagaactaagtatgtgatttgtcagcacattaacataatgaatagtgtggacagtctactgtacccatctcaagtactgcagttctctcatttccctccaactatcaagcaggacaaatagcactgccaactatcaatagcaggcatatctctaagactatccaaaggtggtttagctgattaggtgctaaaaatgcagtccaatcagcaaaacatggtgattcccacatgccagcctcaaattcttcatcaccctcctattaccacaggtccctgctgttggctgcccctaaacaatgaactgccatagtttctgaatgtgaggatccccatcgcccacacacagtgccatttgtgtagtcattgacacacttgatgactcctggccacagtaaaggttggcctgcttctcatgctaggccgaagctaattatggggtcctccaatacggcggcagctggcctgaccaacaagagcagggtgatgtggcgtcaaaccaggtggaattggaccaggggggagtttgtttggtattgatagttaaggggtgtcagttattccatagttagaagttgaaaattaatcaaatacatcagctggcaagagtaaagtatacttattcccttaattatgcatttgataaccagattaggaaaacagacctgcttaaagcttcttgtatcccaagctcttatagttccatctgaagaacaagaacagattacttgtggggatgatggggctgaaaaggaaatttcatggattgatccgctgtgtccagtgcattcacccaaaaattgcccagttgctggagaatataattttagtgcatttgttgacaaggaaaccgcgagcgtagagttctcctgacttgttaccagatatatgaaataagatgcagagggcataagtcctaaagcatgcataatatcagcagtacataccacatacataaaaaagatgaaaagagaaaaggatgagtatggataaataatttgtgatgaaaagagaaaagtgttattacggataaataataatgataatagagtaaatttcacaaaactacatgtttcatggttcaagttgcagaaaaccacacacattctgacacttgtcacttaagtacatatattttggtagtttagtttcacaaaaccacactatcgatggatggattcacccgtgagatgacgtggttgtttcat

SEQ ID NO: 15995 - DNA, 17225 bp, Oryza sativa
cgatggctggtaataggatgccatatcctcgtcctaggtgaaacagccacatcatctcgcgggtgaatctatacatcgatagtgtagttttgtgaaactacacaaccaaaatatatatactcaagtgccaagtgtcaaagtgtgtgtggttttctgtaacttggaccacaaaacatgtagttttgtgaaatttactcatgataatataacagcaacaacaaagacaggaataatgtggtcttgaaatctgaatggtcctttttgcatgtcatggaattcgtaataacataaaagcatacacctaatagcacaccacagttattaacatcccaaaccaaagctaaagtggtcgacaagtatcatctgaagctagtgaaatccatttaaacgggtaaagaatttgcagtctgaaatgaaccagggtgggggaagggcgcctaccaagaagctatctggaagacgtagtcgtcgccgaagttggtctggatgctgttcttgaggcccaaacgtctcgaggagatgccgctgttagggcttggagacgaggagttggacgtcgcgggcgaggatgtccccatgcataggacggcctctgcctctatctccacctccatcgccatggccgccgccgtatcctctccgcctccctccatcgcgccgcgcaatcccttccttcgccgcctgcgggtggctcgatggaaatgtctcagcgagaagggtggatgcgccttctttccgggcgactggcggcgaaggaagtagggaacggccggcggaggggccgaccacgcgacgcgagcctcgactcgcgaggaaagccgagaagcgacagcagctggcggcgtgctgtacgcgtgcgggtgttggactggtaccctgctagggtttattgatgggcgtagtgggcttggtttgatctaatttctggggtgaaactgaataagttgggcccgtcccggtagaccattggcgtggtccgaaatgaaaaagttcacccaggtccctcatctaagggttgaggttgaattgcgtctaacgtatccctcattagtacaaacaagatcctaaaacggtctggatggtggtttcagctgatgtgactggtttgagttagttctcaaactatgtgagcatggcattggaagcaaaattaaaaaaataaaaacaaaacatatggggtcatatgtcagtcaaaaaaaatagattaaaaaaaaaaggagaaatgagggaaggacggcgagctccctatgccatgcctcatcgatggtcggtagcagaggcactagcaagaagaagggagaagggggatggaggagccgtctgcaacattttcacaccctgattttcgtttcagagatttataaattatttaataaattatttctagaatttgtactaagtacacattaatttacttaatttacaagtaaagtgtgtaaactaaaatttcccaaataaacatggttggacttaatttttattaaattctttgtgataaattacagtctgaaattttatcggatttttcagagctcaatttttaattttattaatacaaagatcattttaacatttatttaaatgaaaaataattaaaatccatcatttctctctggggcgaacccggcccacttctcctcatctttccggtcacatgtttccctcttgccggcccgcttccttccctcgtctcttctctttttcttttgggcctcctccctcgctcctcccactgacatgtgggcccagacccaacaagtcagggtcatcttcaagctcggacgggagtcctagctccaccacgatgccaccctaaagccgcagccttcctccacccaattcggtcgaatccttagagattttacaaaattgtttgaggggtttttgtcccctagatctcctcttttcgtttcaccaataagggcttgttcggttggggcgggaatggccaggaccacggcccaactctcatggatcatctcggcgtggaaaggataccgactacagaaaattacgtgttcgattaagcccagtcggtattttaacccaacccatctcggtgtttcccctgcgccccagccctgaaaaaaaacatctagtccggagtgtgtggaaaataccctcgaggggaggaggcaacataacgagaggaggcgctgctgcggagcgcagcacgcggcgtgactcggacacgacggcgacggcacggtctctcctccggtggccaccttctccccggtgagttcctccccttcccctctcccctcctctcctagggttagggattctgcgagcgcgctactactgtggtggtaacaacacacggtgatggcaggtgtggcggaggacaccggcgtatcacatcctcttgccatggcagtggaagctctgccacaacggcaagggaagacaggaggacacgatttcttgatttattattgatttcttccactatttcttgatttgttcttcttcatcgcaaattgcttataattgattatgcgatatcttgtttgccagtcaagtagcttgctcttggatttgtctgagaacataggaagatttttgtttgttccttgatagatatggaatttttcatgctgacatgattaagaccactctcaattgatgtatttcacactttaactccatgaagtcaaggtttagaagaaaataccaagtttgagcaaaaagctacataagcttctattttaaacacttttcttcaaaaatgcaaacacacacaaatgagatggttttggtgagaaatgactatgaatgaatattatgcactcatttgagctagtatgatgcgtttatgcaaccccaacaatgagaactcatctaagtgctagtagtggccatttatggtctagataatattttggataagattgggatctaaatttattttgatcggttggcctttcagagaaactttgaataccataaatgtttgaattagccaaccctatcttttccgttttgaaaccatttccaaattccttttagaattaattgtacaaaaaaattgaagttaaaagctaaaacaagatacttagagctacatttttagttgaaattcatttttttaaaaaaattagctcttctttgaaatataaaagtattgagagatatttgaaacacacattgagatcatttccaattagatttttataggaaagccatagttttcaaaattttcatttttggctaaaaggtttattttgaaattaccaactagcacttagccaacttgaacacatatatgagatgtgatatacatggatatgaatgagcattaaacagtcatacatcacaacctatcttgcttaagaatgcataaatgatgactttcacatatgcaagaaatgttaattcttaaatgctatgagaatgcaatgtaacctacacaaggttaaatacaagataattcattgtagatacatgttaccgagatgacattggttctttacgtgaattttgcaatggttggctccaaattccgaacttggtgagatccaccatttcttgcatgagtcatacctatattctcattatagcacatttttgtccccaacaacattgggtccataaaggtaagtcacacaagacttaggcacccaaatgaattttgtgctagcatgtggtgaactagtcaccctagtagcacaaatgtcattttttgccttcctaagcaaatcataatcaaatgaggagtttagtttagaaatgttactcagaggacaatttttaccaatatgtccctttgcacggtaattgtagcaaagtcgattcttgtctttacatggtgtcttcttcaccacatcttgcatcttacttgctaccttgctattaagcttcttctttgatgacacagagtcatccttcatgtgggggcatgatgcaacttcatgacccttctcattgtatccatagcacttcctattgcttcttcttgttctcctctttggaagtgtggcttggtcatcaatcttgttgaaacacatcaaggcatagtgtcccactttcttagacatgaagcaagtaatgggagttttgatccaactttgaatttgtcccttaatcttgttgttggacttattgttttcttgatagaacttggtgcaagctactgttgatcccctctcaagctttttcaccatgttcccacgggtatcttgagaaggttgagcattgcccacaagtccatgatccatgtgcttctctctttttcctacacaatccaagtcacatgtagtgctcggggaaatgtttgtgttggagcaacaagtgttagcacaagtaaaatcaacttgaacatgtggctcataagattttaccgttgcaattatcacctcatgagctatctctaccatggcatgagaatctacaaggttctcatgagacacacaaaagttcatcgtgtgtttcttgtaaatccatatactttttagtgatctcctcaaattgagatttgagctcttaattttccttctccaaagatgctacacaagcaatagaattagtggcacaagcaaattcatttttccaattttttatacctcataattaatgaagaattagatcccttgagtttcttgtgtttatcggctagacccttgatttcttcatttttcttaatgaggcatgcttgttgcttctcaataaccctcatgagtttgatcaccattgttgtgtccttcttgttcaagtgatcaaccacgaagtcatcatcatcacccataaagcacatatgatcttcagcaatggaagatgaacaaattgatgatgtggattcttcaattaaccattgatgttcattcacttattccttcaaaaggttagtttcacaaatactttaggaagtagagcatccatccatatcatcctcatgcacacatttagtgctaggtgatatgcatgagtcaacaacactatgaaatatagcaatttcattatcggtgttatttgagtccaatgggagagttggaagatcatcaaccttactcaccaatttattaccttgctcatagtgtatgttgatgagatggatgatgaggtgagatcttcttggtcggaggagataatcacttgggacttgtcatgatgaggtaatgaagtagagcaattcccaaatgatgcttccacaagagtatcctctccatcacatttagacttgtcatatctttcctttagtgttatccaaatgagatgagcatctacaagtggcatgatggttttgaacacatattcactcaaagcactaaacaaaacattaatagcttgagcattgagatgtgtgcatttctcttcctcttcaaatgatagctctttatcattaggaggagaaatactcacatctacaactcgctctatatgaggacccatggccctaaacacattaagcacatgaatactccaagatatgtaatttgaaccatctaggaaaagaggttctaggaacatttcacctcttatcgacatcttctctcggggtagtaaagcccaaaatgagagaccttgctctgataccaattgaaaggaccttgatgtcacctagagaggggtgaataggcgtcacgcccagaaatttagcccaaatttccaagctattttgtgtattaaatccatgtccaggacaagacagggtacacaaaacaacaagtgataaacagatccaaacgtaaataaagcaaaaatacttacagaagaggcacttagtcctcgcaccaaaatgaaagtagcagcagcggaaaaaggcgatcctagcgaggcttcagctccactctacaggcaaaactcaactagggtctaagccttggtcctctaacttcgtcttcaactcagaagcactacacttttgaaaagggggaacaatagcaaggctgagtacaaccaccatacttagcaagccacaccaatgatgcagacgtgcaatgggatacaaggatggcttgtggctatttgcataaaggcagttgtaaaacattttattgagcaaaacagtaaaactattgattaattaaagtaatattaaatttccactaatcaacactacaccacgttgaataggcccaaccaacctacctgaactacaatgcattgggtcgatttattgagtgtgagactaatcacggtgaatctggtcgatcacccataaccgcgggcacgactattcgaatagttttactctagccagaggtgcacaactgtacccacaagacacaatccatcggcatgtcaccgtgctcggctagacatgtcaccatgtcgagtgattgtgacaagacccttcatataaccccctctgaccacagaaccggaagcgcccttgtttcaaagagaggaggacgggttattcacatttaatttgatggttataggcgaattgagaccctcgggggaaaatagggatgtctcctacgttacccataatatgtagaagtatcgacgtaatttcatagagtcattcgatctgaatgctacatgaagaacataagccagatgacggaacgtggagacctaggatgtagaagatcataacatgaacgatttggcatatttggattcctttcctatatatccactcatgtggtacttcatcatacgattcatataagatccatctgtctagagatcgtcatatacatctagaaagccgtatgctttggaagaagcttgtacagtttgggaaggggtttttttgagagaaaagaataatctatttcaaccgatatgcccttaggcatggccatacataacataggaatcacaagtggaaggggtgggcaattagctagagcagcaggtgctgtagcgaaactgattgcaaaagaaggtaaatcggccactttaagattaccatctggggaggtccgtttggtatcccaaaactgcttagcaacagtcggataagtgggtaatgttggggtgaaccaaaaaagtttgggtagagccgggtctaagtgttggctaggtaaacgccccatagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgttgtaagtaaatacgtaactaggaatatggaaaattgcatttttggaatttgcaataatgggatgggcgaacgacgggaattaaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaaggagtaatcagctgtgacacgaaaaaaaaagaattcttttgtagctcatcatttattggcaaaaatagaaaaggtcaatatgaaggaggagaaagaaacaatagtaacatggtcccgggcatctagcattctacccgcaatggttggccatacaatcacgattcataatggaaaggaacatatacctatttacataacaaatcttatgataggtcgcaaattgggggaattcgtaccaactcggcatttcacgagttatgaaagtgcaagaaaggatactaaatctcgtcgttaactgaattcagaatagaaagattcaaaataaaaaatacccagcaagatattgggtatttctagctttcctttcttcaaaaattgctatatgttagcagaaaagccttatccattaagagatggaacttcaagagcagctaggtctagagggaagttgtgagtattacgttcgtgtattactcccataccaagattagcacgattgatgatatcagcccaagtattaataacgcgaccttggctatcaactacagattagttgaaattgaatccgtttagattgaaagccatagtactaatacctaaagcagtgaaccaaatccctactacaggccaagcagccaagaagaagtgtaaagaacgagagttgttaaaactagcatattggaagattaatcggccaaaataaccatgagcggccacaatattataagtctcttcctcttgaccaaatctgtaaccctcattagcaaattcgttttcagtggtttccctgatcaaactagaggttaccaaggaaccatgcatagcactgaatagggaaccgccaaatacaccagctacacctaacatgtgaaatggatgcataaggatgttatgctctgcctggaatacaatcataaagttgaaagtaccagatattcctaaaggcataccatcagagaaacttccttgaccaatagggtaaatcaagaaaacagcagtagcagctgcaacaggagttgaatataaaacagcaatccaaggacgcatacccagacggaaactcagttcccactcacgacccatataacaagctacaccaagtaagaagtgtagaacaattagctcataaggaccgccattgtataaccactcatcaacagatgcagcttcccaaattgggtaaaagtgcaatccgatcgcagcagaagtaggaataatggtaccagagataatattgtttccgtaaagtaaagaaccagaaacatgctcacgaataccatcaatatctactggaggggcagcgatgaaggcgataataaatacagaagttgcggtcaataaggtagggatcatcaaaacaccaaaccatccaatgtaaagacggttttcggtgctagttatccagttgcagaagcgaccccacaggcttgtgctttcgcgtctctctaaaattgcaatcatggtaagatcttggtttattcaaattgcaaggactcccaagcacacgtattaactagaaagataatagaaggcttgttatttaacagtataatatagactatataccaatgtcaaccaagccagccccgacagttgtatatccatacaacaaaatttaccaaaccaaaaaaatttgtaaatgaattgagtgaaaaatcaaaactcagattgctcctttctagtttccatatgggttgcccgagactcgaacccggaactagtcggatggagtagataattattccttgttacaatagagaaaaaacctctccccaaatcgtgcttgcatttttcattgcacacgactttccctatgtagaaataggctatttctattccgaagaggaagtctactaatttttttagtagtaagttgattcacttactatttattatagtacaaagaacatttcagaatagaaactgtgaaagttttaccttgatcatttatcaatcatttctagtttattagttttgtttaatgattaattaagaggattcaccagatcattgatacggagaatattcaaataccaaatacgctcactgtgcgatccacagaaagaaaagtaagttgttttggtgaacatcaaagaaaaaacttgctcttcttccgtaaaaaaatattctaaaaataacgaacccaaccattgcataaaagctcgtaccgtgcttttatgtttacgagctaaagttctagcgcatgaaagtcgaagtatatactttagtcgatacaaagtcttcttttttgaagatccactgtgataatgaaaaagatttctacatatccgaccaaactgatcaagaatatcccaatccgataaatcggtccaaattggtttactaataggatgccccgatctagtacaaaattgggcttttgctaaagatccaatgagaggagtaacagggactttggtatcgaattttttcatttgagtatctattagaaatgaattctccagcatttgattccttactaacaaagaatttattggtacacttgaaaagtaccccagaaaatcgaagcaagagtttgctaattggtttagatggatcctttgtggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatcttcctagaaaagatgattcattccagaaaggttccggaagaagttaatcgcaagcaagaagattgtttacgaagaaacaacaagaaaaattcatattctgatacataagagttatataagaaccgaaatagtcttttattttcttttttcaaaataaaatcggatttcattgaagtaataaaactattccaattcgagtagtagttgagaaagaatcgcaataaatacaaggatggaacatcttggatccggtattgaaggagttgaagcaagatatccaaatggataggatatggtatttctatatgtgctagataatgtaagtgtaaaaatttgtcttctaaaaaaggaaatattgaatgaatagatcgtaaattctgaaactttggtatttctttttcttccggacaagactgttctcgtagcgagaatgggatttctacaacgatcgcaaacccctcaaatagaatctgagaataaaactcagaataaaaaaaaattgttgtaatccaataatcgatcttgtttaggatgattaaccaaattaatccaaaaattctgctgatacattcgaatcattaaccgtttcacaagtagtgaactaaatttcttgttattagaaccaataatttcgacaagttcagaaccatttaatccataatcatgggcaaacacataaatgtactcctgaaagagtagtgggtagacgaaatattgtctaggaaatttaagtttttctgaataaccctcgaatttttccatttttatttctacttgaatcagagagagagaaatatttctcggtttatcaaatggtgatacatagtacaatatggtcagaacaaggtgttgcattttttaatacaaacccctggggaagaaaaggagtctaatccacggatctttttccgcttcttttctatccaatttgtttatgtttgttcttattacaaaagagaacaaatcctttagttttgcaggccaattgctcttttgactttgggatacagtctctttatcaatatactgcttcttttacacattcaatccataacatccttttcaatccaaaatcaagaataattaggatttctaaaaaaaaaagaaaaaataaaggtctactaataggaaaaccagcttttccctacatcaggcactaatctatttttaacatctaattagatcagggagttcttccaattaagaagttaagctcgttgctttttgttttaccagaattggagccaggctctatccatttattcattagacccagaaaatcagaatttttttattccattccaaaattccaaaataagaaattgattttattatgacatgctattttttccattcattacccttgaggatcagtcgcggtcttatagactctaccaagagtctggacgaattttttgcttcatccaagtgtaaaagatcatagtcgcacttaaaagccgagtactctaccattgagttagcaacctagataaactaggatcttagatacgatcgaaatccaaaaatcaatggaattacaccgcacacccctgtcaaaatcttaaaatagcaagacattaaaagaaagattttatcaccattgaaaacactcagaacaccacacctcaggtttcacccctactttccacgggcagcgggcaattccctctcgtgcctaggtgaatctaaaagccgcataggccgtcgtagggcctatccgaactccatcacgctcacccttgcctggatgcgtcaaccagaggaaagctatacttcaagttaggcagttacccattcccgcttgtggcaagcgctgtatgtcttccagtgtatcccacgaaccggaccttaattgccatgggtgcgaccagcaaaaccatgcacccacagcccaccattcagtcgcattttaattggataattatgaccaaagaaacatggtcggatgtcccaagcacgcagctcgtcatgatattaaaaggtctaatactacaattatcccatcaactgtgctagtggtaattaagcatggctaagcaaatggttctagctaggtcaacataagtaacacaatctaggcgatttattcacccaaggttgacaaagaacatatatcaaataatacggcacaagcaagcaagtaggtaaaccctgatcccatgtaattagcaaaacatgcatatgtatttgcaaacgataaaacatttataaattgagatcaacatgctcaaggggaatgtgtgacttgccttgcttcttcacaacaaccttctgatctcttttccttgcgcctgcgatctttcaaaacgatggaaactacacgctggcacgcaaaacgaggaaaaactttagtaaaaaccaagcaaacagtacataaaaaagtaaacaaacctgtagatctcaattttagatgaattttacaagttgaatggctcaatttggagttcatatgaattagatatgaatgttagaagttttgagccatcaaataaatttctataattattaactgaatttattgcgcaatttaaagtcatttatgacgtcaccgaggggagaggggtagcaatgacaagcaggccccacctatcggtggctaaaaggggtgggcgcactgtggaccgagtccacgcacgcgtgtccgtgggcacaccacgtggcagccacgcggtggccacggtggaccgacgtgggagttggcaaggacgtggcgccgaggtggcaccagcgtgggacagcaccacgacagccacgttgacggcctcgggtgaatccaacggtgcttggcggctgccgggctcggcacggcttcaagccggccagccggcaggggagcggcggcgcatggcccgatggtcgccggcaacgaccactggcgcggcggcatgcacgggatgcagcagagtgaggctgggagggaagggggatgttcaccgagcggacgggatggtgaggcgaagacgggaaggcggcctgcgacgaggttaggcggcgtcgctcctcgggttggagtcggggatgacgctccgatgactcccggccgcggctgtaacatcctgaaaatgtatcattttctaatcttgcatcatgctgattcttatgttcttaataaccttctaaacctaggaaaatataattagcgggacctcctaaaactaacttgcataaaaacatctatggtatttaatcccttttgtgtttttcatttaaaaacatatttatttcttgttggaattctattttcgaatattaaaccttctttcgactaaaactcttttattcaaatttagtttgaaaaccatttttactattatgaattatggtccaagaaatcctccaattttgccttgaacctaaaccaaagcagttccaatctcattggaattaattgttagcccatcctttgatcttaaacccatcctttattctcgatccaaatatccaaattcctccttttgatctagccaccaatttaatttctgtggcttgatttcctcttcagcacaagaatagtattatttcaaatattgtgaataattgctcttgtgctaagaaaattccaacttatactcttcattcaccctttttagccacaaatatacataataccaattttagaatcggtatcctatttattgccttcaactaattcccttctatattctcaaaaatattttgaggaatattattaatttcccttcctatttgagtgcttccaaataaattccctccaactccatctctaaatattgcactcaaataaataaattaagaaatctcttttattaattctctccgaattcaaattcttcgcaaacctagttatccaatcaagtattcaaattagacttcctttctttttgtcatcgggacgaaactccattctttcttccttttggcccaatcccttttcttttctattttcctcctccttcttgggctgccggcccagctaagccgagccggcccaaaccagcccacaccccagcggagccgcctcctcctcccgtgcgcgtgttgcgcacggcgcacaccgccgccaacgccttccctcgctgcgaagttaccggccgccgtcattcttttcttcacgctaccgttgccgtgtcttcctcgacctcctcctccgaaccgcctctcacaaccgcccttccctcctataaatagccggcccttctctacacacaaaccgaactctctctcttctctctctcccatgccggccaccatcttgccatgcccaatctcctttaccggagcaacactaaccaaatcctcgcgccaccatacttgcccccctccgacgaacccatttttctagtttcccctctcctttagccatcctataagccaccatcaccacttcttttactcgccggagttgagctcttgtcgtcgccgtttcggccatctccctcgctctctctgccagccaccgccctccccgggtgcgtcgtgctcgggaacacgcatggacgccgacgtcaccgccctccagccaccgaagcgccgccgccccgattgccttctcctctctcttctcccagctctctctggaacagagaagaagaaaggaacgggaggaagaaggagaagaaaaagaaaaagaaagactgtcaggtgggcccctgcacagtgacttttcttattttctagatttaattcaaatcctattctttagaagcccatatctcctaaaccgcgtgcataaagcgcgcacgtgttctattacgtgcgagcgccagtcaaatttggacataaattcatctaaattcaaactcttcattttgatatcaaatttgctattttaagattttatttgaatttccttaatttattcaaataccatttgaataaatatttgatttaatcttataattgaatttacaatttaaacttatatttgctttccaaatattttcttttatttccaaaataccctttagccactaaaaagccgccggctttacgccttccatggggacgtttgcgcggtctacggacctcaacgtcaaaccgttggttgtaaagcccggcaaaaaccaaacctaaggtcgaagtgctgctcctggcaccccacgccttgatgcgtacagcggtcagagcttcactatccccttgacctccattgcacgccgcacagttagctcttgagctctgtgtgatcctagccgctccgccgctactcacggttgacggagtaacacttccaccccactaaaactgcacccacctcctattcttctagccgatatgttgtctatcaacacggctagaaatgataccaaacctagttgtcatgctgtccaactctagcgacgactagcgaacacccaaaaccctagccaatatttatcctacctcgatatcggcctaaacaactaaaccctagccactattctacaaaagctcaaccttcacccatattagccacatgcctatttaaccatatcaactatctagtatatttcctatcgtccaaaccacgagagcctccacaaaaaaatatagagcctagccgatatgctatcctactccacaaacgactcccatacaactaaaccctaggtattatactacctaaacctaccgctagcaaatactagccccataatccctataccctataaaagatataggttataccttaaaccctagcccttttagccgtttatcgttttcttaccattttatggcttttattgaaattagttcttcctctttctcagtagagtctattgtcttttggatggcaacatatggtatttcgagaatcggataatcaggttgcctatcttggattatttgcgttggagcaaggcaagttattattcctccctttgagcataattatcctatattctacattctattctatgcattagccatttatgattttgaatgcataatctgaacatatagcaaaccagttatatgctagcttttgcttagccctgcctagttagactgcataaaatataatgaacttagattgggacagtacgtaagatttggttgatttgcgggtggctagtactgtctcagtcgatataagtttaccaagtgcttatgtcaaacgaacgagtacgaccgcagcttctagaatggggacagacctagatattatgttaattaacaatgtggtacctctgtacagtggttcttatgtaagtcctcgcgaaggaggcaaatatatgctgagcagggcaaatgtgatatttaccgaggcgcacataaatatcttgattatcgcgcgatgtttgtgtgattttatggaaacctggttgagatgacgtggggtctctcctccagttctctctaaaaacctcgggaactccagaactcctctcgctgctgataacgttacgttcagagcgcatggggactagagttcatggaacaggtgccacaattgttaataacttaatactgggccatgactaagctaatgattattagcaagttatggactgcgggtaaagcgtacatctactgcagtatgaatatgtttaaaactattcgaatagccgtgctcacggatttgagcatcgggactgatatggtactttggttagaaatataattcaagattttcttaaatactgctgcatatcaagcatttcaggatttctacctctttattctcagcattctgcaagtaaatctagctctacacagatattacctctcatgcattcattgttgaataatataatagcttgctgagtacgttgtactcaaccttgcttcaacccctctttttcagagtctatttggagtttttgccgaagctgggagttcaatcatataagttagtttcattctaacttaattttcaagtatagactagatacatggtttaagtctatagcaaaacattagagttaagccattctatagcttctgctgaatagttagccacaaacttgtaaatatcctattattttatataaagatatctctttggagtctttaccaaatgtatgcgatgaagatccagattggttgaacctgtatcaatctactgatccaaggcttgatacaactaaaca

SEQ ID NO: 15996 - DNA, 26600 bp, Oryza sativa
agccgaaggaggcgacggtgcaccgcgaggaggtcgggaacggcggggatcagcgaccggaggtggcaaacggcggcggtctcgggttgatggcgaaagtggtgcttcggaggtggactgggcaaactaagtggcagccggccttgcgcttgcgactgcgaagccaatggcgcaagcgatgagccgcagcgacgtttgaagcgtcggtggcgcgcggctggactcggtggcagcggtggaaagaggtggtgcgcgtggcggcggcgttacggaggcgaagaggggaaatagagtaggggccagggtagagcttggcacagcgatgccgacgacacaaacggcgcggcacggcggcccctaggatggtagtagcgggcggctggtggcggtgaatggcggtggtggttcgagttggcggtgggatggtggttccggcgatggaatggggaagcggagcagaggccggggtgcagcacggtgaggtgaagccgacggcacaaacggcgcggcacggcggtggctacggcgactgcagcatgcagctggagctcgccggtgggcggcggcgcgcggggtggcgtggggagagcgaggaagagtgagccggggctttggaaaaatggggaaaagagagagggagccccgaggagcatttttataggctcggggaggggagaacatggccggaatgggcggcaacgggcagtggcgtgggactccagcgacatgggtgagtggcggctcggcgtagggctggttcccgcggggagagagggggagtggggcgggatgtgggcgcaaggtggagaggactcgggtccacgccagttgggacgaggggaagcgcggatcggcgggaggggtgggcggcgtggccggaggttaggaatgagcccgacaggtgggacctacctgtcggcggctcaggggagaggaggtaggaggagacagctgggggaggcaaactagactcgagagagagaaccaagcgggctgagggaggggaagggagaatgggccggtggcccgaggggaagagggggaagagggtggcctggctgggaggggaaaggggagattgggccgagcccaaagacaaagaggggattttaatttcttttatttttatttaaatgagtttaataaactttgtgactttaaacttatttcttgagctccgaaaattcgcaggaaatttcagagagttcattagggcacaaagaatattacaaaatattctcggtcaatgatttttaaaggaaaattttaatttcccctataatttcacttgattaaattgctttaatttttatttaatttctagaaggtgcattatttaatgatttttaatcccgaacgaaaatcagggcgttacaataggcgttcctaaaaaattatcacacttcatagcatattggagagatgagaacttttggttcaaatcggaacttccagtataggattggaagttccggtctcaagcaaaaagttcggcggataacgaaataaaacactagctatgaactcgtagctcgaataaacaaaatgtatatgaatcaaatggtgacaaataaggtatctaagcaagatataaggtcaccaactatattaattaagcatgcaagtagatcaggtaaaaacaagatcaagatatgagagatggctagaacgagcaaaccaagagaggagacacgttgatttgtttcccgaagttcggatccaaggatcctacgtctccgttgagggaccataaggccgggtctatttcaacactttcttcacgaggttgcacaaatgcaatcatcggtttcactcttgatttcttcccttgcggaggcgaaatcgaagccttcacaaacttttcatggcacaccacaaccttgggtgctcaccggcaacacctagccgtctaggagaccatagtccccaagggtaaccaatacaatcaaagatttgcttgctatgaactcgagtgctcaaagtatggagtgaagctcactagctctcaacttcttaatctcttaatccaaatctctccccttctcaaatccctctcacaaagaggcaccacataaggtagggaaaacggggatggctctttggttttgaatttgtctaatgttgcccaagaacagcagccactcaaagaaagagtggaggagtttatatacccgagcccctcaaaaactaaccgttggaggccaacactgtaattttcggaatttctaaaatgcattttcggataagtccaaaaacttacagaagccaatctcagattcgcagccattttcaaaatttccgataattttcggatatttccgaaatattttcggaatttcttttagtttttcggaatttccgaaaagcacagagtaaaatgactattacttttcgctcgggagtccattttagatgatcttggactctatggaaagctcattcagaggactacccaactcaaccaaaaacaaggtctaaaaccactcaaaggataggttaaagcttgggtttctctcaaggtagcactacgataggtcactttgagcaccgagacatacacaaatacctcgacgttgcatccctcttaatagtacgacattcctaaactcaaatgtaaataggaagagaattataccaatagggatgccttctttacatctttctttcattgtcttaagggacgccaatgccgaaaccgtttcaccatatattctttaaatgattgatgcggttacttgtagcttcaaatggtctcgcacggtccatcatgacaaagccgtcactcttccgtcaccaccgatttggttcttcggtgccaagccccttgcttgcccttcaccgccgcatggtccatcgtgaccgaccatcgcttgcccttcaccgtcttgccatagtagccactttgtatcccacatcttcaatatcttcactttgtcattcttggtatcgttacgtgtaattatatcacttgagcatcaacacctttgcaatccttgggacctatttctttcattcaactcaataaaattattagtcccaatgatccggttgtcaacctccacatgttgaccaaccaatcgcatgtataaaatgatatgaataaatgatgagtatttatcaacaccacaagtgtcatatactcaaatatatgctcaaatgtaaagatcccaattaaatgaaagtgaataacttagatcgattacaagcataactaaactataggatttttccccctaaatgcatgcatacaaaatgtttgtgtgaagcaagagtatgcataaaagaatgaaacattaggagcttatcctatacaagaatcgaaggcatttatcaaatataggcattaaaataaaaacatacatttatcatcttcatgttctcaatgtaaagagaccaaacaagatatggctcaaacaaagcattagtctcacatgcttatgtaatcacatgaatatatatatatatgaatatagcaatatgtgcacggagagaaagagtgacatatatagcttgatctccatgcatttcatccttgtgatttaggtacatcatcaatgaacgtttctttctccactcatatgaagtccggatatcacctctcacatattccactttcatatccatatgagactagtagacaaagaaatgcttataacaatgttggtctcatgtaattggatttgtcattaatcaccaaaaccaaattaatggcacttgaactttcaaaagaaaaagagaaaggaaagatgctcatgtgattttgcaaaaggacccgtgtagtttttagaaattaagtgcatgttcctttgcataggaaattttgccttttaaaccctgatttttccataatttacacaattaaccctctttattgggatatttgtttgaatggcgtacgaaatttgcaaatatcaccgaaaatcatattctcgcatgaaaggggccacgagacattgaatttttacctcgactttgcatttcaggtacctttattgctgatatatatgattatgaaatttatttatcgcatttatgattattgattatttgtaatgctttattgcctttagttaatatctttgcagtaaaatgtatagaattgcatagaatacattgaaattatttgcgggaacttttgtgtatcattatttgcaacaattgtgcattcttacctgaatgtagttttgcgcatgttttgaatataggaaaatggctggcatcacgaattagaaaatttgctaaatctagaatatctccgacatatttattcaatgtcgaaattacgatagagcaggaagttctacggtaccgttaatccaatcgcgctatgtgcattgactcgataagtttgatccagcatttcaatatctcaccagtgcttctaagctactctcatgaatgagtatgctagacgactaggcgcgttagcatttagaaggttatggtgcacaccctacctcttgcagagcaagaactatcagcaagaatgggtattttcgactatgattgactaagaaaatgaccaagagagtacggtaattcggtgcaccgaacttgcaccaggtaccatggaaactctcaatgattctacccgagcgtcacaaaagtcgtacgcaagcatcactagtgcacatttataggtgacttatgatggttgtatggtggttaaacactcacaatagccattgggagccaaccaggaagccacgcgtggagggccaactaccacggcgaggatcttggcagcggcgctggatccgaccacaggctcgctgcccctccccacctcacgcagatcagaggagaccgatgccgccgttgctggagccgaagacgaagccggtggtgattcacgcgtgttcggcgtcgcctccctcagcaccagcatcatgtactcattcacccaggtccgtgcctcccctcctagtcccttgcctcgcccagcccgctgcacacggggatccccggggcggcgagtcggcaaacgggggcaccaccgcaaccagctgcattgcctgcacgtgtaacataccgaaaatttgctattttctacatatgcatcacgccgattcttatgtttttaataacttcctaaacttaagaaattataattagagggacctcctaaaactaacatgcataaaacccctctttggtatttaaaatctttcgtggttttattctaaaaattggtcttgttaaattgaggtattctctttgatttgattttgcatcttaaacgttctttcgaccaaaattttctttatttaattttagtttgaaaatcctttttacttttatgaatcatggtccaagaaatcctccaacaatacctttgaacctaaaccgaagcaattccaattttattagaattaattgtcgacccatcctttgatttcaaacctattcttatttatcgccaaatatccaagttccccattagcctcgaatacttctccaaatccttgctaaataatttgaggctaacatcctatttatttcccttccctctcaatcgagtgcatcaaataaattccgttatattctatctctcaaaagattgcactcaaataaattagaacatccttattttaaaatccctcaccatgtatcaatatctccgaattcaaatcctttttaaatctagccatccaaattcctctaaatcaattatttgaatctctagaaaaattagactttcttccttgtaattttgggccgaattcttcttcccactcaggcggcccaagtcggcccagctacccctcccagccacacagccgatcctcctccctgtcccgtgggcgccgccgccgtgtgccatgggcgcgcgtggcgcacgggtgcacacgcagccgctgccgtcgcctgcagctttgccgccgtctttccttcgccgctaagcaaccgccgcccgacgtcagcgccacctcacaccgctgacgccagccactgcaccaaaccgacatgatcggccaatcggatggaaggaccggtgccgtcgttctcttcttcacgacattgccgccgtgaccaagacgacgacctcctttgcgaaccgacctccaaagcctataaataccggcaagccgtccctttttctcccacatatccgaggtctctctctccctctctttctctctctttcttcctcatgaccggctgccgccaccgtcggccgatctccttcaccgtagctccacaacccaaaccctcgcgccatcgggcttgcctcgacgaggggaatccatttttctagtttcccctcttccctatccactccatcaagccaccacaaccacctcccttgcagccgaagagaagctcttctactcgccgttccggccaactcctcctctctctcggccagccaccgacttacccgggtgcgcgtcgctcgggaacacgcttggccgccgccgtcgaagccgttccaccatcggagcaccggcgccccttctctctctctctttctctctctctctctctgttgttacacgggaagaagaagagaaggaagaagatgacgggaggaaggaggaaaagaaaaagaaaaagaaagactgacaggtgggcccctacacagtacacttcatattttctagatttaattcaaatcctattttttagaagcccatatctcctaaaccgtagatccgattccaatgaaacttggacctaaattcatctaaattcaaaccctatcttttgacaccaaatttgctattttaatattttatttgaatttattcaaatattgtttgaatttatatttgccttttcaaatatttctttttaacccagaatactctttagccactaaaaagccgccggttggaactttacgccttccatggggacgttcgcggtttactatcctcgacgtcagactgttggttgtaaagcccggcaaaaccaaacctaaggttgaagtgctgctcctggcaccccacgcctcgatgcgtatagtgctcggagtttcactatttcctcgacctccacagaacgccgcacagttagctcttgagctctgtgtgatcctagccgctccgccgctactcacggttgtcagagtaacacttccgccccactaaacccacacaaacctcctatccctctagtcgttatgctgtctattgacaccggctagagaagataccaattctagtcgttatactgtccaactgtagcaacgactagcaaacaaccaaaccctagccgatgcctttctaattaaattccaactaccatccaaattccatacccacctatccaccatactattaactacctactcttctagaacctatacataaaatatagaacctagccgatatgttgccctactccacaatcggcttaaatataaccaaaccctaggtattatactacccaaacctaccaccagccaatactagccacatactcacttaaccagttatatatcccttactctccaagcaaccaaaacccacacataaaatataaacgacatgagttgcttgatcccctctccacctcaacctccaaccctctagaacctccacataaaatattaacccaataatccctataccctaaaggagatagattataccctaaaccctagctctctttagccgcttatcgatcttttgttattttatggcttttattgaatttggctcttcctcttcttcagtagagtttattttattttggatggcaacctgtggtattttaaggatcggataatcaggttgcctaccttggattattcgcgttggagcaaggtaagttattattccttcccttgagcataattaccctatattcttatatttctattctatgcattagtcattcatgattttgaatgcataacctgaacatagcaaaccagatatgctagctttgcttagccctgcctagtaagtctgcataaaaatataatgaacttagattgggacagtacgtaggaattggttgattttcgggtggctagtactgtctcagtcgatatagttattaccaagtacttatgtcaaacgaacgagtacgaccgcaattctagaatggggacagaccttgcaaagtaggttgtctagcaaaggtggtacctctgtacagtggttcttatttaagtcctcgcgcaggaggcaaacttatgccgcgaagggcaaatataacatttaccgaggcacaggtagatgatttgttgagctcaagtgtgtgtattgtgaaaacctggttgagatgacgggggtctctcaaccagttctctctctaaaaacctcgggaacgccagaacttctctcgctgctgataacgttacgttcagagtgcatgaggatgaaagttcatggaacaggtgccactgatgtcagtaaccgaaaagctttgccatgactaagctaatgaatattggtatgtcatagattgcgggtaaagcgtacatttactgcagtaaaataaacatgaatctatttgaatagccgtgctcacggaattgagtatcgggactcatatggtactttggttagaaacctaattcaagattttactaaatgctgctgcatttaaaacatcaggctttctatttctatattctctgccttctgcaagtaatcgtaatcctactcaaatattaccttttcatacattcattattgaatataatagcttgctaagtacgttgtactcacccttgcttcaaacccctttttccagagttaaattgaagttcttgccgaagccaggagttcaatcatataagttagtcttatttcaacctagttcacaaatctaaattagttagatggtttaagtctatagcaaaatattagagttgagacactctatagcttctgctgtaatagttagccacaatcttgtaaattcccctattaatttatgtaataacatctcctttggagccttgttcaaatgtacgcaatgaagatccagattgttgaagctgtatcagtctactgatccagggtttgatacagttaaacatgtcggtttccgaatcattagttttgagatccgacagcacgtccggctcgcttcccccgtttcgttttctgatgctgttttattttgggggattcttgaattgaggataaagggatgacatggaggtgctcgacgagccgctctacgctaatttcctgcaagtcactggcgtcgacaggccatatcacgcggagcttctttctaacatggtaaaccttgacaaaggtttgaccattactacttattgacggtcgttagtataacgccccgattttcgttcgggaataaaaatcaattaataatacatcttctagaaattaaataaaagttaaatcaatttaatcaagtgaaattatagaggaaattaaaatttcctttaaaaatcattggccgggaatattttgtaatattcttggtgccctaatgtactctccggaactttccgtgaattttcggagctcgagaaatagttttaaagtcacgaagatcatttaaccaattaaaataaaaagaaaacaaataaaatcctccctcctctctttgggcccctttcggcccaatttcccccccccttctctccctctcgggccggccttctccctcggcccgctcggctctctctctccctcaagtctgctttacctccctcgcccgttttcccctctctctctccccgacaggtgggacccgaggccccacctgtcagctcctcctcctacctctggctggccggctgcaaccgccagggcccgccgagccaccccacgacgccgccgtttccgacctcctccaccccgcgcgcgagcccgccggtcgtgggaccccgtcgccccacgtcctctacccttttccccactctccccacgaaaatcgccgccggttaacctctccaccacccccacgatgccccggccatctcgccagccggttgccacctctctcgagcacgatcccgtcgctccaagcccataaaaagcatccccggcctcccctattcattttccccaattcttccgagcttctcgcgccctgtactgctctcccctcgctgttcccatcgccgccgctcacccgcgactctccatccgctcgccaccgctgctacagccgtcgccgtgctgttccgccgccacctgcggcttcgccgtgccttgccgcacctcggccccgctccgttttccccattccatcgtcggaaccccctccccaccgcgctccctctctccaccactcaccgacgagctccagccgccgctcctcgccgctccagccaccactgcgccgtgccaccgccaccgccggcatcgccccgccgagctccaccccggtccctactccattttcccatttcgcctccggaacgccgccgccacacgcaccacctctctccctcaccatggccacctccagccgcgtcgcaacgccgcttcggtccttgccgacccgcgtcgtcgccttcctcggctccgcagggacggggagatccttggccactggccctcttcgccggaaatccgcccgagctccacctccctcgtcgccggtgagctcctcctcgtattgtcgtggtcggcagtcgtttccatttacctcgcaccagttctcacctccctagcccctccttgattttcctcagaccgaggccgagcccgtcccccccttcctgagcgacgcccgtcgccggagctccgtcgcgccgtcttcccgaggagccccgctgccaccgttccttgccgtcggccgcccgtttgccgtcgtgccgctcggtgagcactcccctccctctccccttcctccccttcgtcggccacctcctgtgcctgctcacaacgcgccgccgtcgccggtggccgtccgaccgggtcgccgccgccgcgctccgcgccgctgccggctgtgccgggcagtcggctgccgcctcaccttaccgcgccgcgccgccgctccctagcgtgcgccgccaccgcccgcatgcgctgccgctccccgcgtcgtcgtcggccgtcatcaccggtggccgcgctgccgtgcgccatcactcggctggccggctttgagccgtgaccgtgccccagccgcgcgccccgtggccgtccgatcggcttaggccaatccaggccgtcggttcccgtggaccggcggtggaccgcctcggtggtcccggtccacggtggaccggctcccttgtgccactgaccggtggggcccgcttgccggcgccgcccctcccctttgatgacgtcagcaaccctcttttcctttggaaaaataaataataattgcgtcataattcgttaataattctagaaattcatttaaatggctcaaaacttctaaaattcatatctaattcattcgaactccgaattgaaccgttcaacttgcaaaattcatctaaaattgagctctacatgtttgtttagtttttatgtactgtttccttggtttttattagagttgttcctcgttttgtgtgccagcatgtagaatccgtcgtttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgttctttgtcaaccttgggtaataaatcgcctagcttgtgttactttgatgacatagctagaactatatgcttagccatgcttaattaccactagctcagttgatggggtaattacagttttagaccttttagtatcagaatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttatcacaagccagcgtgggcaacggctgggcttgtagtgtagctttcctctagccgacgcatccaggcaagggtgggcgtgatggagtttcgatgggccctgcgatggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcgtcgcacggaaacgtgtcgtggggctgtgtcttgtgggtacagttgtacacctctgatcagagtaaaactattcgaatagccgtgcccgcggttatgggcagtcgaccagattcaccgtgattagtcccatcttaacaaatcgactcaatacacaaatcgactcaatacactgtagttcaggtgggttggttgggcctgttcaacgtggtgtagtgttgatcagtggagattcaatattactttaattactcaacagttttactgttttgctcaataaaatgttttacaactgcctttatgcaaatagccacaaacccctccttgtatccccttgcacgtctgcatcgttggtgtggcttactgagtacggtggttgtactcagtcttgctattattcccccttttcagaagtgtagtgcttctgagctgaagacgaagttagaagaccaaggctcagaccccagttgagttttgcctgtggaatggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctagacagggatttaatacacaaaatagtctggaaatttgggctaaatttctgggcgtgacagttagcgatcagtttcacccgtcaatattactaaaataaaggagaactagttatgcttacaatgcatattcatgttagaataagaaatattccactagcactaggttttctaaccttttgtatagaatgagaataaatggaggagaatcgatagcaaaatagacgatcaatcaatccgacgctgtcgtgaatcagacttagaggaagatgggccaagaactcagaaataacatactcacaagtctacggggagaacacacgaggagaccaccagccaaaacctgggctggttgggccgacccctggttcggccaaacctcgggtttggccaaacccctctcgtagccgtttgatccagggctttgcctggacgttgtagattagaccccaatgacggttggagggtatttctgaccattccaaccgtcacaaccgtcattgggaggctataaaaggggctctcatcctcacttcttccacacacctcaagcgggaagaatcaagctctctctctagtttagtactagaataggaatagaataggagtcttaattcgagaagtcttcagaaggattcgggtatggttctagtagctctgctctcttttgtaagacttatactttatttagaatattcttctttatactactctggtattgtattacttttcgagtatatgtataccaactttattatatattcaagttatattgattatgatgctagcttatctgggaaatgcaatggtgtgggtataatgatcgtgtatacgattgctctatgtcatgacgatgatattagagtagtatttggtaatttaagcgtagtgtttagattactggatatcattattttgggttatatgctgcgaatacgtcgaggtgggctgctgatgctgacagctcagtacgggtattccatcgcgcgtgtatatagtcctaggttactttcctggggaaggtactcctccgtatttagccccataatataccatgagtgtttctacgccattgctggaaattatatttctagtaatgtcgttaagaaataccaacactactccaatcacactactactatttccaatcacactactattattgctattggagaatgaaattttttgttgtgtgatctttgcggcatttagtaatggatgttattttgaagtagcggtcgtttggaattgaaccaaatcagctgtaatcatgctcttatgacatgattaaaagaatggggaggtggattcgtgaattacctttttctctttttttttcttctagcactttcatggctatttggacctttctgtcgaaatgttctcaatgtcttaattagactatttccattttaatatcgaaaataatacagtgcaccatattcgtgtgtgctattttaaaatagctctgctaagttaccataaatttctatactatcaatatgcatgcagcatggagccttctatataatagaatcactaaggaatacttctagtctgatcctgatggtaacaaagttatcagtgaagtcaccttttgggccagggaagagaatatattgttactacaaggtagatttttattttctaaaatgttgctcaatgatatataaatgatcccttaatcccttaatcttttgtttgtagcacattgcaaaacaacacaatatcagttgcatgtagctagaataaggttaatgtgctcttcttctcgattattccttttcgttccataaaatatgtatgattagtcacagtggcatctaacttcttccctttatgaaggaatgtagaaatatacttactcagatggagatatgatggctaactgcttactattgagctgatgtatttctgaagtagtaaagtcgtcggtaggatgtttcaaagaaactaatgatgtaccacgcaatgacataaatcaggaaaggattgttggcaactttttgtgacaagttggcaagcacgattgcagcacctaaagctttacggtgatcctaaatttgccaaccaccctaatctaccaagcgctaaatcaagatgagttttgataaactaaaccggcttgtggagccgatctagatggaacggtagataattacccgtctcgtgggcaaaacggaaggttttcaggacaaacctacaaagaggtgtcgcactctcgtagcagtggcggacaatttacagcacaaatcgacaaagatggacaaactaaactagaactagaagcaatatgaaaaaacgattctattgattgattgtatgattgtctttacaattgaaccggccttgtcccttatataggggttggtcttgccctctacaggccctcctccacgtccaactcgggataaaaaccaaaggaaacccgaaacatgccttcccaagcaaggaaatctcgagacccgacaaaacagactcgggctagaactttgccggtcagaccggccacacaccgtcggtctgaccggccaacacacggcggtctgaccggccttctcagaggaaaacgggcaaaacttccgaactttggcaatttccctatttcaatcctaggtaccaaatttaggtgtaaacaagaattagttggagttgcatgctatagtccttatttgtatggtattatttgttcaagttatgatatggacatacctctttctttttttaggaaaaagcaagagatgtgcatacaaagaaatgaagtaatagcattttcatatccatttgaatttatgcttcttggagttctaagctactatgtattttaaatagtactgctaaatcataactaaatacatgttttttgtatgatggattcactatatttaaagtccttaatttcatgatgatgctatgtcatcttggcatatggttaattaattgaaatatgatttacttggtgggttgtgggtacatgcatgatttcatttggtggtcgtgcccatgacaattaaggaccagttctcgagaatctctggaagatatactcatactaaccacaagccagatgggctctaggctgaatcttaagtataatcttttctagctgacacaccgttggcaaggtgttaacaatgaaatttggtaagcccctaagagaattatcacattaccaatagtcaaattcttgctatattcggttaaggaaattaatcgaataaaaggatgcatatccagaaatgaccgagttcaaggaggatgcggcatggcaagttatctattaattagaaatagtttgttagtttccttttatctttaggaaagtgtgtttagtgtcctataaggactttatgttttccttttatctttaggaaagtttctttcttgtcctacaaggactagtatctccccatgggtataaatatgtacacccggggtcatggtaattatctctcgatcaatactactctcggcgcatcgccatcctctctcctgaggtttttacttatcaaccggcggaatttggcacctgacgcggggctgcatcgggtcagttcgatctccagcgaaggggtaagtcctacgttccgccgccctagtgaatctattggctaaattggtgttgttcaaggctgcattgctttcgatctcttggatcgctctagtttggttgatatattttcttacctgatatctcaattctatccctaattgcattgtgtttagagacacatcggtttagttaggactgtctcggtaaggtatgatcttttgtcttagccgatataaagacacaactagctcggatataaccatgactaccttatgtattaatcaactaaaggtgcatatgttttatattagatttacttgttatatatttgaacaaacgttgctacacaatgagtttcatgtgtttttgtttgcagaggtactcgcttgggcgaaggaaaagagactgagcgtaacgaattcatggatgatcaaagaagttgattgggaccaaaccaagaccttcttcaagtccacttccatcttaacatgtcacttttggtccatagaagacaagagataaagttctacatgttttgaattcggattcgggcctcctgacagcatcaacttcaaacggatctagccgctaatctagaaggaatttcggggcccatgagtacttgttggaaagcttatggagtctactttcatatggatttggtcccacgtcaaaattcctaccgagctgtcgagaatttgcaaaacaagccacgtatctcatccagtccgaatctgatttgggttttgggccttgtaattatgtcgtgggcttagcccaagcgggtgtgcgccctaggccaaccctaggacgtccctaatcacatttattcagtagccgtcatcgtttagagtcaggttttgcttagattattcagtcaagaacagttttgccgctagatcggtttgtggaaccccaaattcgagcgcttaatcattcatatgcaattgtgttgcaatctatcttgttattgattgtgttcttcgattcgcatgcaaggattagccttctcggcgaggtcaaccgggtttcggcatggttgataactagaggagacgtggtgctgtgattgcagggctcagtagcgtgtttgttcagaagctggatcgagttgtgtcgcaactccgcccaaatcattgtttatcagaacctttcggaagatcgggacctgacatcccctcatcaatagatttgttatatccatcacattagacagatctatcagcttatcgaggattagattatcatatccaatctcgtgctgcatcggttagtttcgacctactagattgttgttgataatataaaccttgttaagctgacagattcatgctaatgttttatcggggtgctagccgataaattatctggacgttgcatcggcttacaaggattacatacaagttggcttatccaattgcagcaaaactttcactgtttatctaatcgtttggattttacgacatcggaccttcagccgatgtatgctttaaccttcggatctttacatgttctatcatatcattgttagccgattggtttctactggactatattattgttatattatattatcaacagtcgattgcctttatattgttatttatatcaagcgttagaatctacatcagaattatagccgatagctcaaaaccctatcccaatcggctagtatcggcatcggccggaattaatctatcggcttgttagctgatcggctatttgatccgttgtttacatatcttgtcagttgcagggtcaaactgactggcatgcccgcatctcatcaacctttggacctgtactaaagctaagcagatctctcaggccagtgtgtgtttttcgcatcaacacaagggtaggcgtgatggagtttggatggacctggattttggtctatgctgcttccgaatttacctaggcatgagcggggttgcccgcccctggattttggggtgggggtgaaaccgaaggtgggtgtgctagttagggtggttatatggagggttttgtcatgatttccccctttgcagtatcatggtggtacttcgggtatggtttcatgtgtagaatcgtgtcttgtggttaaagttgtacacctctgatcagagtaaaactattcgaatagccgtgcccgcagttattgggcggtcaaccagctcaccgtgatttttgctgggcctgtcgcaacgtggtttagcgttggacagtgatgatgttaatactacttaattatctactgttttactgctttcaacttatgatttacaaatgttgcttttactgcaaaaatatcctatgagccaatcctttaattatccttgcatcataccttccccttggtatgacttgttgagtacagtggttgtactcagtcttgctttattttttccaatcccccagaagtagaagttggttcaaatggtgagttctatgaagattaggcttgtgccagccgtcaagagtttgcctgtggagttttggaggaagcttcgctttgctgagaagattaagtttagttctctagtttttccgccgcatatgagttttatcttgttatttttgtaagacgtggaactgtatcaaattgtcatctatgtactctggttgatgcctggacagaggttaaatgcacagatagccggtgattcgggttgtcgaatccctgggcatgacagagaccaccatgcctcctcccactgcagccacagtcgccacagcagccgctgctgccgtattccaaccacctgctgtcgccggccagccgctaacgccaccgtcaccacgagctctgcgcctgctatcaccaccacgacgacctctcccgccgctagtgcccccgttgccacagcagccaacagtcgctgcacgtcggccagccactgctgccgccgccgtccagttgctgtcttcgcgccgttgcctccgtgccgtcagctgtcacgacaaaaaatttagcccaaatttccagactattttatgtattaaatccctatccaggaccaacaagggtacataaacgacaaattaatatatagatccaagcgtaaataaagcgtaaaatacttatagaagaggcacttagtcctcacatcgaaacaaaagcagcagcaatggaaaaaggcgatcctagcagggcttcagctccactccataggcagaactcaactggggtctgagccttggtcctctaacttcgtcttcagctcagaagcactatagttctgaaaaatggggaaatagcaagctgagtacaaccatcgtactcagcaagccacaccaatgatgcagacgtgcaaaaggagacaaagggaggtttgcggttgtttgcataaaggcggttgtaaatcattttattgagcaaaatagtaaaatagttgattaattaaggtaatattaaatctccactgatcaatgctacaccacattgaacaggcccaaccaaaccacctgaactacaccggttcattaaccaattattaaggatgggactaatcacggtgaatttggtcaatcgcccaaaaccgcgggcacggctattcgaatagttttactctggccagaggtgcacaactgtacacacaagacacaatccatcggcatgtcaccgcgtcatcatgtgcccatgatgagcatgtcaccatatcgagtgattgtgataagacccttcgcataactctcccctaaccatccacaccacgctaaagtttcacccccaccccctaccccggaggtgggcagtcccctcgtgcgccgtggtgaattcagcagctggacaaacgaacacccggccgacccaactccattacgcccagcctcgccaccggtgcctaggaaattgtcgagctataatatagatcaagtagttactcattccagcttgtggtaagcacagtaagtcttccagggtttcttgtgaaccggtccttaattgccatgggtgcaactagcaaaaccatgcacccacagcccaccatttggtcgcattttagttggataattacgaccaatgaaacatgttcggatgtctcgagcacgcaactcgtcaaggtactataggtctaataatgtaattatcccattatgtgagctagtggtaattaagcatggctaagcatatatgattttagctagatcaacataagtatcacgagctagataatttatcacctaaggttgacaaaggacgggtaacaagtaaacatggcaaaagcgagcaaataggttatacctgatcccatgtaattagcaaaacatgcatatttatttgcaaacagtaaaatatttataaattaggctcaatatgcttaaggggaatgtgtgacattccttgcttcttcacttggatcttctgaactctttccctcgcgaccgcgaacttccggaacgacggagtctacacgctggcacgcaaaatgaggaaaaactctaataaaaaccaagtaaatagtacataaaaagtaaacaaacatgtagagctcaattttagatgaattttacaagttgaatggaccaatatggagttcgtatgaattagatatgaattttagaagttttgagccatttaaatcaatttctagaattaaatacgatttattgcacaattattaattaatttctcataagaaaagggctgtcgctgacatcattaaggggagaggcgcgccaacaggcgggccccgcatgtcagtggcataaggggaggcacacggtggactcggttcaccgcggcgggggcggcaccgtggacctggaccataggaccgacggcctagattggcctgaagccgatccaacgggcacgggcggcgcgacaggacacgggcacggcacaaagccggcccggccgagccacggcgcgtggcggcgcggcaaccaacggcgatggccggcgacgcaagtagcggcggtgcatggcacgggaggtgggcaacgaagggggaaggaggaaaaagagagggggagtgctcaccgagcgccatggcggcaagggggcaacgggcagcggtgaggccttctcaggaagatgacgcggcggcgcctcagcgatgaccaacgaaggcggtggagcggctgaggttcagagaggggcggcggagccgatagggtggtggcgcgtcgcgacgaaggcccgcggaagtagcgggaattggcggctagtgacagggaaatggcggtgagggctcgggtgcacgctagaagtggtattttggtggagttccggcggcgatgaacggaggccggggtgtggtggggcgctgcgaacgctgtggaggcagtagcgtggccgagcgaggcgatgctcgccggcggggagcggctggaggcagtagaaacagtgatggcttagcctcgcggtgggagcggcgtttcggtggcttttggggaaaatggagcggtggacggggtggagttcggcacggcgatggcggtggcggcctagagcagaggtggctagggcaacggtggtgagtggctggagctcgccggaaagaggcggaagttggttgcgcggtgggagcgatgtttcggtggtggtggggaaaaacggagcggtggccgggcttgatctcgcagcggcgaagccggcagtggaggacccaggatttgaacccagggtaggcctagccaaagaaaatccaaatacaatacaatatgattcgatataaaatatggtaaacgatacgtatataactctaaatggttcgatacaattagaaaataacaaataagtttaacttttaggataaaagcttgtaagtctaactattttttttatcaaatgaggcaaatgaatcggacggattaaatgctgacatataaagaagcaactccatactaacttcatcaaaccgattctcaagctcttgacgaattctatcgatgacaccaatgtacacttctctcctatagtggtcatcaattgtttgttccaggtaaaaacggtgggatcttccatgaggcatatatttagcatccattgcgggaatatcaatggaatatttgatgcaaaatgatgtaacctttcctaagaaaccttcccaaccatgcaaaaatgtcatatgaagggggtagtatgctagtagtggtctactactactagaactctagattctagaagggggagagggactgagggactgaggaagtgaggaattgctcactggagaggcggactggtggagagccgaagaaggagtggccggtagagcactagcgctgggctcttgggcggctgccggctgggcgcgtgctgccaccgacgcacgtcgggcaggaccgcgggagccaggaggccgccggctggtcgcgccgacgcgggacagagagagtgtggccaggcggggcgcgccggcgaggggcggagagggcgcggccgcacgggctccgacgcggcacgaaaaggcagtaggaggagcggcgctgtgagtcgcggcctcgcgggagcgccggccaccggattcacgggctcgcgggagcgccgtggcctgtcgggagtgggaggccaggagagtaagtggagaggggagataagagagttagagttttcttttgttgggccaggctttcttatgggccaagaaaaataaatacctgttcttatctgggccaaattatagggtagtcctgggcctacctagactactctttggtcccgccactggaagccggtggtggcggtggcgtagcacggcaacgacaggagccgcggtggctcgtggttggaggacgccggtgggcggcggagctcaggccggcgtgggaagaacgggagagcgtggggaacggcgaggaggggaaacaagagaggatggccgggatgcgttttatagcgctcggcggccgggattgtggccgagagaggcggattcggggtggcaaccggtaggaggtggggcgccgacgtggaggaaatggcggccggatttcgcgggaaggggtgggggaagtgggcgcaaggtggaggaggaccacgtgcgcgcggttagatgcgggcggggagcgggatgatgcttggaatttcggtgatgtgggcggccatggcgactgaagctgggcgactggaggaaggaggaggagttgacaggtggagtcgctgagccctcctgttggcgagggagggacaaaggaggtcgggagagaggccaaatagactttaggggaggggggagagggccgagcggtgagctgggccgggaaaggaggggagggagggggaggctggcatgagagggggagggggagggtcgaaaggaggctcaaaggaaggaggagatcttaaattggtttttcaattaatttaattgattaaatgaactttgtgatgttaaaattagatgttgagctccaaaaattcacagaaaaatcaagagagtatattagggcatagagaatattataaaatatttctggccaatgatttttaaaggaaacttttaatttcctcaataattcacttgattaaattgctttaacttttatttaatttgtagaaaatgatttattaattgatttttaatcccgaacgaaaatcggagcgttacattagccaccgccgctgccaccacgggcgctgccgcggctgtctcaggccacatccgtagctgtctcagccgccgccgctgtcacccatcaccagccgcgtggtcggccaccattgtctccgcgacggcggcagggtgcagggagttaggaggtgcaatggaggtggaggaggcagaaagccatggatgaacggtgcggcgagctggtgaccctaacgtggagagcggcgcaagtggcagcactgatgatgtaagagcatttcgaagaaagggctaaacaggttcctaaaaattaatttttgggattttggttaaaactaggtctgttaatcacggttctaaattttatcccctcctataaaatcgataccaatctcatcagaatttgggaaatttgggaagcagaacgccgtcctaatcgcaggaatcacgccaattgttttactgtcggcgccaaaagttttttttccgtccgcttccttttcctcgtcgcgccgttttttttcgagaaattttttttccgcccgcttcctttcccttctcgcgcctttctcctctcgccgttttctttttcgcgagaaacaacagcgcccacgccggcacgccgccaggctagggttttggggctcctagcgccagctctgtcccgagcgcccgtccgtccagggctctgccggccgtccgtccagggctccgccggccgcctatccgggggaccgccggcctgccagccgtccgtccaggggcagcgccgcccgccgcccgtccagggcaccaccacctcgccatcgaccgtccatccaggtcaccccgacgacgacgtgtgctgctactgctgattcactttgaggtattttcagagaaactcatttctacctgtgctcgtatggtttatacgcactgtacaagtgcttgtgcctgtcaccaatcgttgctgctcgctgccgttgcctggttgcttatgccgccggcgctgacagaggaacagctctgcgtgcgtctgcagcactgtgtccttcgcaaggttgtctggatcgggatattaggtagtaatgttttgctccaagtattatcgtatcgtaatattggaatactatgagattttctttttttaagtttaattaatattcatattaattacatatatattatgcaaatatagacatttatcatgagaaaccacgttggttttgatatatttaactgatttctatatatacttgagcatattcatttacattatttccaaaccatcttattttaaataatattttgtagtaacgtagggatcgtagaatcgggataccacttaagatttcgtaggatcgtgtagtaatgaatagtaggatcgagatactatgaaaattaggatactaggtgggatcggtatcgtttcggcttggtaggatcgtagtatcataagatactagaatacgaatcaggatactgacaaccggacttcgttcgatatcatatcgctgcgccttatatagcctcacgaattcggacgtcaaagggtttttaagttgtatttggacgtcaaatattaaaacacgtttcttattgtataaggacgtcattttgagaaaatgaaggaagcatatactttacacactgtaattatatacataccacgttttgatattgtatttttaggttaaatgaaatgaagaacatttaatcaatgttagctaatttgtgttcaatgaaattttctacgtaaattatgtttgttttcgtggctgcgcacgccgcgctctcccttctagtaaaaataagattatatcatattggatataatgtgctcacattgtggaaaacttaatactaatatttgagtttgtttatattattgctgtgacatataatttgggaaacacacattacaggtgcacgatagctggtggaagggaaaggccaaaagggagaagaaaacgagaaaataaaagtttcaggcgccgcttcaaaatcccgcctcaaacggtcaaaagcccctgatccccctttcccctaccgggcctctccgctgccgcctcatcctccacccccctcactttcctgtcgcgatgccacggcggcggcggcggcggcgtgcggcacccggcggccaagttcccccagagctacgcctggcttatggcgcccgcgcgctcacgctcggccgcgcggttttctccctcctgccctcgcctcgacattgtgagtccccctgtcctgcgtgccggggaagagtggcctcggggtgcctcgcgtgccgccgctgggagcacctcctccgtgacggggaccccgtcgcttatcgccgcctcatcacacgagccgtctgcgccattgcggccgacgatctgtccgcgcccccgccgccccggtacactccgggcaactccgggcattcgcaggccagggtttgtcctgctgctctcctactctcgatcttgccttacttatgtgctgcttagggtgtgtacatttctcgtcttctattggttatctgaggctgccctttttttttgcctgcatggtgtttgactcacagctcgttcgggagatgatgaagtcgatcgttgcggatcagtctcatggaaccaagaacgtcctctgcaatggtttgcacg

SEQ ID NO: 15997 - DNA, 2149 bp, Oryza sativa
cccgttgaagtgctgccatgccagtatacatggtatggttgttactagtgaaagaataattttcagttaaaacactgtaaaattatcctaacttaatttgttggatatccttgtctccttggtgttggtggtgtgaggcatctctacgagcatgttcaatcttgttggtcaaaaggggtcatttctggcaatgagtgaaaaatgatgagataataaacaaagttcacacttaaactaccaattttattacctgaaccagccatttatagaatcagatcattagatgtggtagttagtaactagccagtaagcattgaaataaaccaattattccattgaaatactgataaactaccatttatttggctcaacgacaactatttggaaaaataggatgtttggattctgttggggctattaacaatgtcgtttaagatgtgctaaagttagctaatattgaataaaggtaaggacgtagggttttgtgaatacttggtcttcggtgccaatgacattggcgcctatcccccttcacataagtggcttagcttccacggggaggctaggggtacggtgccaatgtcattggcgccctcatgttggaccataacaccaatgacgttagccccacaagaaaggtccattcccggaataaatttttctggggtctatttgtaaagtaagttttcaaaaaggaccaaaaagtgaattacaggcttataatcgttgataaccactcatcatatagctctgaacaatattaggttagccatacggacttatgtaaacttgtacaaactggccttggatgtgtcaaggaagctgtgatgcaattatatctctttagtttgcttcttcgcacatactattgattttactacttcgaatcattacgacctgataacttcttatatgattggtcgagtgacatgttggctactttgatatacacagatattattttatacttcccattaataatattaggttgttattgttattagggtggccagtctatatgtatcagtgatcttgtttcttcttcatcttggagtattcttttgcacagagtaagtttaacaaaaatccttttctctgatgattatggcctgcaatctttttttatttgataagatacttgtttgtgtttcagatcggggatcttctcatgtgctatttgctgaggtgcacatcaatctttctgcctgttaaaaagaatgattattttcaggtctctggtgttccactcaatgtggttctgcgaaatcctatatttgcaagtactgttgcgagaaaacatcaaccccaaactacaaaagcaaaatgtcatacagtaagcatttatttccagattttatagtttttcgactattgagtacaagtctttgtccagtgaaccccgtacaaatatttgattcccaacttaatgctctgaagacacaagtcaacaatttatctcagtatgactaggtctaccatttaaacaagtctcaacattcataaatttattttttcatgtataactataggtgaaaatagttctcaaatacagaaggaaatgtttacctcatccaataatgtgatatcctgcgatgttttatgatattcttgagtaagcatatttttctaaagaacaatagttttgttgtgtgtgaaaacaataacaataacaataacaataagttatacataaaagcctttcagaggtggggaaaggtgtcttctttggtagaaaaaacaaaactatcttgattagcctgattagttatatgtgattttggaataaaagctagacggagaacagtgtctgggattgcagcggaaacatgacttatctgacttcgtgttgatttcattacttcataaatgttgagttccaacaaggccacaacttttctgcaagatttttaattaaataggcaaaacacagcagaattacgatgaaatgagtatatcgcaatttctggttttcatgaagttccaggaatacaaaactagtccaaagaattggcacataaatttaaatttcccggtaataccaaatatccacatggagacatttttgtttataaagtatttttatacttttgtcaattttgtcagagaaatcttcaaattgcatcgtctccataactcgtgctataagaaa

SEQ ID NO: 15998 - DNA, 4338 bp, Oryza sativa
  unsure (1)..(4338): unsure at all n locations
cagaagtatcataggtggggttccgtaccgagcaaaccggcgatctaaccgatcatgggattacacggttcgctactttgatctaaacaaaacccaaattgatctatggggtcgtcctctaaccctaagacctgcccctaacggactcaacttgatacacaacccattgggcccaaataagttgacgcaacaccgttggcagaaaaaggtctagtaaaacggcgattgcagcctctccagaacagatttgacatgaggccggatccatttgaaatagacttgataagttttcgatgaagtacttgcacgccaaatcggagttcgtatgaagtcgtggcgatcgtcagaagttggtgctgtcctgcagtccgaatccagcctgcgcgaatcctctcccctctggatcctctccattgttcctgagtaaaacaagagtgcacgtgtctctggggtataaagatgatgaacatggactcaagaatgaactcacctgatagttgacttgacgtgcacgagcacgggtaataggactatgaagttggacttgtggagatgtggatgtaccgagggtgttgatgtcctcatcaaaaacaaagtgactttatctgcttgatctggttgccttcacttcagaatgaggaaagtcaaaccaggcagtttttgtgaaactgacgaacaaagtgatgtcagaaggattatattacattagctgaccgacttgattgacccacataattgttcctagaatgggtgcctcagcaatcccctgcctcaattttcaaattctctctttccacgtgcccatattcctttaaatgtaactgtgtccccttaactactagcagctggaacctactctcataagaccatcagtgttatgtaaccacaatgcatgtctttcattgctatatcagaagcaagtgctaggtagtgaacatcccaacacatgtattggttcttttctttctttgttttttgtacaacaattgaataaagtaagttcctaattttttatattaatccttttgctatttctctccacaatatgagaaaagatatgccaaagtaataaaatattaatatgtaacaaactgctggttcaaacctatgaacggtggtgaactgtgatttgataacctgactgttttaacttttgagtactggagatattttttatagattttgcaagcttcattaattttggctgttgatttgtatctgattctagtcctataaaatgtcatcagttatattatttgatgagccacatgataattatattctttaataatacaagcacatgtagagtgttcagatgaattactccatcacaatatatagctacttctagtgctcaaatcttgtcgtcgcaaccaattacaacctcctcattcaatttctccacctaccttctccatctcaaccaatcacaacaatctcgtgtttcacctgtcttcttaatctcagtgaattttttttctagaagtgcttatattttgggaacggagggagtattaaataagctgacaagtcactacatgtctttgtgtcatcagtgctacctgtggaaaagtgcaaacatggcggaaaacttatctatttgtcatgacagttcaaattctggagttaattcttcgtttagcagcacttgcaaaattgttactcaacaaagctgtgaaacatgtggttccataagaagagcagaatccaaagatccaagtgaaggatgtaattgtccaaaatttccttctgatggtagatcaggagagtgttgcaactgctatacccacaacaccaggaaaagaaaaaggttatacagttggcagcgccgcagcaaaaagaaacaggtctgttctgtggatgagtcttcagcagaatggagtaaattaaatggcagtaatttcaatatgtctaatggtccatcggagaacctggctggaaaaatgaatgatcaagcacaatctgtcgagctcacagtagataatacttctttggcaaggagcaatgatgacagttcttcagaaatcaaagtaattaatgctactatcttgtcatcagaaaaatcaccttgttcagtgttcgacataaggggttcccagggtttatcttgtcattacagcctgtcagaagtccagtaccaatctacatgtccccaagttgggccctccagttacttacatctgaatgtcagcttcccagccttctattcttttttttacctcttgcttttaagcttgcatttcattcataatggacaaatatccatttatttaatatttttgtacttctgtagttagtttatttttttatcaatttaatttctttgagaacacaattccgtttagttattttgagaaaacatcttttaccgtttagaaaaactgttatttactgaaaatgtgccagaatcaatagtttggatgtataaatagtcaatgtatgggttggtgtacatatattttttaaaatatactccaacagtagtcctgtaaaccatacaactggaaatgtcatattctgtcttgaggataccattttaggactctaatcaagtcaacgtcttgaacaatatgcttgcattacttgttccttgatgaacttactgtaataaagccatgctgatgttctctagtaattatagtttctttggtttgtattgtttttagaaaaaaaattccttggcattgatctgatgcactattctcttttaggatactgttgtttattgggtatgaacttaaaactggaccctttgctggccctggcatgtgggtagaaattttcactcctttagtgtatatccacaaatcattcattcactttttcttgcacatataatgtttctcataatatgtttttcaatctattcttcctccagagtattcttgaaattcaaaagcacatttctgttgaatattttactgcacactatcatggaactttttaaatgttctagtcgtttcatctttatattttttcttgcagagttgttccatctgcttcaattgtataatatcaaatgcatccaaacatttatcattagattccttgatatcaagaaatggtattttctataacagaaggacaacctatagtgtcttccattgcaaacgtatccttttgctgcttcatgtaccctcaaaatctgtaacaagatttgcgaatgcaaagaagtgttacttgtcataatgatggggaaaaattgagtgaaacctgtgcatgagtgcttattttgtctttcctgttggggcctaaggtgaataggtgatgaggtgtttggagttctggaggaaaccagaagcagtttgtctaggaaagggaggattgtacgatgaggtgatgaggtgtatggagttctggaggaaaccagaaacagtttttgtctaggaaagggaggaaaccagaaacagtttttgtctaggaaagggaggaaaccaaatctataatgttttcttgcttgtttctgttacactagctaatgcgctttttaatagggatttaaatagtactagatctcctacattgcaattcgaatatggaatcttctgttgtgttactcagtagcttgttgctagatgtagattgcaatactgatttcctgtaattttggtagcaaaggacacatttggccatcatctttagataattttgtagtcccattcaattagctttaattaatgcaaagagttcttttcttttctttaacattccgtgtcattgtactgttctaaaattttactatttttatgtaggctaggacatttgattttattacaagtagttctatcaattcagtttttgaacaaagttcaatgggaaaaaaaatagaggattatgcaattggtccattaccactgttggattaacatctcctatgtatggagcgatctttacatggcatgttatagtcacatatcagatcccatgatgtgttgaaatctagcattgcctatgattacagtatgttgtctgagtgttccttaatccttactgctgttagacatattaagcaaaaggaaaaggccagatgctctatctcttgtaaagcacatatttggaatcaatagttgctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15999 - DNA, 698 bp, Oryza sativa
tgtatttaaccacatcggccttacatatcacagcgcattcattggataatagataatgcctcaactttgtgcagagaaatatagacacaaacacaacttttccataggagaataccttgtctctccatccaagagcctgcggcttaaataaaatacagctctctctttcccttcaagctcctgaatcaaaactcagccgattgacttctcaccggctgatagatataatctgaaaggtatacccttctgtggagggattaaaactggaggagaactaagatattctttaatattatccaaagccttatgttggttagcccccagatgaattcttgatcggctttcaatctcaacaaaggtgtaaaaggttccaacctaccagataaattagaaataaaccttataacaaaatttatcttgccgatcatttcctgcaacttcttcttgcactcctgaggttgaatcttcttgaatgcataatactccttttgagttacctcaatccccctctcatgaacaagaaatcccaaaaactgaccaggcgatactccaaagcacactttggcggattcatcttcaggccatattttctagtcctctaaaaacccttcctcaaatccggtatgtgggtgttctaccttcttgactttacgaccatgtattaatataaaacttaaactaaccagccgacagatcat

SEQ ID NO: 16000 - DNA, 1544 bp, Oryza sativa
cgtttccttctctagctgtgcctctcttataggtgctgcatgctatataccaccaaggctcagcaggaaccaagtccctgatgattatattgacaacatagctattgccctggttgacatgcgaaaaatggaacaagtaaaggatggcgctaataacatatgatggaaataatgatcactagtagcgctgaggtaggttatattaccaaggcctcatggggattaaggtcacaaatatcagaaactttgacatttatagcttccttttgaccgaagttagcctctatcatcctgaccacctgtgggttaccgtgaaggcttcaaatgtgaaagaagttagtgctctggtttgtaggttagggaaaagcattgatctacatgacacataaggtagcgaaaaaatatgttgaataaagtagaaggatgtctatgtgtatgaaaagagcagagctaagtggcacctgcttatgagggagattgtttcctggattggtgcgttaggataccatctacagacagtgctaccctgtagggctagctggcctgtcaaagacgaaagaacacatcatgtgagttagaacagtgaaaatatgcaaatgagataggagggataatagaacaggaatttatttcttacggtctcgaaatttaacagttaaaccaacaaataacatgacaacatgtccattgtctgcttgctgctgcaagttttcagcgtggaattgtgtagcatggggaccccataacgccacgacgacagtttctctgaggcacatgaaagatctaagacgcggaaaataatgcagatgactttttaaccatccatatttgctactaatcaagatgccagagaatgttcgtctagaaaaaaaaggagaaacatatatgtttccaagaaatcgatgatgcacatgaaaaaagcaataatgatctatccgtgcataggttgctcattttggatggtagctttcactcacccagaacagaaatatgtttggaataggtaacgtatcgatacgcacataccttccattggttatatggtcattaagcacagctttcataacacctgcataagaaacagtctgcactggcccgatggctgtcattatgcctatagcatctacatgggaatatgagggaggaaaactgtatatgagtaaatgagggcagcaagctagaaatggagaagattaataagcaataatatagattgatctgggccaaggagacttacctgaaataatatctttcttgtaagcccgagctctgagttcatcaaaagaaagaattttgcaggcataagatgggaacgtggatggtggtccagtatcttctgtaacggttgtgtgagcagtgaactttgccatcaacagtcgatcaacaggcctatactgggggcgtgcctcggcgacttcgaagtatttgatgtaatacacagcgccttcctttagcaaaggcttgaattgaacaacgcggcgtcctgggatttgcgcatccatcatgtcgccctgttgatgtttcaatatgtaagagggtgcgga

SEQ ID NO: 16001 - DNA, 3678 bp, Oryza sativa
ctgcagaaatagccacaataaaactaaggtacagcacccataatatttcgctgtacacgatgttcttggtggtggaacaaggatttccatcatcatcttctatcaataacttgagtccttcctttgatgtaactcgcgaaacagcaacatatagctatccatgtgtgaagatagggttcttgaggtatacaccaacatttcctaatgtctgcccttggcatttgtttattatcattgcataacatagtctgataggaaattgcctgcgctggagcgtgaaaggccacttcggactatttccacttaggacaatccgtggaatacagaccagctggccaatatttgtcccagtcatgattttgccctcaaaaataaaatcaccaagtcgagtaaccagtaatcttgtcccattgcaaaggccaagtgattggttgatgttgcgaagtaggacaactgctgaaccaattttcagggatatgtgatgttccgggaagttgtttatggatatcgagtttagaaattctatgggatacaacagatcaaaatccgcagctttctcaagtgtatttgcaatagtgtcgctgctaagatagtcctttgcttctccaggtactttggcaagcatcatatcattaacctcatcaacaactgcatttactagacagactattgcgcgctgagcaagatatgggatgcagtcatagttggtctgaaaatctgggtagacagcatcaattatagctgtaatcttgtcaccatgtggagtaagcaacaattcctcaggtatctgtatctatgtctgtcacaccccaaagttctttcccaagcctaaattgaagttataaatggtctcaagagaatacttgtgtaaagcaagagtaaaccttaataaattaatgcaaataataatcggaactgacatgtggaacttttgagttctacatgtcgaaattcgctaacaagatttttagtgaattttcagagccctagaaataattttaaccaattaaaattgagcaagcaatattttaattccagggaaaatccttttcttcctttttctttttctttttcccccttttcttttcgagtgggccgccggcccattctccttcctcctctcccctccgctgggccggccgcctacctcctcccacccgggacgccgacaggtgggccctacctgtcgggcccgtctcctacctcgcaaccgccatcgccgcacccactcctccgctttccccgcgccccacgccgcgtcgcccgtgcccacgccacgtcgccgccccctctccccgcgtcttccggccgcgcctgcgcacgagaggggcgggattcgattttgaatcgccccccaccttctctctctcctcccccacgtcgccggcgaaatcggggcgcctcccggccacgtccgcctccccctccacctataaaatgctccccatgcccttctctctcgttttccgctctcaccgctccatcccgtgccccctaccgagctcgcgccgccgccgcttgcgccgccgcccgccgccgcactccggccgtgtgctgccgccgctagagccgtcgccgcgctaagccaccgccacccctagcttcgccgccgcaagacctttcccggccgccgctttgcgtcgccggaatcccaccgaaaccccatctccctcgtgtcgccagttagttctctctcccctccgactccggccggcgtggatggtcgccgtgagggtttccctctgtcttaattcctcctctctttttccctaggtgtcgccgtcgcttgtccgcacctcggcatcgccggtcttcgccgcctccctcgttttccaccgccggccgttgccgcccctccggtgaggtctccctccccttcctttccttccctttttttcccgtgcgccgccgccctcttcgtgcgctcgccgtcgcgttcggtcgtcgccgctcgcgccgccgcctgccgtccgtgccgccgtttgccgtcgccggcggtcgcatgcgcgcgccgccgctttgccatggccggctggtcggcttgatgccgggcctggccggtacatcggcccgtggagctggggccgtggggcccgcttgccagccgtgccccccttgagccgctgccgagtggggcccgcgtgccggcgccccttttccctctctcccgagccgctgaccggtgggccccgcatgtcggcgcccccccttgatgacgtcagccctgggaattattgcgcaataaatgatttaaggactttttgttatagtaataaacacagtgaatcttctaaaattcataactaattcatccgagctccgtttaagcccattcaagtctcagtaaatcaagaaaaatgcgtagaatccactaaaaatggttttgttctctgtttcagtagtcttatagcctgtttgtattgtttgctttgtatgtcgcctagattccggttcttccgacgctccggtgtacttcgagatagtcgccgaggttcctccagctgcagagcaaggcaagtcatgcctgtcacttgaacatgttgatcctatattgcaaatgctctattgtttttcttcaaatactgcatcgttttataatgttactatgggatgtttacctattgttacagccatgctattttggtaccctgctcctttgttagctcgggttataacatgaatagacgttggactaggagttgcttagccatgcttagttcaactagcacacaatggggaaatctcatttaaaatatagactgtaggttcatatgataatgttggtttagtaccaccgctttggtgttggttaattaaaatgaatcacatggtgggctgtgggtgcatggttttgcttgtcgcacccatagcaattaaggaccggttcgcgggaaaccctggaagaatttatcgtgcttaccacaagccagcgtgggcaacggctgggcttgtagtgtagcttttctctagctgacgcatccaggcaagggtgggcgtgatggagtttggatgggccctgcgacggcctatgcggcttccggattcacctaggcacgagaggggactgcccatcgcccgctggggacgggggtgaaacctgaggtgtggtgtgcttggctagagggggttatgcgaagggtcctatcacggcctctttccggtatgtcgtggtggcatgtcggcgcacggaaacgtgtcgtggggctgtcttgtgggtacaattgtacacctctgatcagagtaaaactattcgaatagccgtgcccgcggttatgggcggtcaaccagattcaccgtgattagactcaccctagtttagtcttttgaaattagatagtataggtggatggttgggcctgtcgcaacgtggtatagcgttggacagtggatgattaatattgattaattattacgactgttttcttctttaaacttctgtttataaatactcgctttatgcaaatgaaccactctagctctcctttgataattccctgcatcatacccctattccggtatgacttgctgagtacagtgggtagtactcagtcttgctctatttttcccaaccccagagtatgagtatgtgtcagatggaggtttctccgaggagtaggcttcgtccgtgccgttgagcatgcctgtggagtggtgttcccgctgcagtttagtcaaggg

SEQ ID NO: 16002 - DNA, 863 bp, Oryza sativa
agagttctatccagctcctttgagcatagcttgtttgtcataggcacctcatcccatataatcaatgatgccttcttaataagatctccaagtattgtacctctacgaacaccacacatggactgatcatgtatatctataggtattcgaaagcgtgaatgagctgtccttccaccaggcatgagcagagctgcgactccagaagaagcaactgcaagaacgatctcgcctcttgacatcagccttgccataatagcattccacaagaatgtcttttctgttccaccatgtctagatataaagaaaatacatttttccttatgagctagcctgtcaaagaccttgtcatatatcttcttctggtcatcattcaagctggcatacatggacatagactcttcatggaggctgtcttggttgaaactaagctcttctaaaataagcgtatttcctgcactggtatccgaacattcagctggtgtcgggagatcgaatgatgagattaataagccattatttgagaaaatgccatccaattctttgagcaaggtgttctgtaacataacatccggaatagctctacgctgtactccaagagctttggttagcttgtaagcaaaatcatctgccatatacttccagtatttatcaaacaaaaccctaacatcacctacatcacaatgtgctagaacagtcatgaataggttcctgagttggtatgcagtagcccagataactgcctcttcaaagagatgaacccattcagcatcatcaccaataagaccacgtgcctggcaagcttcacgataggtgctatatgtcacaccttggtatgtcctgacatcttcaaaagtcatgcaacc

SEQ ID NO: 16003 - DNA, 3006 bp, Oryza sativa
  unsure (1)..(3006): unsure at all n locations
nnnnnnnnnnnnnnnnnnnnnnnnnnnnnnnnnnnnnnnnnnnnnnnnnnnnnnnnnnnnnnnnnnnnnnnnnnnnagaagaccaccaacttcaagaagaagaacaacaacaacaatcctaatcaggatgagaggagttgctttgtgtgtggtcaacctggccatctggccagaaagtgtccacaacgcaaggggatgaagacacctgcagggcagacctctaagtttgctaatgtgaccattggcaacactggagatggaagcgggtatggtaatttacctactgttttttcagttaatcagtctactaattggtgggttgatacaggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaatgtgcagcatgtcccttctatcgacaagaatcttgttagtggctcccgtctgactagagacggatttaagttggtttttgagtctaataaagtagtcgtgttttaacatggatattttattggtaaaggttatgagtgcggaggtctgttccgcttttccctttctgatttctgcaataagtctgtgaaccatatttgtggcagtgtggatgatgaggctaatgtatggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggagagaaacttggcacctctagaactcctacactcagatctctatgaaatgaatggggtgttgacgaagggtagaaaacgatatttcatgacgttgattgatgatgctactagattttgctatgtgtacttgttgaaaacgaaagacgaggctctatactattttaaaatttgtaaggcagaagttgaaaatcaacttgacagaaagataaaaagacttaggtctgatcgtggtggagagttttttctcaaacgagtttgacttattctgtgaggaacatggcattatacatgagaggacgcctccctattctccctagtctaatggggttgctaaaaggaagaaccgcacactgaccgacttggtgaatgccatgttggacaccgcgggattacctaaggcatggtgggggaggcattgttgacctcgaatcatgtgttaaacagagttcctaatagaaataaggacaaaacaccatatgagatatggattgggagaaaaccatcactttcttacttgcgcacatgggggtgcttggcgaaagtcaatgtaccaataacgaagaagcgcaaacttggacctaagactgtggactgtgtctttctgggatatgctcaccacagcattgcctatagatttttaatagttaaatctgaggtacctgacatgcatgttggtacaattatggagtctcgtgatgttaccttctttgagagctttttcccaatgaaggatacacatagtagctctagccaaccctctgaaataattcccagttcaatcacaccaccagaacaaactgaacatacacatgaacattttactaaggaggatgacagtgaagctcctcgaaggagcaaaagacaaaggacggttaagtatttttggtgatgatttcactgtgtacctcgtggatgacactcctaagtcaatttcagaagcataagcatctcctgatgcagactactggaaggaggctgtccgtagtgaaatggattccattatcgctaacgggacttaggaggtgacagagcgaccctatgggtgtaaacctgtggggtgcaagtgggtgttcaagaagaagctcaggcctgacggtactattgaaaagtacaaggctcggcttgttgctaagggttatactcagaaagaaggtgaagatttctttgacacttactcacctgttgctagattgaccacaattcgtgtgctactttccctagcagcctcacatggtcttcttgtttatcaaatggacattaagctaattagaggtgagaatgggattacactcttgcagtcccattatgtggagaagatcttgaatcgttttggctacattgatagtaagccttctccaacaccttatgatcctagcttgttgcttcgcaagaacaagagaattattaggaatcaactggaatactcccaaatcattggctcgctgatgtacctggctagtgcaactaggcctgatatctcctttgctgtgagcaagttgagccggtttacctctaatccgggagatgatcactggcatgcgcttgagcgagtaatgcgttatctgaaatgtactatggaattggggcttcactattctgggtatcctgcagtactggagggatatagtgattctaactggatctctgatgtggatgagatcaaagccactagtggatatgtcttcacactgggtggtggtactgtttcgtggaggtcttgcaaacagactattttgacgaggtcaaccatggaagcagaactgacggcactggatactgctactgttgaggcagaatggctgcgtgatctattaatggatctgcttattgttgaaaaaccagtgccggctatccttattgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgagggaccccgaccccttaaggaagtctgcgccacatatatgggataagtgagcacagctgtgctcacctaacagcatttattgcagtctggtcaagcgtgtcacgctgcatg

SEQ ID NO: 16004 - DNA, 17176 bp, Oryza sativa
ccaggtttcatcctaaccataccaggcaaggtgttaccgaacaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggttgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggactttttcccttttggaaggctgaggggaaagggagttaatcctttgtaacttgtccatacacaaatccacaaaaacacaggagtagggtattacgcttcgcagcggcccgaacctgtatagatcgccgtgtctcgcgtttcttcctagcaagcgatctttccacatacagagagagcttgagatctcaccctaagcccccggccgaaccggcaaaggggggcctgcgcggtctcccggtgaggggccacgagctccgtcatctggcgcgccaggtagggggctcagcgtgtgttttctgagctctcatactcttccgtgtgcgccaagtttcccttgttctgcctaatggccgagcaagcaaaggcgcacgacctctctccgagtgtgagcggcgacgacggggagccaaacccacgccgtcgagctcgtactcccccacctcctccacaccaaaatcctaagcagggggaggcactcgagagagtcgaaaaatccgcagcatcgctagtcgcgggtggtgcaggagaacggcgagatggggagcgtcgcctcctcgtctacggtgacggcagcacgcctcagggcgcgctccaggctgttggcgcgctcctacgtcacccgcctgtcgtccctgacccggagtctccagcccagcgatggctggacgacgtggccaacttggtcatgacggcacagcagcgcctgggtgctggtggacggtccgccaccaccaagacctccggcgccgccaccaccggttccgtgtcatcaaggcggagggcgcggcgagcggcggcggctgcacgtcattcggctgccactccctcgtcgacgccttcgactcgggaggatcagcatggggagccggatgcccgcctcaacatcgagcgccggcgtaacggccggcgtactccccgtgcaacggagggcgcctcctcgtccagagtgtcacctccacatggacgtaaggaccagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacttatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcataaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgttccgcgggccacccgaaaggggaggcctgcgagcgacaaaaagaaagaggctggtactcccagcagggagcgcccagccagcaagtggtgctccgtccacaacacctccctccacgatctcgcggattgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacattgatgacggtgatgatgacctaggtttccaggaacccggggccaccattgccactgtcgacgggggagcgtgtgctcacgtttctcgccggagttttaaggccatgaggcgagagcttctggccgcggcccctactcatgaggcgacgcgccaggcgcggtggtcggaggttgccctcacttttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccttgcctcgcatagatcagatcgtcgactccactgcggggtgcgaccttttgtgttttctagacgcatactctggttaccatcagattcgcgtggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgttgatgatttggttgtaaaaacgcgcaaccaagaaactttactttcagatctggcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcgccggttgcatggccgccctaagtcgtttcatatcaaggctgggagagaaggcgctacccttgtttaagctcctcaagcgctcggggccgtttacttggacggaggaagctgagcatgcccttactcagttaaaggcatatctcagctctcccccggttctagtcgccccggagccaaatgagcccctgctactttacttagcggcgaccccccaagtagttagtgcagcgttggttgtggagcgcgatgaagacaatcctcatttcgcgcacccccgccctgtgctgacttggcccgggagcgagcagggaggagaagcccccgagtcgaacggtggcctaaggcccctgacgaccggagtcggccctctgcccgcttgtcagacggtgctggatgcccccgaccctcaggaaggccccgaggccactgcgggaaggccgcacctatcgccctttggccccgaggctaaccctgtgctgactcgacccgggagaaagcagggagaagaggcccccgagccgaacggaggcctgaggcccctgacgaccggagtaggccctttacccgcttgtccgacgacgccaggagcccccgacccccaggacggccccgaggccactgtgggaaggccgctcctgtcatcctccgaccccgaggacatcggcacagaaggcgagtgcgccccgagaggccacttggacgaagaatgccccggggatgcggcccctagcaaagagggtcggccccgccgaaaggtgcagcggcctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcgggcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatacccgaggccagcacggacccctctcagctgcctcgcaccacccactgggtgatgcagttcgacggttctctgtctctccagggcgctggtgcgggggtcacgttgacctctccaaacggagacgtcctcagatacctggtccgcctcgactttcgagcgaccaataatatggcagagtacgagggactccttgccggactcagagtggcagccgggctggggatccgccgcctcctggtgttaggcgactctcagctggttgttaaccaagtctgtaaggagtaccggtgctctgacccacagatggacgcctacgtacgccaagtacggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggactgcgaagggagtgaacgcgtacaacgcatttccaaacgctacgtgttggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcggtcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttagaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgtacggctggccacgggcgacggcactgagctgccaaacccgtggaacatcgaacaccttcgtcgcttctacccctgacgggggggatcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttaccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacataagaaatttttcatcatttttgattgcagattaagttgatctatacaaaaagaagaaagaaaaagaaaaaattggagattggcgggggcctgggggctcattccaacgcgcccgggtcgccggcctcgtcgccaccgtcgtcctcaccgctggcgtcgccctcctcgtcggagctgggggcgaacgcgagccgaggggccgacccctcgaagctttggacgatgtggttggcggcatcccggacccgcgcgcgcgcatcgtcctcggtcccgggggggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgccgggcccaatctcgcccgccaagcgaagggcctcggcctccccggtggaggagtccagcgctcgctgcatatcggcgacggtgtgttcggcagctgcgaggcgggcggctaagtcgctttcgcctgcggccgccccaccgatatgcgccctcgcgtccagctccttttcccgagcctcgaggtcagcagcccgctgttccagtgcggctctctcggcgcggacgcattcaagattgcggcgcgcctgctcctcctgcgccacctcgcgaagggacaggctgtccgccagccatttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagcctctgttacccgccgctctcgggcagcggtggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctccgcggccgcaggatcttcggcctcggactggccggacttggggtggcgggaggaatgcgacgggacatcgctgaagcagaagaaaaaaccagaagacgaacaaaatgagtaagaaaaagcttccttttgggagaaagatggttgcaatgagagtgagacgaacctgcgagggggtcggttgaatgaccaccttggaggggaaatcaggtttccccggcatggttccgtctcccccgtcttgcgaagccgtttctttttgcgctccccctcgggctgcgacgtcggcgcggccccctccgggcgccgactgctggcacgcgccgccccgccccctcggggaggagatgggggaggtgttcctcccaacttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgtggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgtgcgcgttaattacgctcgccgaccgaagcggcgttaccgtatctccgggcgagaccaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgagggaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggttgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggactttttcccttttggaaggctgaggggaaagggagttaatcctttgtaacttgtccatacacaaatccacaaaaacacaggagtagggtattacgcttcgcagcggcccgaacctgtatagatcgccgtgtctcgcgtttcttcctagcaagcgatctttccacatacagagagagcttgagatctcaccctaagcccccggccgaaccggcaaaggggggcctgcgcggtctcccggtgaggggccacgagctccgtcacttatgaactgtgacaatcaaacggtaattgtcaaagtgaatagttctaaggataatatgaaatcgtctagacatgtgaaaagacgattgaagtctgtcagtaaattgagaaactctggagttatagcgttggattacatccaaacagctagaaacctagcagatcctttcacgaagggactatcacgaaatatgatagataatgcatcgaaggagatgggtttgagacccatgtgagttatactatggtggtaacccagtctatgtgatcggaaatcccgtgaattagaacctgggaagaacaaaccattagtaaactagaggagagtaccaatctatatgtaacatcccggcctagggcttaataggattaatagaatactcatatcaacaagttgcaacttcttttccggaagccaatctccaaagaactccagggttaagcgtgctgcgctggcactggacacatggacgtggccaagagaggacgttcctagcctagggttgatcgacgggggcgtcgatctctcttaagggggtgagggtgtaacatcccggcctagggcttaataggattaatagaatactcatatcaacaagttgcaacttcttttcctagggcttaataggattaatagaatactcatatcaacaagttgcaacttcttttccggaagccaatctccaaagaactccagggttaagcgtgcttggcctggagcaatttgggatgggtgaccgaccgggaagaatttcccgggtgcacacgagtgaggacaaagtgtgcagaaaagacatgtgttggtcctctaagtgaagatgcatgtactctcatgagctggaaggcaggttggctatgccttaatgagttctgttggctttaattagcgaagatgctgtcttgcagagcattcttgaaagaactcacctttgtaagcttgactgttggtcgcagtctatgaagattttgggtgaatcttttaggaagcttattaaagacctaggagtatgacttatacgctccacccgaggggtagtctacagacggtctagtaccagataagactctgagtgaaacttgcttgcataagacttgtaattcaagacgtagtccattgttcaagttgtgagtaagtgtagcttggagttctaggtggatgttcaaccttgatcggtctccatcgaaccgctggtatataaaagtacattggaaaaggcaaatcttagtgggattttgagatttggtgggggattgttagaattaatagatgggctaaggcccattcgaagattaattctttgaaaaatcacaaaagcccacctcatgggatggcatgcatgtggagtttagtaccaccttgcttattctaggagagggggacctccttaaaagggaggatgccctcctagcttcttgaagcatgtgtggtggagagaagagggggaacacgcgctcgctcgcctcgcctcgcctcacctggcctggtagggcaggggcagggcaggcggcgcgcgtgcacgacatacgcgtcgaatggtccgcaaaattggctcctcacccttgcacagatgcagcctccttttgcagttttgttttgctgtaggaaaattcggatttgttttgttttggaaacattccgaaaaatccgctgcgtgaaaacggcgtggagtccggataagttacgcgcgacttatccggttcggttacgcggagtggagatcgtgcgggcgccctgatcaagcgacctatctctatataaactgagccgccgccttcacgcaaaacacacgaaatcaatctagggtttgcctcctcctctgtgctgcgccgtcgctcgtagactactccaccccgctcgctggcgtgcacctgcgatcgggagagcaggtctcaggaacctctgccttcgacgtcctgcaccgggagaaggcggcaataaggtttttgggaagcgcttcgcgcgactgctcactgttcgtccacgacggctcgccttcctctccgctcgcgtgctgcgcgccttcgtcgacgctcgcaaccgcgagtagttcctgccgagcaaccggtctttccgccacctcggtacgtgttcgacatgttgcgtatatttgatctgttcatgttttactgcttagtttacatgtgtaaatctaatgatacattaatgctagtatacatctgtaatgtcatgatttatttatggaatatattaaatcattatatttctatattctcaacacacacaactccaggtaccttagctaaagatccaagctcatcaatcagtgaatgtgcttttgcaacttaactacagcaaggttaggtaattaggtccacactgcacatccttcagtggaactattggtgcctggcccattttcctgagctgccgttgaattgaatcttggtgccgccaagacgaggcaagctaagacgatatatatgttgtaggctagctatagctagctacttccctcaatctagctacagccatgcaacacaatttgcctgagttaatttgctagcatgcatctgcttgaaattacttcaacgagttatttagtaggacatgtttccttatttattaatttatgtgggttaatatatcgttcagaaatttcgttctaccttaatataagagagccacgtgagaaatcgaaattatgactaggctttaaggaagcatgccaacgcataatgtgaactagctagagactcatcgagataggatagggacttagagctaatcgcacaactacatgaacaagtgttctgtaaaaagaaaatagcaacactccttaccaataaagcagttatgacagcacacccaaggacttgaaaagtcattaattgtgctcacctaacgtggaccaccgtgcttctcgtcgttactaacccgtgttcctcggaataatgattaattcaatcaaactaacaagcgcttcaagaaggtaaaaaattccaatcaatcgatcggctttaaattgagaagcatttcattgtagagatcgagaataatgtggaagtgtggctctggcacagtacgtacatttccctgggatgggcacagtaggatgctctgggattttgtttgcttttgtgggaagtgtaagaaaagctgcctgctgcatgctgctatgtgtgcagccaagcgcacagtaataactagaaattaaagagagagataaaagatattgagatcgatatgtgtgtgtggagttgtggaccaatggatggaccagctagctgctgatcgatcaagatataatataagatagtatcatgcatgcattgtggtaagatatcgatctctatatatatatctctctccctatatataaagaaaaatataaaaaaaatacaaagaaaaatatttatcggctaataaattaatcaaattgaacgtacgtgcgtaccctctcctaccgtccaaagttgctttgtcgcttgatccatcacatcagctagctagctcgatggatcatgtcacagtgacttggtgtccatgcatgcgatccagatcgagccagcctgatatagtaacttaccactcgttgaccgcactattaattactacctccattccaaaatatttaatgccattgacttttttaaaaatgtttgaccgttcgtcttattcaaaaaatttaagtaattgttaattctttttctatcatttgatttattgttaaatatacttttatgtatacatatagtttcacacatatcacaaaagtttttgaataaaacgaatggtcaaacatatttaaaaaagttaacggtgtcaaacatttagggaaggagggagtagttcctccatccgttttcacaatgtaagattttataggattgtccatgtgtctagatttattaacatctatataaatgtggacaatgctagaaagtcttacgatatgaaacatatggagtaattaattaattccctaaatcacaaagaaaaaattaacttgctcgttgctactagtacatgatgttgtctgcatcaactaaacctacacataactattttagagctcatttgaaacgcaaactagattcttaaagtacaagaataggaaaacacggaattaaaatgtcacaactcacaccatgataaattctatagaaaacaatactaccgaaatgtttgaatgtaccacaagaaaaacacatcatatttaattaagttcacattttgatttggtagagaaataatgcagagagaaagagagagaatgcatcggaagtccgaaaggaatttgcaaacctaaagttagacttcatgctagaattccgccaaaatctggagtattaattactttaatgcagtcctacaaaccaaacgtgtgcacataggattttttttcctttggattgagttcctctgcttttcttccaaaattacttaattcagtacaaaggagctattagttttaattttaaataaaactaggatcaaaaccatggtatgtagaatcaagtagtcatatccttcagtaattttgacatacaatgcatccttagcttcagtaagctcatcaatggatcataattttctggtgtagtttttatctcatctaatcaatcgacagcaaaaattgtgcaaaaaaaataattttctaaccgtgtaaagatcatatgtgaagattgtagatatcattggatgccaataataatgcatgctaataacctgcagggttgagaccttccgcacgccctcgccagttaatgggtccgaccatattgtaccaacaatatactaggacaacactaataataacaaatgcaagtaaatcatgcataccattttttatatataaaaaaaaccacatgcatgca

SEQ ID NO: 16005 - DNA, 717 bp, Oryza sativa
tgtccatgccccgttttcagacatccctgaacaaagagctcgcaactgggcgcgggcaaggggtaaggtcaacccggatggctctgtcacatttgagaacaaaagagatgccgtcgtctatcaggaactggtgagttcactacttaacctaactaatttccgttcgtataaagtagaagttcgtataaatgactcttttttttctagttgggcttggttgctgaacaagcttcacaaagcaaggttgagtccgcgccgaagaggcgcgaagatgacatcctcacaaaggcgctcggaaccaaagaacatcctggccggactaggggaattggtagcgatgtgccctggaagcatggactcccgcagtacagttcccaatacaagaaacggaaagtctccaaggaagagagggacgctcgtttgaaggccgaacttaaggttgaggtcattcaagaactagaagctagcatgaacgctagggtggaagaaagggttaacaaggtcctcgccgacatgaatataccccgaggcacaacacctgctgtgcatccaactcctcgtgcacaacacgacgcgagtccgtcacagcataggagtagttgtgcatccacagaggtgctggcccctggtctccccgtcgcaccactagctgcagtggaccacatagaggtaattgatgttatctgatccatatctaataaaaaagcgggctgcagg

SEQ ID NO: 16006 - DNA, 704 bp, Oryza sativa
agtccctctcaaagaataacatggtacgcagcggaaaataaaactataacaaactacggaacagctatggcgactccactccacaggcatcctaaccagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaacgaatatttaagagaatagtaaaacagttgtaataattaatcaatattaaataaacaccatacaacacacccatgttgcataggcccaaccacatttgaacaaccaaccccagttgaacaaattaaacctccaaaccaggaattatccattccaaaccaggagtcaaattaattaccacattattaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttggggacaataccccttgcacaacataacccattacagcgcacctttcctggatcataatcacccccc

SEQ ID NO: 16007 - DNA, 6169 bp, Oryza sativa
ggggggggatgcatccatctacagttggtgtgtggggcgaacagttgcttcgcgctgtagcttgtagcttgtgtggtggccaaataaatactatcagctgatcgatccatggtctctgcgacgaccgactcaaaacacgacgcgtttgccacctagcagctatatatcttcctttcctttgctacctcgatcgttctcgatatctagtatcgatcgatctgactctgcatgcatcccactcatatacataccgatcatcgatcgagcaatcgaactctctgctctctcatgctcatatgctatcatgcatgcatgtgagagagagaaaaagagagagattcagagatcaatcgagctggtagtagccggccagtagcactgtgagtgcgtgcactactagtgctcctgcaggcaaggctggacgggagtgggagtgtgtgtaccagtactagctactagtgaatactgaataggcagcagcaacagcagcagcagctaattaagcatcagacagaaactagaaagagcgagcacgccactatggatatgatggaggaggaggctgccaacgccgccactgctcaagctgctgctgctggcgacctcgccgacgtcgtggcccgtgccaatgcacgcgcattcctcgtctccacccctcaccatcacccctcacctctgcatcctcttcctcctcctcccatgcctcaggcgcctcaccaatactatcccgccccccagatcaccatcccttaccaccaccaccaccacggagagcttcggcgccctaccaccatcgcttacaccgacgcacctgtgccgttcgagacggcggggccgccatccacggtcgtcgactcataccaccacctcacacccggcgacgccggctacgggatgccgcggccgcttgctctccagatctcccagcacgccctctgtggcggcggcgacgtggtgatgggcggcggaggcgcaggcgctgccgatgatggagaagaagccatcaggatctcgccactgacgccgtctgctcatcatcaaatgatgaaaaggtttggcatgctagctagctcttaacattattaattagttctctaattaattggattcatatttcgatcactcctcttcttccttaatgtatacacatcttggtccttccttcaattgatgatttgcatccctctgatcgatcccggctttgtgttaccgcttctttttatcactttgatctttttattagttcatgcatgtgtgtgtgtgcagatatctttggctctcattttcagcattcctttcgatccattacatatactgacagattatatatatatgagtcgtcattaattctgacttcatcacctttaagcaagctagcaggatttcatggattggcatttgatgcttgcaccccctacccatatcgccaaattaatattaactcgatcttactcttctcagagttttactcctcgcatatggccgttttcagtattaatgctcatatctagcaactgtacatgtacacataactctttgacaggtttggaactaaatcatacttgacttcagttcctcctaatttgcttttcacgtttctctaatgagcgaggaatacttacatcaatcgatttccaattaatcaaaagtcttaactatttagtgttagtttattttcaagcaattaattaattacttgcttgcatcctttggcatatatactacaggaagaatgaggtgaagaaagtggtgtgcatcccggcgccgccagcgacgagtagccgtggaggtggaggagaggtgatcccgtctgatctatgggcatggaggaagtacggccagaaacccatcaaaggctctccttatccacggtaaaccggccacattttcatctgtttcttcccctctttttttttttaacacgcgctcacttaatcgatctgttcatatatatcttgtacctaatgacccgattcatacatgaagtttatttgcatcaagatctcatcaaatatctttcaatcattcctattcctcccattcttgataaacaattaatcactttctgcataaatatttttatacttaatgaccgatccaatttatacgaagtttattggaatcaagagatatctcatcagatatatatgtttcgttcattcctattgtgtgcttactgcttagttatattatgttccctctaggtattaattatattcattttatattatgtaagttcattaatatttattgctcatatctctgcaggtactgtatctctgggcaaaagcatcaaaatcatggccatccttttttataagctaattaactaaaaaacaagcagcttccatatttcttgtttagacaatttcaattggtttgtcataattaaacaacttttgaaatatatatatactgatcccctatgagtccaagtgtaagccatcttagccttttttaaactctaaaagtatgttgtttcaaaatttgcaggcatcttttaatttcaacttatatttatggtttcggtgtaaaaaaacttatatttatggtttctcttgccaaataaattatatttttctcataaataaactaccaatattttccaaaacaatataaataaagggtaacaaaagtcgcttgagctatttttttttaattcttgcacataagttttaaatggcttacatatggaataaggaagtacatatatatctgtacaccccccccccccccccaattttcaattcaaacaacattttttgttagtaagccacaactttgggtttattacttagctagattacatgaagttccccattatttgcttgttggcttataagtcattgacacaatttaaattgagttaattgcactttggtccatcttttattaccaaagtttcactttttgggctaccctctagctaatattttcactttagactaggtaagattatctttgttgcagtttggaccaccccaagtcacttttctagtgcatctaccctctaatcttgtgaataatagtctacatgtgagccaggaagttagcggtttatgggtgttgatgtggttaaagtcatttatgtgctcgagaaaagtttttgggatggttcaaagtgaaacaaaggcaaactaatctagtccaaagagaaaagatgttttaaagggtagttcaaagtgaaactttggtgataaaaggtcatttactcatttattttaaagttaattttaaattatcctccttttttattttaaacttatttccaaccttggctttttaccactaatggtataaatagtatataaaaggcctaacctaaaattattttcggttgcttcgtttacttttgtataacttatcagccaaagccaaccaacgtgaatagaacccaaaattaatttactgcacaatacacatttaatataccaaatctccaatgatccaaatcaagtatacaaaacatttcttttagaaaaataattcgacagcatcataatagacaatatgcttgtctattattgattaattatttgtgtagtgttgggtttcaaacttccaatggcacttgaacgacctaataagggtttggatggatatgtatggattaatcaaacgtatataatcacttcagattgtgtcggagtttcaacattgtaccgtctgaaggttatatatacacctatgcccaagcaatccctaaaatgtaaatctatcatcaatgaattcttccatatatacatggggatctaataagtgattcatcacaattatgacccaatgtagtgtcatttgtgagaaactaatactcccaattgcaaattgcgtaaatcaaacattattaattgttgaaatagtagatattgcaagactgccacaaattaagttgcttttacttttgaggcaaaaattggaacaaaatagctatgtttgccgttttcaaattaatttaaaaggtaaaaatgaaacttcaagtacagggatcgataagcttaatttactcacaattaattaaatttctcgatgaattaacaattattctggcttagtggactcagtttgacattactgtgccatcttcaaatttgatcaaaccattcatacactgcattctaagggtatatatatatctaggcacaataattttatatatatgcggttgatcaggaaattaattaaaaaataataattcactgatgagttgattttgtgggcggtgatgatgcaggggttactacagatgcagcagctcaaagggatgtatggcgaggaagcaggtggagcgcagccgcagcgaccccaacatgctggtgatcacctacgcggcggagcacaaccacccatggccgatgcaacgtaatgtgctcgccggatatgcccgttctcatcacagtactcatgctactgcctccagcagccgccacaagcaacagcagcagcagcagaccaaccagctgcagcctgcactgatcacaagctcatcgtcttcttcctcctccccattcaatctctacgccgacgtcgtgctcggtggccaacaggccaacatgatgatgacgacggagggcgccggcgctggacttggcatccaaccttcagcagctgatgaggtctttgcagagctggaggagttggagcctgataatcctactatgatcaatgcaaacatgcaggtgtactccaccaccagcaggccaggggtaagcagctatgatcatcagtggcacaagttctaataattaaaccatgcagtacctatatatatatatatcagaacttcaatattcgagagaggagatcagaggaaattgaattctagcacgtacaattaatacatcatgactatgcaaaatttacatatatatgatatgatggtcgcctgtgcgattattagtgaccaaattaaagattgtcagagatataggcgtgtacttacgcttatatgtatcacgctgaggtatactgtatttacaagaagataaataaaatatccatatccctctagatgcttttgattggtatcctgtatcgactgatccatatatatgtgcaatatattagctaatttatgtcattagtacatgcgtgctatattaagaagagatagatggcaaaaaggagtcacgtaccacatctttttctggatggcttaaaaattatcacattgataggataaaaggatctatattaatttgcatcatttggttgtcatgctaagtgggctggaaacactaaaaaatctatgttggagggggcaatagtgttagtttttttcttcaaaatttcctcgagctagctataaaattcaatgtaaaatttgaagacaaggggaggccgagttggccccttcgccgtctccgtctccgtctctaggtctagattagattataacgggatagatcgatcaagatagttatagatgtatacatgtaaacagatagagatgtatattaaatacagtacgttctacttttaaatctagttctttctgcacaaaatctcgcatgggaggttaattagttaaaaaaaaacgtgtacatatatttgtgctttcatgttcggatatttgaaatacctataccactttaaaagaaggcaatggtgcatggtggcaaccaccgcccctatcaatgacatgcaggttctcaaatgtactctacaataagaagactactagaaacagcttgattcaactagatagagaagtggatatattattgtatatcgtctatatatttttcccacgtgaatatgtaataccgtaccatatgattctctttttaatccgtaacaaaatacgggcatattctagctactaatatgtacatatatgaactgcatgcagtccccattagtagtacttaatttgggaggtagttatattccatctgctgcaagttttcatactttgcacatgagaaaaatgaatgaattagtctggtgaaaaataagatgaagaaaatgctttaatgtggtggtttaattttttgctttgcttggttttatggtggtttgtagtttctagggttggcttacactggtggagaacggggctttactcccggttcgtaacccccctgtagtcccggttttcaaaccgggactatcaatccgggactaaagattgggggtgaaaaaaccgggagtaaaaatctatttttagtca

SEQ ID NO: 16008 - DNA, 1538 bp, Oryza sativa
ctgccggcacgccgccggccaccaggccctccactcgccggcgctcatagaggagaaagaggaaaaggagaagaggagttagaggagagaagttaaaaggagaggaggaggaagaggaagagatatggaggaagagatatggaggaagagataaggccagtgaggagatagaatatattaactgctcctcctcctcctcgatctggcctcgtactctccgccgcccatgttgcgcatgccgatcttttattccggttggtaacaccaaccgggactgtaaatagatctttagtcccggttggtgttggtgactaaagataatagggatcttttgttccggttggtgttaccaaccgggactaaaaatagatcttttgttccggttggtaataccaaccgggactaaagataaaaaaaaaactctaaccttttgaaccgggactaaagatatctttagtcccggtttttattgcaaccgggaatattgtgtattttggccgaccgaccaaaaatggtttttccaccagtattatgtgctgatagagttgggtttttatttgccgatttttcatcaattaatcgtatggttgtttggttttttggcccatgataaactaggccaactcctttttcttcctaatataaaacatgaactccctgtcctccttctcgaggtttaccccaaaaagaaaatgctttaatgctttaatatgctcatatagacatatatatagatattgtacagccccccatctttgagaatatatatatatatatatatacatggattgggtagataattcatgtatgtaatatttttttctgaaaaaaaaactttcaaccctcaaccctcttattgttttgttggttggtccaagcaagataatttaagtaagtgtggttatgcttctatatatgcaagctgaattaagctagcatttcatcgagacctagctataactaatttatcgatataaaaatgttctcgagggcaattacacatcattcaaaagttggacttgggggctgttatttttctttagttaaatgtgtcaattaattatgtaccagaatcttttgttgattgaattgcaagttaataattacttgtttggtatacaagaacgaatgccactatatatatgccggtactggaatttcttagggacgatcgagaataatcaattcatcccaaatcggattaattcttccatattcccagtgtggcatgcgttagccattctatatgctcctttcgttaaaaaatatattgtgtattattttgttttgttagggcaagactttgacaataattactctagcaagatatatatatttaacacaaaattaaagatacatgttaaaattgcttacttacaataattgtttttatataaaaaaacaatggaattttttttaaggtgctccaaatgttttcactgtccattagactagaatccaatggtatattaccttgttctgggtaggatctcataataaggaaagaattaatattctttaaagtggggccgcaggaa

SEQ ID NO: 16009 - DNA, 3930 bp, Oryza sativa
tccctacacaggtacatataaatataaccatctctttataccagatcaccaaatgaaataacaggcattcaaatccctaccacatcaatcatctgtatttttttaaaagagacatgacctattctagagagctcaaatagattgaggtcatcgttcaattaacagcctacacagccaccttgcaaactgtaaaatactattggccattctataggcttccaagccaagacagattaacttaaaaataatcgtgccactaaaaaaacacccatccccatttccattatatcgagcagattaaagaccgagccaaactatcaccacaaattagtaaagagcacacctcaatccacagggttaatcgctgtatatgcatacataccttgcacaggttcgtccatgctagctaaatgtcctttggctaaaccgctaagatcagcagcgccgccgccgcatcgattcagcgttaaaaaaacagccagcactcctacatatataccagccccaacaaaacatatgcaatgacagcacaacacgttgccctaggacatccatccttagctaaaaaaggccttgcatcctgaagcccaccagcagcccactatttatactcttgcacacctttaagagcccaacgtcaaacataagcacaaaagcctatagctccttgatatgttagcccgatcagcccacgataacaacagagagatccaatgcttactgctgcacgacctaaatagccaactaaatacgacctaaacagccaacttaaaaagccgttttccatcaattgttacatcggtactgatcaaataacacgaatcggttataaaccgcgcggcgcagcgcgcgaacccgctctagtatatatagcaatgcaacatataatagcactgacatcgagttggagatgaagatgaacatttttataaaaaaaactcaacacatgacgattgatttagctagttagcactctaattttaatgcctctgcattgcaagttttgttggaaccatttcttttcatgtgtaaacagtgtactatcaagaagggatgaattggcgtggtgaaaaataaagaaattaacttcaatccggctcgttatttactgatgagagttttgcggacaaatatgcgcgctcttctcttaagtctgaacgtttctgtttaaaaggagaggcgaaaattacaaacaaacgaatggattattaacactttatagggtccctttgaaatgaaggattgccatagaaattttggaggattcagttttctatgaaatttttaagtatggaatcatttaattcataggaaatggtaagaaatgtttcggaggatggtgtgtgtgtgtatcttaattaatttcatatatataaataagaagacgtcatatctgttggaaacttttctcttcttccttttgttttctgtgatgctatcggaaggctccccttctctctcttatctttttcgtttatgtaggattaggataagagaaacatgccgttccaattaatttctatgtttttttttatttttgtgttttcatatacaacatttcaaagagcgttaagtttatcaaaacatgcttcggtagagatcgaatgctacataattcacataagtagtcatctagtctgattcatcactatactagcttagatagctgttgaaaattaaagagcatatatagaagagaatggcgctattcctagtaggtaggtagctgtgctgtctagtgatatagagtacttcatccgttccataaaaaatcaacctagtattagatgtaacatattatagttagtattagatgtaacatattatagtactacgaatctgaatataactttgtccagaataatgtatcatatctaattctatatttgtttttttatgaaaggagtatgtatttgcttcatttcttgatttgtatttttttcgttccaaaatagtttaatctaggattgttatccatgcacaatgaagttggataaattttcatatagattcgttatattaaaataggtcatatcatattctacattgagttatacaggaacggaaaaagtactgtcatatggtagccgctaacgaagatatattttcgttggtatctgacttaagccggctgtcatagtgactggacccagcgaaaacatattttggcccaaaaaaacccatttccgttccttgttgtgtgcccggccagcctctcgatgcgatgcatacatagttttattttcttctctttgtttattaaccgagcgtacccctcacattattggatctccaacaataattggtactactgacattcatatatatgctaatatataaagctatttgcatttaatttaattatatgactagctagtgctacgacattctgattcatgaatacataactgcaattagcgcagacaaatttaggtaattaatatatcctaattggatatatctaagctataaaaacagccggccatcccgtccatgcaacactgactactgactagctatagcagcagcactactgttcttcataattccaaggtaattaagctagcaagcaagcaacagagatcgatcgatcgatcgatcaatggcggcgtcgtggagcgagagtgaaaacgcgaggttcgagcaggcgctggcgacgtacgacagcgacaatcccaaccggtgggagctcatcgccacggcggtcggcggcggcaagacggccgacgacgtcaggcgccactacgaccacctccaacacgacgtcaccaccatcgacgacgaccactcccacgccgccggcgaagccctccccaacggcaacaacaacaataatactaacaagtaccgatacatacctcacttccttccttccttccttcttaattctatttattcattcaaatatatatactcctgtatagagtaatttcctagctaattattattaacatatatgcatatacgtagattgatttattaattatcgatggattatatatgtttgcagaggaaaccgaaaccaggcatgatcgatcgatcgacgacggccggtgatggtgcacgcaattgcttaagctttcatggttaaatattttttttcacataaaagtaaaaaaaaaaacatgatcgatcgatgcggaccttatattgatccatgcatattggcctaaatatatatgtatgagccaatgttgcatctggccacgtacctgcgccaatattggagtatttggtatttatacggtacgtatgacaactttgtgcttgcatctccatcaatatattattactagtggagaataaatttatgtgtattcagagggtgtgtttggataataggaaatagggggtgggattgagattgggaaatgaatgaagcattaggattaaataaaagagtgagaatgaatggttaggattgaaagatgccttttggtgggttggaaatcatttccatttcctattagccaaacattgctagagtgtgatgcatgctttaccacctaaacattatatgcagctaacgggcgattgatcgctgccagcgatcgtttttttttccttttcctcttttagtaagtttatacacctaaagtttgtagatcgaatgtttataagtcaaatgtttatatacccgattcaaattcaaattcaaattcaaatattttatatttttatcttttagtaaatttatacacctaaagtttacacatctaaagtttatccacctaaagtttgtagagcgaatatttataaatcaaaagtttatatacccgattcaaattcaaattcggattcaaatattttatatataaaatatttctatacacaaagtttatgcgtgcaaagtttacggtataaagtttatgcatatgaataagagtattagatttttttgaattttattttactatttttttaaaaaaa

SEQ ID NO: 16010 - DNA, 12161 bp, Oryza sativa
agagggaagggatcacccgcccactagcaataccctcatctttattctcacttcccctcgaccaatatatctccatgcaaatgagtagatctaatgggcgagtgttcacatagcttgggtgcgccaaacatgttcggtctagcccacatgggtccaacccatcacgagacattatcccaaaagtttatgcatagaaattttattcatttcagaactttgtttgaattcaccggattcactatgattggcctataaatgcagccatagaagcaagttgtcgataagctcattattattaatagaaatctgtaagatttcatccccaagtttcattcgaatgccatataacaatcccgttattattagtagaaattttaggccataaaacatgttatgttactctcaggctcccactaagtcaaccagaaataaacttatcgactaataaaaataacatagacgaggtgaaggactggaagtggcccccacaagcacgtctagtagaagctaatgtggatggtgaaaacagagcaaagagcaaattgtttatggaccgatccgctccgagtttgactaaagtaaagatatggtaagcgttagcatccgaccacagatctaggatttaccaagggctgtgagtgtaaacggggtgtgtccgggtgtgcagtgtgctcgggagcgaaaaggaacatgatcgtgtatacaggtttgagcctttcgaaggataatacttactcatgttcttggtcggtatcaaagaagtttgtataaattaccaggtgccctcaggctagtctaggaagccggatgtttttgccaatgacatatggcatattaccaaaatcccacggtcgaatatccgatttcttatgtgggtcattcaagaaagggctatttggaagaaaagatgtaccatcacccgatacatgtatcatcatgttccattcaaatggcttatctattatttttaacttgaagactctatcgtgagtttgggagcctatctgtcggcttctttttgttctatattgtttatgtgagcaattcaactgtgtaaatttttaatacctcatggtaccttctcaagaaacataaaattgctctgtttatgtatgtatgttttatacgataattttgatccattcttaagccgtatctgttttgactctgtatcatttccgtcatccgcattgataccaaaattgaacccgctaaaagattgttgtgtaggatatcatatgagctctttatgtccgaatccactttatttgcataattgcatcgcgtcactggatctaggagcttcggcaagaagatgtcatgattatacggaaaacggctcaaaaaatacatccgtcctaaaaaaaattaatttttcatcaatgccaaaaaaaccaatataaaacaaaaagattaaaacaccctcactttatgaaatcctaatactattatcagatttgctagacaactgcatttatccactacttttaccaacttcaatcatttgcaacttgttttgagagacaaacaggagagacaaaaatgatcttattcattcagagaccataaagcagtaagagatgatttataagataaggattaagagaagttagggagtgcatttttaagacggattcgtccgacgtttatgtgagggtgaccagctagctgatagctgagtcaatttgtgtgacttaatttgcgaccacgtagcagtatatgtatagtattagtatagccccgaagttagttgaagacctcttggagtagagatcgaggaagaagaaataatcaatggagtgttgggagaagaagccaaggaatctgggtggctcgctgccggtgcccaacgtgcaagacctcgccgcccgcccggaccacctcacgcccaccctcctccgccgctatcttcgcccgcaccacctgtccctgcccgccgacgaccaccatgccatggctatgatacctgtcgttgactttgccaggctcatcgatcaccatgaggaggccgccaagctgaggcacgcctgcgaggagtggggtttcttccaggtgatcaaccacggaatcgccgacgagacggtggaggagatgaagcgcgacgtcatggccttcttcaacctcccgctggccgacaaggcggcgttcgcgcagcagccggaatggatcgagggctacggccaggcgttcgtcacgtcggaggaccagacgctggactggtccgacctctacttcctcaccacgcagccgcccagctaccgcgatctccgcttctggccaccggagacatcctccaccttccgccgctccatggaccgctactccctcgagacgcagcgggtggccaccgagctcctccgagccatggcgcgcaacctgggcctgcgcgacgccgacaagatgacaaggctcgccgcggcgcagtccatgcggatgaactactacccgccatgcccggccaaggagagggacagggtcctgggcgtgtcgccgcactcggacgccgtggggctgacgctgctgctgcaggtgagcccggtgaaggggctgcagatcaggaggggcgacgactggatccccgtcgaccccatccccggcgcactggtggcgaacgtcggcgacgtggtcgagatggtgacgaacggcaggtacaagagcatcgagcaccgggtggtggtggacgcggcgcaggagcgggtgtccgtggcggcgttccacaacgccacgttcgggtcgacgtacggaccactggaggagatggtgggaggcggcgaggcgcgctaccggagcatcagcgtggaggactacgtcaggctcgtcgtctccagcaagctccagggcaagaacatcttggacgctgtcaagattattactacgacttaatttctcatcttatcatgcctgctgattaatcaatcaatcaatctccctggttggttggttgctgccgagtaaactattcatgccacttcaattattagtaggtaaaaaggatctatcatgcatactactttccgtttttattggagtaaggtttatataggagtacctttgaataaacaaacaaatctcgtctactttgatgtaaaggtttgttgtatatgaggtttgcttcattgtacgctacagttgcctgagtatacggctaatgtacatgtgtcttgctacataaacaattagtaattacaaggtacacaagctttagcaaagatgtgtgtaaatcatatcatgcgtgctcatccatcgatcaaacaatccctccatatatcactggccgggtgccgggtaaattttccatgccacttcaattaggtagaaaggatctatcatactttctgtttgtactgaactgggtccctactttgaataaacaaaaaacctcgatcgtgtactttgatgtaataaagatattgatgggccgggttgctatgggagtatctatatatctttcaaaagatttttatgatcgtatcatacagatttttaatctttagagtaaaagacaaaaagtaactaaaaaacatcataatggacattaatattaccatatctttaaagaaaaagaccaaatccattataaatttcaaaacttacatgtaaagattcaaaaattacactgtaacatacaaaagttacaatataagttttataaattacactgtaacttacaagaaaatacactgtaaatttaagtgagaaaatcgagtgagagataagaaagaaatctttcgagtgatatatagcaaaatcacgctacagttcattttttcttttacaccagattacgctacagtttgccaaacgtttagggagaatagccaatatgttccctaaagttttgctcttggatcattttagttcttaatattttatagtgttcaaacaagtcatatcacgtggtttaacatagcacttggtgccaccaaaatcaccacatagacatgccatatcaccctcaatttacctatataatagaaacataaacataaggaaatgaaaacattgagttggactacaggaagcaaatctctactattataaaaattgaagatgtttttgccggtattttggtatgtcattcgtgtatgagtcggttttaagtttgtttgcttttggaaatatatatccgtatttgagtcggtttttaagattgttcacttttggtaatacagaaggaatcatataagaattctatttaaaaaactcaaatgctaagctgagatgatcggactcctaactgcaactcatgattttctaaaaaaaatatatatccaagggaactccaatagtgaatttcatcttaactaaaccatataataataataagattaaaataaacttcacccgttgtaacgcacgggcattttttcttatatgattaaaaaattaaaaattatataactctaaatttgccattactttatatagcaatacgtcatattctatcttcatggtattctcagactagaaactttcggcccgtcattctcatattttcgaagaatttctcttttcaattgaatcgaaaatgttctctagcaaattatcaaattttaaaagtgtttttcagccgtgatatgtttttgtgatgtttatcattttagcaaaattttccttgtttttaggttgaccatctgttttatgataagaattaccaaattttggtacatgaatatgtttagtttgtaaccaatgtttagcaacatcaaaatttaataggattggcgaagtgggcatagctcaacccattaagttactaatggtggaacaaacccatccaagttcgaattctatacggacatgggtactcgtatttacgattatttatttatcacatatatagtagacgacgtacccgtcgacaacgatacgctcatggtagcttcatcaatcttaagaaataccgagacgttcgtggtggcttagccaatcttaagatatgtcattacagtttcttggaggtgatcatagaggtaggatgtgtgtttgtgcgttcttagatatgagtgtgcgcgtgttatgagcatatatgtttgtaacgtgttttaaaaacttttaataggattaaaagtggtaataaagcaaactgaacatactcgtatatcgaactgtcataacttctaaaattagcttgtacctcgtaattgtcgttgtttacaccataaaattcccaagagaaaagtgaatctacacaatatgtttacaccataagtttggaaaaaaaatcaacgcaagtcattttttcatcttcagtccgaaagtataagcggatatttttgcagatattttgttagacagacagacgaagaagggaaaagagacaaagcgcgcgtgaaaaaaagaaaagaaaaggagagaaaatgttttaagctgagaaaacaaacccaatccaaagcgataggcaaatcacatccatccatccattgccattgccacccatggcgccactccccgccgccgccgccgcgccggccttcctcttcctctcccctcccggcaaactgcccggcggcaaacccaggctgaaaccctcctgtgccgcctccacctcgtcttcgtcgtcgtcgtcaccctcgctcgccgagcagctggagcccctgtcccgcaggctcctccacgggaagcccacgcccacccagcacgcgccggagccaacctgggtgaacccctccaagcccaagcccaccgtcctctccctccgccgccaccgccgccgctccccttcctcccacccctcctccgcccctctccagccgctcctccgcgccatccgcgccctccccgacgctgccgacctcgcccccaccctccacgacttcttccccccggcctcgccgccctccacctccgacgcgctcctcctcctcaactacctccacccctcctggcgcaagtccctctccctcctctgctggctccgcgccctccccgatggcgccttcccacttgacaccatcgtcttcaatgtcgccctcaagtccctccgcgccgcccgccagtggccccaggccgagcgcctcgccctcgacatgctcgcctccggtgtccccctcgacaacatcacctactccaccctcatcaccgccgcccgccgctgccgccagttcgacaaggccgtcgagtggttcgagcgcatgtacgcctccgacggcgtcctccccgacgaggtcacctactccgccatcctcgacgtctacgcgcagctcggcatgaaggaggaggtcctcgcgctcttcgaccgcgcgcgcggcagcggctggaagcccgaccatgtcgctttcgccgtcctcgccaagatgttcggcgaggccggcgactacgacggcatccagttcgtcttcaaggagatgcgcgaggtaggcatcaagcccaacatcttcgtctacaacgcgctgctggaggcgctgggcaagaccggcaagccaggcctggcacgcaacctgttcgaggaaatgacggccgagggcgtcgagcccaacgcgcgcacgctcacggcgctcgcaaagatctacgggagggcgcgctgggggcgcgacgcgctgcagctctgggagcagatgcgggagaagaagctgcccgccgacaacatcctctgcaacacgcttctgagcatgtgtgccgacgtggggctggtgggcgaggccgagcagctcttcagcgagatgaaggacccggacctgggcgacgtgccgaagccagacaagtggagctacacggccatgatcaacatctatgggagcagcggggatgcggaccgcgcactccagctgtttgcggaaatggtggagagcggaatcgagcccaacatcatgagctataccattgtgatccagtgcctgggaaaggcagggaggatacaggaggcggtggacgtgctagaggctgggatggccaagggcctcaagcccgatgaccgactctgcgggtgcctgctctccgtggtcgcgctgagcagcggggacgagacggaggtgattctggcttgcctggagaaggtgaggagtaatctggtgaagctgatcaggatgctcggggatgcccgggtgggagtggaggacctgagggtggagctgaagggcatactgaacagcgcggcccctgaggtgcggcggccctactgcaactgcctgatcgacatatgccgcaaccatgggtaccctagtgagagggcagtggagctgttccgcctcgcccggcactatggcctgtactcgaagatccatacgaggaaggaggaggagtggtcgctggacctgcggtcgctgtcggtaggcgcggccaagacggcgttcgacgactggatgaagaccatccgggaacacgaggaggaggaggctctgccacagacgtttagcgtgtacaccggctccagcacccacaaattcgcgcaggggctggcgaccgcggtggcctctcatcttgagcaggtgggggcgccgttccgtgccagcgactcccagcttgggagcttcatcagcagcagggatgatctgctctcctggttgcacaccaccatgtcatcgccggatgttgccgtatgatcgccggttggttgcatcatgcagtcttgcagacaggacaggagggacgacggccgtgccgtcacattaaaatgctcgtcattgtttggttttggttggctgcaaattaaaatgctcccaaagaataggattgcgaggaggatggatggatggtgctgtacatgcgcaaacactccggataattgtcatttctctgccttttttatactagtccagtttgtaggaagctggacaagtgataagcagataagctagtactagtgtggttttctcacctcttttatttatactcctactagattactcacagttgttagggatgaggtgagggcactctgaagatgagagagagctcacagtttatggtttttgtacgacgaaattattattacatatctgggtctgggtgccagccgcccgcttctcaaattgtacttggttgattttcatgtgtggatccatggggatggtcatagatagggcgccataggaaggagttttgcaagaaaagaaaaaacaaaaacaccttgaatttatgggctgtcgaaatgtaaaaaggccgagtccacatgcagcccatcagagacggcccatcaagaatcttttcttacagatgcatgatgtcccatgcagccccaaccactcctcctcctcatcggaggggttcttcttccgaaatccgaatcgatcaatcgagcaagggacgggacagggacgaatcgtcgccggagaagaggagagggagagagagagagaacagaggggcagaaggcgagacaagatgatactagcggtgctcttctccaactccgacggcaacatcctcatcgagcggtacttacctcccccatcttcttcttctcccctccaagaaagccctttttctcgggggatctcgcctcctgaggcagatctgcccatctcttccacgctcccccgctacctatggccaacaaattccacctcaaccatttccctccaaaactaatccatctctactccccgtacttaccgctgatagaaactgatttatcacttgcgggttggtaaacgtttgcagcttccatggtgttcccgcggaggaaaggctgcactggcgttctttcctcgtcaagcttggcgccgacaacctcaagggggccaagaacgaggagctcctcgttgcctctcacaagtatctacttttcccctttagctcactgattgattgattgattattctactctagcttaagttctccagtaagttggtaccaccaaatggatcttcaagatttaccaattgttcaggcccttttttttattcgatccctggttaacatcaatattacctggttcatgtcttttggccataactgcccagtagcaatattgtgttaagatcgctccctgatgtgccaatgttaatcttattcctatcccgtacaaatctattttcggaaaattcattcattcattcatctcctaaattcgctctccagtttgccaccattctgagcatcaacttgatgctcctctgtttttttttaaaaaaaaaaatcttctgaatgaaacagcaggactgctatttggttacattggtgaggaaataaacgttccaaaattacaacaaaaatgcccaggggccaaaagaaaaggagagacaacttaccagttatagtagataatgaacctggaactgcaggtcgtgatgctgaatgtgtagaattaacctccttcagtcatccttaagcttgaccatgtgttatacagtaagtgtagtagagcatatccactgatcattaatcagatcccatggttgccttgagttttgtttttactgtatgctgtccttctgaatcatgcttgtcatctcctacaaatcctttgctcatctgaaatagaacatttccctctatcgctgctatttactattgggttttttttcaggtccgtctctattgtttatacaatgattggggatgtctgcctgtacattgttggcaaggatgaatatgatgagcttgctcgtgagtgtcgtcaagcttatgaattatgatattcctttccttatgtaaaagttactaatctagtttgaacgccttctacttccacatcaattgtactcatggttggtgattattgtctgtagtggccgaggtgatatttgcaatcacatcggcagtgaaggatgtatgtgggaaaccgcctacggagaggctcttccttgacaaatacgggaggatctgcttgtgccttgatgagattgtttggaaggtacagcttggggttgatcttctagtgtgtgaagttgtttcccccattttctgtgatctactctagtacctgagagcttgatgatatatatattgcacgttgttgatgcagggtctgctggagaacacggagaaggacagagtccggaggttgatcaggctaaagccgcccgttgagccatgattttttgatcactttggaatatgtgtgtatccttctcgtcgtgtaatcatatctctcgcagtttatttgctggcagttgtttttttattccctttgggatggatgattctgtatgtgtacaatcctaatacattttgccactgatgatttgtactgttacactactctccgtgtccatggatggaaggattgcagtttggcaatatgctgcattgctgctgcgcttttggtttcggtcattgctacggtatgctctgctttaagtgaatttgaatatttgatgaagcaaaaaatgagtaatcaccatgattattacatacatcgttgaatttgatgaaatggcaaggcaacctgtgcctttgagggaaaaaaagcaatggcgaccacgtcgcctgagctccttccaaagcaagcaccacatctataataagacattaattatattatattatgaaaatataaaacttggagatgttttcattaaattttttttacgttatccgtgtttaagttgattgtacgtccccaacccctccttctcctaacccaatctaaccagcctacaccatcacgccctcctctccaatcacctctatttcatcacaattggtaaagtttttatgaatcacaaaaattgtcttcacctcatgtaacccaaaggcatttttgctagttaataagaaaaaaaagaagaaagggtcaaaagcaagcgtgaggggggtgaatctcactataaaaagaaatttccattcgtagcacaaaacttaaccaaatttaaaaacagggcaataaataaaatttcagggcgcgaagaaaataccatatatatgtatctaaaccttccatctcaaaattatttatattctttaaaatcaaaatagatactattaggtggtgtttggatgcagggacttaactttagtccctatatttagatactaatttagagtattaaatatagactacttacaaaactaattacataaaagaaagctaattcacgagataaattttttaagtctaattaatccataattagagaatgtttactgtagcatcacataggttaatcatggattaattaggctcaatagattcgtctcgcgaatcagtggatgtgttttattaatagtctacgtttaatatttataattagtgtccaaacatctgatgtgatatggacttaaaagttttagtcacatctaaacagggtcttagtaaagagaaattcctcttgtgtggtgtgtagtaaatccctccctttgtttttttgggttaattagatccatgccattaaaaatatactagttttgaaatataccactagtattcaagtatttggtaccatgccattataattttacacatatttgagacatgtcactatttaccccttagatatattttaagaaaagattggacaaaattgcccttcttcttctttcctcctcttcttctcccttctcttcctgttcgatgcagcggggagcggtggagcggcggcggcggagtgagcggcgagaggcggcagcagctgctactgcgcggcggcgcggcagtagcagcagcggcgcgcaagtgtggcggcgcggcggcggagcaagattcttgtggccgctgctgaagataggagagagaggtatggcctgttcactttgatgccaaaaaaaaccttaccaaattttggcattaccaaaatttttgccaaaattttggcaggatttcttatatagttaccaaaatttggcagcaaactaaatatagtcactttttggtaactttatcaaaatttggtaatgttaaaaataacatcaaagtgaacaggcccgtaaaagatagatgagagatagagagaggtagaagatgagggtatttttatccaatacatataaaatacgcatcttagtggcatctttaagattgtaaacaaatagtatagtagtggcatcgttacaaatacacaaatagtaatggtatatttcaaagcatatacctaattaacccttttttttagaaaattggaaccatgccacatccatcctcgaaaccagagaacaattgatgcgaaagatgagataacaaatatgcagtgggtgaagaatggaactatacaatgagatagcgatcatcacttcgagcgtacatacctattgagaacgatgaaccacctgtgaacattgg

SEQ ID NO: 16011 - DNA, 3285 bp, Oryza sativa
aatggcatggttccaatttaccttcttctttttttttagaagttccagtgttgcagccaagtcggaagtcgccattcgtcttctctctctctctctccgcgccggcaaagcggccggtggcggcgccgacgagtcagcaagcggcagcgcggaagtcgacggccgcgagagtgggaggcggccggtcggtgatcgagtgcggaagtcttggtgaaggcccaccgcgtcgcgtccgtgtcctcctcgagccgcgtcgtcgtcgacctccttcaattccctcatggctcgcaacaaggtaacctcgctcgctcgttcgcacctcctcgtcctccatgatttgcactccaactccaacgccacccttcctaaaccctatctataccctcctcctccgtccccttcaaataaaataaaggttttatccccccattcctagggtttttgggacagtaataatttacttcgcattcgattgttgtgatttagtatctatttacatccatcttcacattaacctatctgcattcctctccttccgctgcaccatgcacttgttgttaggaagtatcctgattttacattttcgacttgcacaccgtgataccaaaatctaatgaaaaaaaaaataaaaaccagaaatcaaacccatgatactgatcccccccccccgtccctgtgattctgcgtgtttgacaaaaataaaaagagaagaaaaaaccaatatgcaagaccatttctggtagcactttttattgccaatcaattatattttttttaatgtaggaagcattggttttgctattggatgttggcccatccatgcatggcgttctgcaagaagttgagaatatctgctccacccttgtgcataagaaggcaagcacacactatttccattttaacttcccagatgcaaatgctactacctggccacctgcaattcatcataacttgtaaccaatcagcctcaagctaacccccctgccttttcccccctctctgcagctagtttataataggagtgatgagatcggtgttgtcctttttggaactaaaggtattgttgcaagcaaatgtttaactaaaattttgtttgcacttcaaatgttctgtgttgttttttattagcttcattgaacaagcatatatgattcacaatggaaaaggataaagacatagttatattaaacaagtatgtgattaacaacagtgaaggatcagacaagttaatgtttcttctctcacacatctagtctagttaaacacttcttctcaagttgctatgaacgatagatctacttagacaccaacgtttgcattgttttgctgcaaatttgagaaccatgcatgaacattgtttgggtcacatatttcttgcttcaaaagttccttgggctgcttgatttatgtttatatgtgcagaaacaagcaacgaactcgccaaggagcttgggggctataagcatgtggtggttgctcgtgatattaaagttgttgatgaagaaacaacaaatgctctgcaaaaccttccaaggggaacttcccctggtgactgtatccacaagtagcactgtatgctgatgtttggtttatagttattgttaactagacatccgttactagatttgccataactactactatcagcacacgacacctatttgatctttcattttatgaggcattttttttgtcttgccctgctgcctgcatttgcatgttgctagatcatatctatggtgtagcagctcaaattagtatttctcagtccattatccttaagtgtttgcattttgggggacttctttgttgtgatactgccatccatattcagcatccggctcttcatatagtagctcctgcttatggatttgtgcttgtttcatcttcttttttttccctgtctttaagtcatatagtttctttgttttacatcataatagcgttgtttgaacttgctctgtactcttctcgagtttgatcggaatcagatactggaattccttgactaaggcaagttttggatgctattgttgttggtttggatatgctgataagaaaatttggaaatatcaaaggaaaacagcgtatgtgtctagtcactgatgcacaacatccattaagagatccaccccaagggacaaaaaaggatcaggtggacactattgcagaccagatgaaaagacacgaaatcaagatggactgcattattttcagagaatctggagttcgtcacaatgctgtaatggatgaaaacgaccaattattataccacttcagagagaggtcagtaacaaaggtagttcatgttgacagcccaacgtcactcttaggtgctctcaggactagaaatgtacttccagttactgtcttcaggggagacttggaagtgagctctagctttaaaataaaggtggggtgttgttttcttaaattcatgtaatgttttttttttcagttagagaaatttatattaattctggttcagtttgcaatttggtctgacgtctttgtgaacaggtgtgggtctataagaaaacatctgaggagaaattccccactttgaagaagtattctgataaggctcctgcaagtgataaatttgcatctcatgaagtcaaagtggattatgagtacaaaagtgttctagaaccagacacagtcgttccaccagatcaaagaattaaaggatatctttatggtccacaagttgttcctatatcatccgctgaatgggaagctgtcaagttcaaacctgagaaaggtgtgaagcttctaggttttacagatagatccagcatatctcggtaacccatatccttcaaccttttatttggaataagattatgttctttggaccttgtggtcttgtattcactgatgccatttctacatttaatttcatgattatttcaagttgtttgaggtaacttgtttgaagacatagcaaaccaatccatgtgaacattcaagcatgaatagttagtttatgtactttatatcattggagattgagctgatactatgaaacaaaacattataaaataaattcttgctctagctgattacctgatccttgcaattatgcctaatataaatgtttaaagagtacatgtttcgtgttatgtggtgttgcatttgagtttaagctgtaggttatcatttatcatgttataaaaccccttgggatgaatatgttgcaagctggaattggtgaatggtttatgcatgaaaacaatacatgaatgcagtgctctgattcgatcaatcaatcataaatccttg

SEQ ID NO: 16012 - DNA, 26518 bp, Oryza sativa
atactctaaattcagattgtcaaatcacataccaagccataaatacagaggttcaaatctgatcgcgcacacacgcacaccccgaaaagtaaatgtgcaatcttttatttaaatctacagcacatttttttttgtgaagtaccaatgtttaaaatatgtttaagtttgatttcacacatggtacaaatttaagaataaggttggtgtgctcatattcatatcaataaataaggtagggtgccaaatttattattcgtaatttctatctaatgtgactgagtttgaaagggcaagtgatatattaaatgaaaggatgaattttattcctattaagaaaattttacaaataaccaatggatatgaaaacgtgaaataaatgtaaaacgattgttgtttttagaaactgcaaaatagttattagtcaaagccttgatgtaacaaaaacaattatattactaaaaaaaaagagagtatagcactacagtaatacttttgaattttttttagagaggttaaggaacaccgtgaaattaatgatcatgatcggttgagataataaagaaagtaggtggaataattagatgatgagagatgctgtgattattggttgagataatatagttggagaagtagctaggtaatgtatatattttgaggcaaaatttaaatgttagaagtagctattatacgagatggaggcagtatatatgtagtacatcaacatatgtatagtattaggattaaatgagatatatatactagcttatagaactattgaccgaaaactaattaagtcggctggctgtatatatacgtcgttttctccggtggatgcagccgcagaaagcaagctatatatagcagagaaatttgtggtggagatggaagcacgtacgaagcaacaagctgatcgagaaagtaacacacatgtagtaatacagtgaattaattaagctgcagctagctagcaagccttctggtacgttggttctgtaggtaattaacggtttgatcgatcgatgaatgcatcgatccatcgctgtactgtgtaaattgcagatcgcgaggtcggcagctgggacgatcaatcgatgtgacaagtgaacaaagctgcagacagcacaggacagtagtagctttttctcggatcggattcgatcgttgcatgccaagaaatatatggaaccaacgaccaacactgctgcatgcagtacgtgtactagctagtagtagtactattgtttcatttgcctcacgtttcttcatattatattagtataatgttaatggttttataaatatactccctcagtcccattttaagagcaggtataatagcatattataagctaactataaacatattttaaaaagataaaagagaagatagaagagcagcgggctatagatatgtagccagctgcagcacggatttcaagacataatgtgtacgtgtatgacagatgggaccaggtattaatagtatagtaagcaactattgtatgaattagctattaaattggctatagatgatttggagctagtagttggctatactattaaccttgctttaagtgcaatcatgagttttcgtgtccaactttgatcgtccatcttatttgaaaattttttataattaatattttttatgagatgataaaaacatgaatattacttttctcgggacttatgtttttaatttttttaaaaaaaatttaaataagacggacgatcaaatttgggcgcggaaaaccatggctgaggttaaaatgagatggagagagtattatgggtcagacactataaaaaacatttttttctggcggctaaaacctatatttcctagcggctagacgttcagcaagcaattagaagttagtccaaatcaacgatctttactgactgcatccgacatctagtgaaaatcagcaaaaataaaatcaaaaaatattttgatttttactaggcatataacacaactaagcatcctaattgataatttaggcaacttttcagattaaattcgcaggtatgtggtttgtataggattcaaactcaaagacctctctctacgcatatgtattacattaccatctcaccatgaagcacttattcagaatgctattgttttgattttcattgttcgaaacttaaaatacttatttgtctctctaaatgatttcaaataaaaaaattcatgaactacaaagttgtagatttcgtagagctctataactttggtacagatcatgtgtccatcaaaggttatttaaatcatatatctgaaatgttgtaaaatagatcttgaatcttataacgaatactagatctacaagtttggtataaattttattttcatttgactttttaggaaaaagttaggtacaaatgcatatttttctaaaattgattttcacaaacggacgtcttaaacgcacgccagtaaaaatcgattttcactagccgatgcttatgtcgtccgctagtaaaagtgaacgtgtttttcactgtcaagactatttttagtccatctgaaaaaaatgaaaggaaattgccatggaaaatcatttttttagtgaaagttacattaatttgaagactttacctaatgtctatccagtctaactgtgttgctatgcattaacatcgaaatataaatgctagttcctatttatataaatatatgcatgctggtccaccctctttaatttatcacttgctcgcttgatcgacacaagaagttgaaaaattactagttgatacctcgcacttgttacgatatatggataaatataggttatatattatagaaatgataaatgtatgtatttaaataatgtaaaaatgatgtggagatgatgatttgacattgcttatatactgaggtttaaaagtacaacaaaattatgaatgatatgccatgtttctatgaaatttaaaatactctaatcataattattagtggatgataatatgacacatttatatatattaagttctaaaagatagtgagtacaaactataaatgcatatcgatcaagtgcgcagcaacagcgtaaagtgcctgttgtctccatgataacgagactggttaaataggccggttggccgatcaaactctacatcctacccttttttgccttgcccctcaaaaagataaactcctatatgtacacagtactatcaattaaatactccctctatctacttttgatagtcatatttcatcttggcacatagaccaaggataagtaattctacttatcatccatttaaacatgccactagtcattcctcgtaaacaagcgattcattaatatttacatttctcgatgcacatgcagcctgtcaacgggtggtacccgtagaccggatatagagggtattggggtacgttggtacaagaatctacgtaatacgacatcaagcagacaaaagacgaggattatactggttcagaccccttggtaggtaatagccataatctagttgatgtgggattatatagtggaaaacacaagttacaaagggaacaatggaacttgacggatccggcgagatcgtggtcgagttggttcgactagatccccggcgacttggctccttgcgggctccgacttcgtaggctgtgagggtcgtgttggctctgagattcgatgccccaggtcctccctggggggtcccttttatatcgcaggtcaggcggtttccaagtagaactcggagataacagaccctatacgatacattgatgacccagtcttgtccgagtaagactcttcccatccgtagacttcgtgaatgatttccttagtgtacgcgggaagtatccgtatgcgcgtgggtatgccatgccgatatgtaacatatatcgaagggtaaagggtatgcctaacccataaccctgacagtagcccccgacttctgcttaaatgaactcgtgtaaccattcgcgacttgttgtgtcgagactgttgtcgttcccggtgtgaggaccatagagacaggacgtagtcgagaacaccgtgtgaagcccaacggtcacgagtgaatttaaactgaagtccaaaaaactgccgcgcgtaacggatccagaaatctccggcgggcatctctcccctttccttggaagtcgtaccgtcggaagtgtgtctatttaaaggaattttggggatccattttgaagtccgcctattgtgaagaaaacatcccgcctgtaagcgctcttcgtcttctccgctgccacaagaaaccctagttcatcgacctgagccctttctctggcgatctccgatcaacgatggatctcggcaaatcatcctccaccagtgtgtcactgaagaagcttcaggaagacggcgcccttcctggtcgcggaaccatggaaagggaagcaggaggtactaatccccagcccgtcttaggtcgcatggttgcgatcgaagactatattctctgcggttttctccttgtgccttccgaatttcttctcttggttttgaacttctacggtctttctcttctccatttgaaccccaactctatcgccttccttagcatcttttctcatctttgtgaggcctacattggggtagagccctttcttgatctctttcgcttctactacgagctgcgttggatggagtccaacagggtgtctggttgcgtcgggttccgacttcgggatggcctgaagtcgcgttatatccccttccagtgcccttcttctcgcaacaaatggcggactaggtggttctaccttcagatcaaagattcggaccctgtcttcgttgttcccaaagaacaaccggacaagatttcgtcttggaccgcaaagccccctttgaccccctctctccagtcgtttatcgacattatcgacgatctccgagtacgaggcttgtcggggtatgaagtcgctgcagacttcgttggtaggcggatccagccgctccaggctcgggcacatccagcctttgattattccggaccggaggatgcgacccgggtttctcctcggggtatctttctcgcatttatccagacatgctcatgttcgtgttcctcttgatttatcaaaatttggtctcgattcacaggtctgaacagcaaagctgtggaacgtcgtgttggccaagtgatgatcagtggtccgacaacggcgagtaccatccccgttcccttttgtgagaaaggtgcggctgaacgtgatgctgccatcaatgtaagtgtacccgataggcattctacgttttccttccgagatcacatcgtgacttgattaagcgtaggcccttcatctgactgacatcatcgagccgctcgcggaccatcaggtggcggcgtctctgaaagagaaggtcgccaaggaggcgtctgatgctgctgctgctactacaagtggtggcaatgttccgacaaaggggaggaagttctcctctgtgagcggacatcgtcgcaaggcatcaaccccctcggtaagctatcctgtcgtcaaatcgtacagccagaagaatttcgccttacttcgcatcgaccatttttcaggcctcggacacgtctctcccgcctccacgacgacaacgccttgtgacggttggcgagaagtaagttgatgaacttaagtttctgtgattttattcgagtgttgtctgaaccatgcccgtctcatagggcggcgcgggcgaaggctgggcaagacaagtccggagggacctccggcacgtcgcccgctgcggcctcgtcggatgtcatgctcgcacccgggggccgcgaggtgacaccaagcggcccagtcaacgatcccgcggctggccgtggtccaccggctaccgtcctcacctgggaggagctctaggttgagatggggcgcctcctcgaggctggtgctcgcggcatcggtcacgagattgtggaggcaaggtcggcggcgtcgtcggcaaacaagcgggctgaccgattggcacacgagttgtcggaggctcgtgaggacctcaagaagatgagggagttggtggccggcaacgagcgacaacggcaggggctcgagcaccgcatgtcagagcttgggaacaatctgtcgaaaatccgtggctcattgcgggtcacctatactggtctgcaccagctcgccggggagtgtggcattaagtctactatcccggcgaatcccgacgagttctcgttgacatcttctcttgcggagctggcggcggcgatggaggagatcccctccaagcatgcggctaggatcggggaggagacatcgaacgggatctacaccggggcgtgccacgtccttgcgtgtgtaaagctggcgcatcctgaactcgatctgcgcgagatcttggatcagggggcggctagcaacacgcgtaaggagatgatggaagaagtcggtgacctgggggaatctgttctccccctttttgaagagtggggcctcttgtactccctagatatgctgtgtaaaactggatcttaaccgcctttgtgcgagcagttattattctagcttactcttgcatgttgatcttgaaagctttttgtcccttgtagagatgttgatgacgaggatgtccagcagcatgggcaacccgagtcaccggcgattattccggctctcacgtttgaccaacatgcatcgcccgacaatgtagaccaaacccttgcctcggggacggagatggcgaccacttccttaggttagtgatccattcatccctttttgcgcctctgactagatcacctatgttctcggaagaggcgtgtagcctgacttagtcgttcccacactgagcagatctcgagagtgctcttgctggccaagatcgtcgtatccaatattggaagacaaaatttgaagtagcggaactcgagagaactatggttgtagtgaagaaaaagcaggctgtggaaacgctccgaggtcgcgaggtgtggttcaactcgtacttgaagagttgctgcacatccatggccaaggtttgtagagagcttcgagtacctcgtggggatcccgaggagtccgcggctgggtacatctcgtggctgaacggagcctgtgctcaacttgatggcgtcggcaagtgtatcgacgaggccttgaagcaggaatgtcgtcgatcgagccgatatgccggagggcacgtgttggcttgtctacgagatcatcgcccgcgcctggacctcgattttctccgtgagggctttgctcgttctcggaggactccggcagagatagaccacctggcgaggtcgatggcgccgttggcggagaagatattccagtctatggattggcgttggccttcttggtagtcttcgtaccctgtgatagatatctcaggaaaaaggtgtaatatagctttggatttgtgtaaaaactgtaagaagtattttgtaaaatagaaaagaaatctatctttaacaaatctttcttactccggatgtcatgtgtaagagtgtgttctcagttcacgactttaatcagtcgtttgagtcgtacactctccctagcccccagccttgtcgtctgagggattttctcggaggataaggctcttggacctttgacctgccttggttgaataagctctgatcctagcccccagccgtgaagttggaaagttaatttccgatttcgcggcttggttaatatgcatggcgagaactcttacatgaccagatcttacatggtctttcgtctctacaggatctgacaaggccttatcggctctgggcgtccccagccgaagatcccttgggttcctcggaggccttgtcaagacggcgtaaagggacataaggataggtttcaacgctaggtgtcatcagggtaagggatcatcgggcgggaacactttgattctaatatgggcctaagaataggctttattgatactgtaaggtgtcttacaggtacggatggtattgactcatacatagaatttacgtagttggtcaatgttccaagaatttgctaacttgcgaccctcgccgtctgcaattttgaatgcgcctggccgcaagacttgtgtgatcgtgtaaggtccttcccatttgggtgagagtttgtttcgccctgcttggctttgaacccgtcggaggacgtagtcgccgatcgaaagtatgcgtgctcggatgcgcttctcgtggtaacggcggagggcctgttgatagctggctgctcgaatggcaactcgttcgcgatgttcctcgagtagatttacattgacgtttcgttgctcctcctggtcctcatcggaatgcttctgtactcgtgtactctgatgtcgtagctcgctagggagtatggcctccgagccgtacacgaggaagaagggtgtttcctagttggacgtcgtcggagtggtgtgtacgacccatagtactgatgggagttcttcgacccattttttgtcatgtgacatgagcctgtcgtagacgcgggttttgatcccttgtagtactatatcgtttgccctctcgacttgtctgttgctttgagggtgagagaacgaggcgaagcatatcttgactcccagcccgatgcagtaatcctggaagtcagcgctgatgaactgggagccgttgtcggttatgatgcggtgcggtagtccgtatctgcaaaatatccccttgatgaatttgatggcgttgtcagccttgatttcccccgtgggtagccaccctgtcctcgtgggaatggtccgagtatatctagcccccagcacgagaacggccacgtaagagggatagtctggagcgcttgcacgggtagctttgtgtgtttactgtggaattgacaggcttcacatcgctggaccatgtcgcatgcatctttaaggacggttggccagaaaaacccttgtcgaaaagctttcccgaccaatgtccgaccggcggcgtgtgacccacaaatgccttcatgtatatcaaggaggaggtgtctgccgtcgtcggacgagacgcatttgagaagtaccccgtttggcgctttcttgtatagatcgtcgccgaccatacagtagatctttgctttacgggttattttctcggcctctgtatcgtccttgggcagctcctcgctgttgatgaatttgattagtgggatgcgccagtcgtctgtggtctcgatatcggcaacggcgcgttctgcctttgtggcctccgagctaatgtcgggggtgtccgggctaacttcgccgctaacctctttcactgatggcttcgtcaggatgtccagaaaagtgccgggctcgagcggttctcgtctggacgcacgtcgtgctaggtcatctggctcgatgttgtctttgcggtagacgtgtcggacttcgatcccatcgaaccttttccctagcttcctgacttctgtgatatacttagataactcggggttagagcatttataatctttgtgcacctggttcgtgactagctcggagtcccctttcacgattagtcgcttgaccccaagtgcggctgcagctcttatcccggcgagtagtccctcgtattcggctgtgttattggtcgccctgaagttgaggtggattgcgtgcttgaattgatctccggaaggagacgtcaagataaatcctgcccctgctccttagctgttgagtgcaccatcgaacgccattgtccacgtttcgttatcgacttggttgtctgatttgttatcaggcatagtccaatcggctacaaagtcggcgagtacctgggacttgatggctgttcgtggcgcaaagtggacatcaaactggctcagctcgactacccatttcgcaatgcaaccgacaacgtatttgtttctcacgacttcaccgagaggaaaggaggagacaactgtgactctgtgggcttgaaagtagtggcgtagcttccttgatgtcatgatgaccgcgtaaagtagcttttggatctgtggatatcttgtctttgcatcgtggagagcttcgctgacgtagtagactggtcgttgtactttctctctctcgacaacgatgatggtgctaacggaatatggcgtggcggcaatatagaggaataattattcattaggttggggggcaacaagtacaggggggtttgataggtagcgcttgagtgcaacgaatgccttttcggcttcctgtgtccatacaaatttgtcttgcttcttcagcagagcgaagaaaggttgtcctcgttctcccatcttagcgacgaacctgctcaatgctgccatgcatccggttagcttctgtacttccttgagtcttgtgggtgacttcatgttctcgattgccttgatcttctcaggatttgcttctattcctctgccagagatgaggaaaccgagcagctttcccgacggtgctccgaacgtgcacttctctggattgagcatgaggcgatatcgtcggaggttgtcgaacgtttcccacagatcgtcaatcaatgagtcaaatgttttggtcttgacgacgatgtcgtcgacatatgcctcgacattgctgccgagctggtcgctaagtgcgccctggaccgtgtgctggaaggtatttcctgcggttatcagtccgaacggcatcttaacatagcaaaataccctgaacggcgtgatgaatgatgtcttctcttcgtcctcttttgccatgctgatttggtggtagccagagtaagcgtcgataaagctcaacagctcacagccggctgttgagtccaccagttgatctattcgaggaagagggaagtgatccttggggcatgccttattgaggtcggtgaagtcgacgcacattctccattttccgttggccttccgcaccatgactggattggctagccactctggatgaagtacttctttgatgaagccagctttgagaagtttgtcgagctcttctcgtatggcttgttttcggtctggtgcaaatctccgcagtctttgctttactggcttggcatcaggtcgcaccatgagtttgtgctcaattatctccctggggacccccgacatgtcggacggctgccaagcgaacacgtcagcattgtcgcggaggaaggtgatgagtacgagttcctatttctcggttagtgtcgccccgatctcgacgatcttgtcggggttggcactggagagtggaacgatcttgattgcgccgtccggtttcggcgtcttgtttgttttgctcactttcttgggtggctcagtcgtggcgggtgggctgggcgtttgctcaactatgtcgaggctccgtttgtcgcattgcaccgccagctttgtgttcccttgaatagtgattgttcccttcggtcccggcatcttgagcacttgatacgcgtagtgagatgcggccataaacttcgcaagtgcagttctcccgatgatggcgttgtaagctgtatcgaattcagcgacatcaaaggtgatctgctctgttcggaagttgttggattggccaaaagtcacaggcaacgtaatcttgcccaatggtctggacgaggattggggagtaattccatgaaagggttgatcggttggtgtcaactcgctttgtggaattcccatcgcgtccagagtgctggtgaaaagaaggttgattgagctgccaccgtcgatgaggactcgtgcgaccttgatgttccgaatagtgggttcgaccacgatcggatatattcctggaatgacggcggtcttggggtggtcttcttccgagaactctatcttctgttcagaccacttcatcttgggtgcagcccccaaccatgtcgaacagacttcgcgttccactttcttatactctcgcttcgaggagtatgttgtggaatctccgaagatgtgtgaaacgtggaggtcagggtctggatatgctgagtctgattcctggggagccgcctccacgtccttttcgaccacgcgtactcgtttgcctttttcagatgcaatgtgcttctcgagcgattttttgaaaacaaagcaatcttccaaaacatgtatgtccgtcttgtgtatggggcaccatgctttctttgtgtcgctactttgtgggtctgggcgcttgggagggttcgcgtattctgctgcgaggacttccgcttgagctttccttttcccatttttgcgattcttcttcttgcttgactcaggtgcgtcagtggctgatttcttctctcccccggtcttcggcttatcgttcttgcgtcttagcgcatcatctgcgtgggcgcatcgctcaacaatctcgaacaatctccgattggttgtgatgcgtcttgtcgccaactcctgggtagtatagcgatctctaacaccggatttgaaggcacgaattacagaagcgtcggtgattttggggattgtatttctgcactcgttgaagcgctgaacatattccctcaaggattcacccgggttctgtgtcaacgcgtgtaggtcgtcttcgatcgcgtggcgcttgtaggttccttggaagttggcgacgaactgctgccacaggtctgcccacgaagagattgagtagggcggaagatgcatcagccatgaacgtgcggagccttttaacgcagttggcaaataattcgccaatgcgttgtcgtctgctccggcagcgtagagtactgtggagtagacttgaaggaactcttctgggtcggtgctcccatcgtatttctctattgctcggggtcggaatctctcaggccatcggacatcacgtagggaacgactgaaagccctacacccagcgctgggggcggtgggttgtcggcgatcgtgtgtccttcatggatgtctgtctgatgatgaggaagacgaggatgatgacgatgatgatgggtcgtttggttctggcgtacgattacgaggatgtcggcttggatctggagaatcctgtcgtcgtctcccgctgttgtcttggcgccagtctccatcatcgtcgtcgttatggcgacgtcctcgatcagtatcgtttggcacccgccgttcgcgatcgttgtgatcgtggtggttgtggcggttatcacggtctcggtcctcgtttgagcggtctcctcgatcttcgttatcatggcaccgtgaagagacatgacgtcgggaacgattctcattgtctcatgtgcgtcgtgcctctcggcggccgttgatgtgatctcggagatcgccagtgccacgaggtggaggggtagctcgctgaggcaattccctccgttcagggttttcaccgttggcatcgccagttggtggctgctctgggtgtgctgcggcagcggcctcttcgaacgcgttactgaggttggtcactgattcccgtagtcgttctgtccaacgcgcgagattgtcgttcagaacgggatcgtagggggtttccctcagtatagcgttgacggctctgatgtgctgagctggagtggtcaattgattctccgcttctgcattggtgcacgctgatatgccgacatcatcgatagccaatacctcccgaggcgcgcttgtgaaggtgcaagactgatggttcgtgaggatcgatatcgattaccccaacaaatcgatctgaagttggcgtcgctcctcgttccttgtctttatcccagatggggatgtgtgactgttggaccttaggggatggcgcttccatggcgctggaaaagaccttgcagcttgaaaggtcgtgattctttgtcttgtgaataggacaatagacagcacgagttggagaaatacgctgaattccacgctctttgtaggcgcaaatttcagcgcggacgttgaggaaaacccagcaggcttgcaaagtgtgtttcctggttttgtggataggacaccaggaccttgtcgcttcggaagtcatcttcgtcggctcgcggttcatgtcggaacgacaaggtttggccacattagaatccttcttgagctcggatgtcgtcgatactccgttctccgcctcggcgggaggatttttcgacatggagtcgccttggtttgtagccactgcgttctcgtttccagtcattggcggaccggttgagatcggcgtcgtggtgtaaaccgggaagacgatttcgctaacttgggtccacaccagcatcgttgaagcagggaatacttggctgaggttggtgttgacgctgttgtcgacgaggctggatgacatagtagtagaaccttgagtaccaagggcccctacctggcgcgccactgtcgacgggtggtacccgtagaccggatatagagggtattggggtacgttggtacaaggatctacgtaatacgacatcaagcagacaaaagacgaggattatactggttcagaccccttggtaggtaatagccctaatccagttgatgtgggattatatagtggaaaacacaggttacaaagggaacaatggaacttgacggatccggcgagatcgtggtcgagttggttcgactagatccccggcgacttggctccttgcgggctccgacttcgtaggctgtgagggttgtgttggctctgagattcaatgccctaggtcctccccggggagtcccttttatatcgcaggttagacggtttccaagtagaactcggagataacagaccctatacgatacattgatgacctagtgttatccgagtaagactcttcccattcgtagacttcgtgaaggatttccttagtgtacgcgggaagtatccgtatgcgcgtgggtatgccatgccgatatgtaacgtatatcgaaaggtaaagggtatgcctaacccgtaaccctgacacagccaatcttgtgtggaagaatagagagtcacacattaattctgagaaagtcattaagatgataggttgttggattgaaatatgcctatcaaaaataaatttttcagatttggaaatatgactatcaaaagtagatggagggaatatatagcaggccagtccatgcattcattaaaattcaattttgtcccttttatgagtttactgtagcactacaaacaggtgcttggtttattttgaaaaatggatttatgttctttcaaatagtctacatttaaccgtacgcacaccacactcgcgcaccagtgtcaaccatctgcaaattcatagtcacaataaaatccaatagaaagcgcactgtgaccaaagtaatgttagtggtggacgtaggattctaaaaatgcttgggggcacaaagttgaaataggtagcatcaatatatgacaaaacctaaagcgtatcaaaggaaacaaaacatttttatgttgaaaataataaattacgtacactaagaaaattacttataattaattgtagttgttttttattgttatttgcaattctgaaagcaaatacagcgtgctgttaaccatatatatatatatatatatatatatatatatatatatatatatatatatatatatatatatatatatatatatatatatatatatatcacacttttaactatctatcaggaaataatgtgaacatcacatagtatatatatagcactaagctaaaagtcaatatttggttgttttcacttttcacagacaaatgtgtagcactttcgtggaacatgtagcttaattattcaacgcatggtgccatatagtataatgcatggttgcaatataattgaccggtgaggtgagttgtacctatacttgtcaaaatgtcattctcaggctctcaacgaagaatattgttgccctccttcagaccatcacattattctccataattatgcactcaattaatctccaccagtaggcttcattttcgtaattatttcgttttagtctagaatgaaagacaagtacatatctatataaagtatatacatagccgtatatagtaaatttgattaagttcctagcttggttatttattaaatactccaatatatattgcattttgcatgaagtattttacagtgaattaatgatgcacaaagatgattaatagttttgaccaaattaaaatgaatggttaggaatacgcgcattgaacagaagattagctaggtgtaatggttactccctccgtctcaaaatagatcaatttaggtatataaatttgaacatatacatcactaaattagcgtataaaagttgatttttctttcgaggctaaatgtagtagtaactgaacagaaagcctagctagcttcgaggtgctaggtaagctaggtgcactgtaccaagtgacacctgaacaaaaagatcatccatgcatgcattgacgaccgcatggagtagtctactggctactacctcaaagttttcacatttatctacacgtgttatcacttgtgcagattcctgtaaagaatgaagttttctttacggatgtatagcgtattataattaaattgatacgtatgtacttcccgtacggatcccaaagaagttgctttataataattaaagctcaattagtcaggcgctaatatttttcttgttttacgtatcctaacttatcttcatcttccttaaaaaataacaccacctaaatataacaacacaatggtacgtatatatatagctggttaatttgagctgaaactatgctattttcagttaatccggtagagaaagaaattagattggattgagaacattaattcattttacaccaaaatagatgtgaatttattccgcacctaatttggtttcaatccctttgaaaggtctcaacaatatggaattaatggtggaaggcagtaccaaatcatcgatcgtctaattaaggctgaaaattgttaaaccgtcgtaatggatagatggatctgatataattaggagtagagtagtagtaacacagtatatatattcatatatatactgctccctcttttcacaaatatatttctaaaacacataaaattaaaattcgtatattttaaaatgatggaagtaagtatttctagattgtattggagagattaaggatgtaaaaaaagtataatgtgttttatccattgagagatggttggatcaagaatgtaaaaaaagaagtcataatgtgttttattgtatcgagagattgttgagggcagtgtggttcagatcgataatagacagagaaatttaaatactaattaagagataggagtaactgatagagacaagtataacttttaaaatacttaccctgctttctcaatctcaaaataagttaatttttcttctgccctgcatatcaatataaaattaaaaagtctgggaatcccactttattaatcccaatgtagttattgctctctttttctattatcaatatatttatcctctattttacaaattctgatgcagtgaatacttcaaaataattttaggataaaaagaagacgataaaaaattggacccattctaagatggagggagtatggggttacgcttgagatggttaagtttgcggaaaaataatcaaaactagtatgggttcagattcataatgctagcatatatactttattggtctaattttagattaatttttagaattggattttttataaatagagagaatattatatttcatctactagatttgtttgttttggatgggaaataggcagcgtcgtcgtgtagtctcatcgtgtggtctcatctctggatatgatggatctatgtgctgctatatgcaaggcaatgcatggtcagatctgggtcaggtcgtcctgcagagcagtgcagtggagtactgcggtagctgtgtttggcatgcatgcaacagtggcttttggtcagagcaactgccagtggagaccatatggcccggagatccatggcctctgtagctttgcttttctggccctgtgcaacaagcaccagcagctggctttactgcattagcaagcaccacattgtttaatagccgtgtgattgtgcccatgcatggccattgggatgcatgagaggaagcaactaagggtatttttgctagcctttaagtgattgaaatcgcttgtctgggcatccaacagccaggggtagttctttcagtgattggaagctcttcctcttctccgatacctgctatgaataaagggaggggtaaggaagaaggggtaactaatcaacaacgatgataattgcaatagcaaccaggtttggtgggagtattcttgcccgcagctgcaggggattacaacaggaaagggttcgactcccttgtcctccttgttacatggcacttgtggttgaaaagaaatgctcgtgttttcaaggagatacttttcatggtggagatggtggtgttcatcgtatcgttcaataaggaaagctttgggttgtggcgttatctagtcccctaaaagttcttcttggcgtttagatacaagctctttctctttttttgttttcaggaatttggttgtctttcctagttaatctagtgtgcccgccatctctcctgtaaccccccatgacctgcatcagctagtcgtggttgtaaaatctcctttccccctattaatatatcgatgtgcaaggcttttgcacgtttgaaaaaaatgatagcaatattctttcagtgattaattgtgagctcttcttcttctctgatgcccttttgatgattgccatggattggattaggtttcaagagggtggttaaggtgggagggggggttaagaaagaggggaagggggttttccctaggcttagaggggcagtagtggcgacggtcagagcagtggtgggtagtggccagcgagcaatggaggacagcggtggcactgtcggagccatggggctagaggtggtggcaggcagggttggcatcgaaagacgacagcaaatgagactggttatgataggagccaccggcgatgaggaaggaccgacagggtaggggcttcacatcattgtatttggagaagaagaacatcggacaaagggggaagggcgggaggaggccggtctagtaggcatcaccaacaccggcaaggccaaggtgttgtgtgggaagcggagcacgcggcatcagcacaagctttctcatcccaagcacatcgtgaatgaggagggaggaggaggagataaggttactatttttccctctgtaaagaaaatgctaattctaattccctcctctttcatgaagccatatcacttcaactatttttagtctttggaccattcatcaagggtacaaattgcatcttttttccccaaaagccacactatacaacccaatcatttataaccttttggatatttgatcaaggtataatatataagcacacaatagaaaatcgtatagtatgtaagaaatctatatatctataaagttgatcttcactaaggctgtgttcgtttgtgtgagatagggtgagaaaacaactcgttttccgcgcgcacgcttcccaaactactaaacgatgcgttttttgcaaaaattttctataggaaagttgttttaaaaaatcatattaatccatttttgaaatttaaaatagtttatactcaattaatcatgcgctaatggctcatctcgttttgcgtatctttccaatcttctcaatcccctatctctcaaactcaccctaagtgtagttatgatatgcatcaccttaattgtttttagcctttgaatgattcatcaaaaatgcaaattgtatattttctctccaaaagtcacaccatacaacctaatcatttataacctttggataattgattaaggtaaaaaaatatatagtaaccaagaaataaaattttacaactcatatatactattttatcacacacttctcccgcaaacaacgcgttgggtacccatctaaaactagttaatcacacaaattatcataccttctatatgttgtgcagttaattacccattagttacacaaaatagttttcttaaattaaagataatagtatttagtagtaaccgtcgtttacccgtaccacgcacgcaaaagcttggtctgggtctgtgggtgcgggtggctggcctatgttttggtttggccggtggtggccggggaggtacggattgaacacagctgaggatggcattgaccttcctttttccttttggttttttctttctctggactggatctggatcatccatgcggctctagatgccgatgccaatgccatgcctgcctctgcctgctgccaaccaaaaagatgcatgcatgtcctcctaccttcctatacataggattcctgcatgcatgctccttcatcatctctttcattcacttgattatttctcttacgattcattatttcatgaaaaaaaaccttgtttaccatgtaaacatttataattatttatactcgaaaaaacaaatgagactagtgatgagatatatcatatcgtgtgtttgatttaacactcaataaaagtatgaaaccataccaaaaaaaaatgctaatggcgactgacttcggtgttcattttggtttgttgcaaaaaacaaaagaagaagaagaagaagaagaagaagaagaagaagaagaagaagaagaagaacataattccaatatgttggcaaagctaactaaaagctttgaagtaacattgtcaaaactcttactttgctaaaattttggcttgctagggagtatttttaaatggatgcaatcaaacaagcccatatataagaacgcatgatgttgtggttattatctactactctactatatactacttaaaaaataagaggtgcttccatcgtccgtcaaaaaaaccgggtgaaaaaaaaaccgggcagaaaaaaccaagtttgtccgatcataaaaaccggacgaaaaaaaagtccgatccaaaaaaaagtgaaaaaaaaaccgggcgaaaaaaacacctgtccctggcaaaaaaacacccgatcccttaaaagggaaaaaaaagtccgagagacaaaccgtttaatgaataaaaaaagcgaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaaagaaaagtccgataaaaaaacctagtgaaaaaaaaccgggcggaaaaaaaacaaatatgtccgacaaaaaaaaaggaaaaaaaaggaaaaaataccgaaacgaatccgactacatcgacgcggtaaaaagagtttaaaaaaataaaaagaaaactatcctattccaaagaaaaatgaattatatgtatcgtggagcaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaaaattgtccgataaaagaaaaggaaaaagctgaaaagaatctgactccatcgacgcggtaaaaaaaggcgaaaaaaaactttccgataaagaaaaaggaattatatgtgacgcggtaaaaaaaataaaaaaaccaggcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaatctgactccgtcgacgcggtaaaaaaagggcgaaaaaaatccaaagtaaaaggaattatatgtgacgcggtaaaaaaaatcgatcgggcgaaataaaccgggcaaaaaaaaatctgtccgatccaaaaaaagggaaaaaatcaaaacgattccgactccgttgacgcgataaaaaagggcgaaaaaattgtctgtttctaaagaaaaaggaattatacgcgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgtttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacgtggttatgcatgaaaaacgtatattatcattacgttttttcacccgttgcaacgcacgggcatatttgctagtataactccaaagatgactataatacgttaattaaaggggaggcattatacctggtttattacgcttgagggaggtgatccaatcaggagcaagagctaagggggtcaaatagacttattccttattggactaaccttatgcactgacagcccagaaaaattggaatatgtatgggctcctgccttcccttcccaatgggccaatgagccatcttttcatccactaggccatatatattgctttcctccacaagatgaaaggagaaagttcattttgactcccttaactagtgaccgaatctaattcgtacccctcaaccacaataccggatatctcgaacccccaactattaaaatcagtgtaatttgactccctcggtggttttggagggcggtttcgctgacatggcgcctacgtggcggtattgacctgttcttcgttccacatggtgctaacgcggcgcgtaggtggcattagaattaaaatttatgtgtggggcctatttgtcattcacaaaaatatgtgtgggacccactaacatgtgggccccacatctcatgctctctgatcttcctcctccctctcctcgtcgctcccttctctctctttcctctcactctctctctttcccgcggtgggaggcgagggctagagacgacggtgagcggcggagacgacggaaggcgcgacggagatgcggaaatggcagcggctcgattccccagctgtcgccgctcccgccccagatgagctcaatgtgtggcacccgcggtggtcgggccgaacgacacggctgtgttcgcggcgtcagatggatggatggggtcatggcggtagccggcgacgagcggcacagcttggcggcggagctgtgcgactaaacgtcatcgtcgacgaccgaattgacgtagagggtggtcgccatcgaggatgccatggcgggaacaaggagctgactccttgaggaaaagaggagtcggctggcgttgttcccactttgccgtcaccgccctcccaacctcttgtcgccgtcacaaccttcccggcttcgtgtagccgccttcgttggagaagacgaagaagcatcgagtcggagaagcaaaacggcggcaacagcagtggtagaacgtcgtttggaagagcggcagccaccgccttcgtccttctgtgccttccgctccctcgctgcctctgatagcctagccgccccgaccacaaaagagatgggggaggtcactcctcgtcactgcctttcggtgctcccaccctgagcccgccctggacacagcgtgcgagggccgcgcggacctcatccgccactgccgccctccccgagtcctggcctctctgccgtggaagaggaagagggaaaagaaggagagggaggggagaaatgggaagaaacggaggggatggattgcagcggcaagtcacagctcgagctccgcaatggtgatcggcagagaccggatttggggggtttcggcagtggtggtgattgggcgccagcgaggtgtggattgggatttctgggaggagagaagctcgactgtggtggtggcttggttgatcggggactgaaagaggtctaatcgaagtcgcgagctcgcaaaggggacccgaccctcgctcgcccaccctcccgcccgccaccaccactgcctgccgacggcccctgtcccacgctcgccgatggggaagagaaagagaggggggaggaagaaggaagaagagagagcatgagatgtggggccacatgtctatgggtcccacacatatttttttaatgacaaatgggcccccaaacatattttttaattctaatgccacctaatcgacacgtcagcgccgaatggggacgaagaccaggtcaatattgccacgtagacaccacgtcagcaaaaccgccctctaaaaccgccaagggagttaaattgcaccggttttaatagttggggggtcgagatatccgtaattgtggttcagggatatgaatcagattcgatcactagttaagggaatcaaagtgaacttattcccaagatgaaatccctagcgaggaacatctcactctttctaggaaaagcaatttcccattgatttcatcaaacatctctctatattccaaagatgaccgatcattccttttcatcctattcccaataaaaacatatatattctcccatggtttcttcctccaacaactcataatcgttgctactcatcaaatatcaaattacattatgaatccacaaaaccaaattgtttgttaatccttaatatgaccttgtctcttccctggctgccaaaaataagaggatgtttggtttgatgcctaatatggccacgtctcatgttatatgtaaatgtatttccgtgtctgcatgattgaattccatgatcgtgcttactcatactttttaggcaataatttgatttagattattgaacaaattattgttatagattatttacaaattaaatattttaagaaataaacagtgatcttgatgatgttgcagaaatttttttttaaaaaaagaaaatatttttctcaaggcgtggagctaacgtattcatatgccaattaaatttgcgtcaagctttttgttattactcgtacttttgctattgtagttggattgacaaattttaaccatgaatcaaattaaacaacccaaagagagatcttgtcctgtgtgccgtggggacaacataaaagagagaaagtaataaggtcaatagttttccaaaattattaatctccctacaatagaaactcaaagtcccatcttacatattttggaccatccaattcaatctgagatttgtacaccatgacattttcttcacattccggtgagctctttgatcttaggaggcccagtccagttaagatatagggttaaggttgaggcggggtagaagaaagaggagagagttcctcaagttttagaaggatggttgtaaaatacaagaacttgatagtaatttatgggcggtggaacgaccaatgttgatagctcagagcacaacgagctaggaggcagtggtgtctttgatggtgaggagtcgtcaaagacaacgggatggggacacctcaccatcatcagcttgagaaataggatagggagggagggtgaggtctgatgaaccccgctggtactgttggcgtattctataattggtgaggcatataacaatatttgtatgttagttgttggggaggaggggtatcgggcggagaggtggcggcgttcggagtgaggagcgagaaaatgagtggttagggttgggcacttcacgaatctcaaagtgatccaacggtcaagaaccccgcaaaatatttaggttttttttttcaaacaggtactcaaagttattttagggaggaagtgtaaggacaaatataaactggccattgacagaaaaataattaaaaaagaagaagaagaaagaggaagaaaagggggaggggggaagagagagaagcagggggcggggcggacatggatccccggcggcgggcggatttgtccgtggggtgggcggatctcccgccggagctcctggaaggaatcatgaagctgatgagccccctggagcgtgtcaccgtccgcctcgtctgctcctcctggcgcacctgcgcccgtgcctccttcccctccgacctcgccttcgaggccccgcgcctcctcctccgccgccctgggcccccccggggacctctcgccttcttcagcctccgccgcgccgagatcctccccttcgccctccccgcccgcctcagcgccgcccgctgctgcggccacatgggcggttggctcgccatggccttggacgacgaccgcgagatcgccctgtgcagcgtcacgtccggcgaatccgtgggcatccctcggccccccgtgttcccggtggcgaaggtggtgctgtcggcgccgcccaccacgcggggatgggtggtggcggtgctggggcggacgggcacgatcgcgctgctgcatccggacacggagggggag

SEQ ID NO: 16013 - DNA, 11190 bp, Oryza sativa
  unsure (1)..(11190): unsure at all n locations
gggcagcagcgggtgcgggggcgggtgtgtatgtacctggtggtggacatgtcggggtcgctggtggtggtgcagagggagtacagcgtgcggcgggacgcggtggaggtggaggtggaggtgtcccggttcgcggcggaggagcgcaagtgggaggcggtggaggagctggcggcgggggaggcgctgttcgtggggtcggtggtgtcggtggcggcgcgggccacggaggggtccgggatcagggggaactgcgtgtacatggcgcggagggaggtggagttgatcgcgccgcacgccatcggcgtctactccctggccgacggggaggcggatgggttggccatctccggcggccactcgctcgccgcggagcctgtctggatcgccccctcgctcgcctgatccagattactccagctgcaacagcaatttatcaatcatgaatcaggaatcgatgagatcgtgttcgatcgtgtgttcgtgccgcctcgcttgcaaacccaacaataattactactccactagctagtagtactacttgagttcacaaccgtgctaggctttgctgtgaacaagtgtgttgatctgatggatgcagcaatttgctgctgttgtcgtcagtctaaatttgtactagtagctgtttgcaatgcaatagagagtgtatcgatgggactatctaattttgcttatagctgctgctgatgcttcatatttcttattgttgttggttcgatttatgttgtcttcttcctcttctgttctccgattgcttctgctctcatcttcttccttgcattccatggcaaaggaaacgaggcacagctcagctactgccaccgtggaaaaaggagcgagaaaaagtgagagcgcgatatgttgatgtttggggcctaatgggctttgtgtttgatatggggccgatgaagttttttttttctgggccgtaacggtggcccatggacattcctctagcagcctagccgcagcgggcgagggttggttggtggaggtggatgggaaacccaagaaaatacgaggacgacggcggcggcgacgattccaacgagaggagaagcgcaaggaggataggcggcggcggcgactgggcgaaagtgatcagagctcgcgaggatgaaggcgacggtgaagggcaggtacgagggcgacaaggccacggccgccgccaccctcgccttcaccccctccgccgccgacctccgcttcaaggcctccgccaccgatgccgccttcgcccgcgggccctccctcgagggcctcatcctcaccctcgagaagcccggctccttcctcctcgacctcaagccccactccaaggtacggttctactactatttcttcttcttcttcctctcgccgcgcgctatcaatcaatcaatcgatccccatttcctcctcctcctcttcctgcaggatgtgcgcttccaattcatgaactccgcgctgctgctcgaccgccgcgtcagcctcacctacacgcactccaccaccctctccccgggccccgccaagctgcccgcccgcaccgccctcgacggctccctcaccttcgatccggccaacaagctcagcctctcccacacgctcggctcctccggatgccgcgtcaagtactcctacgcgcacggccaagaccgcctcaccaccatcgagccctgcttcgacaccgctaacaacgcctgggacttcgccgtcacccgcaagtttcaaggaggggatgccatcaaggccacctaccaagcctccaccaagctcctcgccctcgactggaccagggactccaagatcggtgcctccttcaaggtcacctcccttttatccttacttcccttgcctatccatgccatcttcaattatctctgtttcgattgccaatgttcaatttcaataccttagttttgaatcagaattacaaaaattgaaaggatcgctgctaggtatggaactgaacatcttgttgtcagtctaggactaatccaaatctgcgctaagtacaggcttattcccattttactactgtaaccattttgctccccactcgatgatgtgcaactgcacaagtacgaacatcatcaactagtgaagtggctgtgcgtatctatccatggaccatgggtggtgcgaaattgttggggactggggacttggggaatgcagaaagatagtttgaatacatcctcctctatcattgctagaaatgtatgcatctcatgctcacttccctttggaagccaaatctagttttcttttttggggctattgcattcttaccctcattttgaagtccaattgtgattttgccctcacttttagggtttgcgtttttgcccctgttttattgaaacgaagcaaagctttacccctagtttggatgatcaatttaacggtgttaagttgagtgtaaaactacatttttgcccttgcttcctattgtatatttccctctacctttggacaacacttgtgaagttacccctagtttgtgtatgaaacttgtaactgttttgaactgacatttcatgaaatgattcaaatctgaactgatttttacaaacttttaccgaaatcaaacaaaattttgcacaccagtttcatcactaacaggatcacaacatttatattacaaacaaatctgggagcagcacgcctcaaccattatcacgctgtttaattcatagcaaaactgtgcaaacatcaagcatgcatgaactcatgaaggaacaatcgacaatgggagttgcacgcgaagtgttaaactgcagatagagtaatgatacagcatccagtgtgtcaacatagcggccatctaaactcaatatcgttgctatctatagcactgaatacagaattactgaattacctatagcactgaatatcagtgtgccaacatggctgatagcatatcagaattacctatagcactgaaaacagcccgtcagcccgtgcttgcaacttcaacttctttgtgtgtgaaatcactccatcatggccatctaaactcaatatcattgctacctggaaaactagacaaccaccatcgcctgttgcttgccagcacgctgaggagccgccgcctggtgctcgcgttgaggggtagtcgccgccgccgtcgcctgctgctcgcgtcgttgtgtgaggagccgccgtctccgcctgctgctcgcctcaccacgccaagagccaccgccaccgcctggtgcttgcatcactgcgtcgaggagccatcctctccgcctactgctcgcctcgccacgccgaggagccaccgccgcctgctgctgctcgcgtcaccgcatcgaggagccttcgtctccgtcgcgcgccaagccggctcgccggagctgccatcggtgccaccgccacgtgatctatctacgatttggggatgggagcagtgggggtgaggagaacatgtaatgttatgatactattactaggggcagattggtaatctaatattttcttaattaatttttctttttcatttctattttttaatccaatattgtgggacccacctaactgccatccatagttgggtcaaacggtgatttcgttttgaagaaacaggggtaaatatgcaaaccctaaaaagtgagggtaaaatcacaattagggttgaaagttggggcatgatcacgattatttctttttaaaacctttctgtactcatccaaacaaatcgtgattcttttcgtgtgaggaacttgagaggaaaatgttagtgtataaaaatataacttttagtgaagaaattcattggaaagatgtttcagtatgtttgtatatgttttcttttctttccatcgtgactcttttcttatatttcagtatgctacttcactatatgtttcacacagtactttctatggttttgcaatggctgtctgatttatcttggtggttctgaaggatttgctatgatcagtttatgaaaaccttcttttgttgcatagagaacaagtgcctgtctgtttattaagctgccaatgttgttctttagagttccttgtgagcaatagttctcaaatatcatagggtcactttaggatggataattctagtaggatctagattggaaggatggggatagagcctgaagaaacatgaggaagcaaaatgggtgagttgacttgaaagaacattgagttgttgatctcacagggatgtatgtggaagatttttggccataaaactgtggtagctctctatactatgtgcttatttatgcatcaagtgaatagagatctaaatatctagaccgtctgttttcactttatacaacgtatattattctaacatctcctaggtcctccaatataaatgtgttgtcaagatggccttttggcttttcataggcgaatataactttaaaatggttagctttatagtcttgtcagttccattgcagaaaagtgacttagatattacataccattttttattgaaaggtcattttgtattcacatttgtcagttctggtccaagttttagaccctcatattaaaccctgggaaagagctgaagtagattggttcgtaagggcatctacaattctccagctcagctgactcatggcctcagccacattggactccagctgaggtggaagagagttaatgcacccaacaaagctttattctttgagccgttgttacatgcagagtcgactcttcacgcgaattagagggagattgaactgtattgtatagccaataaacggtgattagggatggatcccactaaatatactactaaatattggagagtttaacagataaatgcattgtatgtgttagctcatgcatcaacaacccttaatgatatggatgggttttgggccggcttaagagtcagccttcatgacatgccttaactgatactggtacagaagggtgctgactttattctaacttatctaaagaagactatcttcctatatctcagtctcacacagagagaccatgatatgtgccacaatgcaatatcgtaattctgtgaccatattgtgctattgatggcaaagaacaaatatttggctagttatattgatttgttgcctgcttgtttgagttcatttaacaaagaatgtcaatagtactttttgttcaaaaaggtacccatgcaaccctgcttaaatccgcaacaaggcactggtgtgctgtctgactagctccttccgaacattgaaagcaacttgctatgctattttcactatagatgtttgtagaggttgtacttttataggtaccgaccaaggtttttattttggccatgtaaggtttttttttcaggtcgcagggtcatttgatctgtctgaccaaaccaaagcgccaaagctaatagcggagagcacgtggaattacgagatctgattgcttcttctaggaggcaggcacctcctgcttaagaagcacccttgtcatactggttgtcttgtacttgggaactattctttctgggtgcaacaatttcaatacctactgccctttgttcatttttggctgccctatgattggagttgtcatggcgatgctacggcattgacaatgaacaccgattatcttttactatattctctaatgcacatgatatgattgaacaaaatgcctttggtggcgagaattcgagcattggtgtttgctccttgttcagatatacggttgatgttctttccttccttctgggagcttgtaaaacgttgaattagcttgccacatttttgttacatttgtttggacaagacaaggtgggcagaaggcaaaagaaggaagaagctaaagagtggttgttgatgatgttctatacttcttccttatcgtacttatattattaaagagtggttgaaaaggaactatcacttttgtatatttgtgtggacaaaacaaggtgggcataaggtagaagcatcagctagctttggtgggtggtacatatgccgtgtagttaccgtggattggatgactgaatatctatcagtatatgagaaaaggagagacctgtaaacttatacatacattaatgaaaaaagatagaaattttgaccactaaatcatggtggacctaaattataaggggaaatatatgagaaaatatatagtgcaaacctcataatgttgtgtaaacctaaaaattatcgttgaatttgaaaacgatatttgtccatatcaccctgagtaaaacttttcctctcagtatgtttatttttagatccaagagtaattttcaggtttgcactatatattttactagattataatggtataaatcaattgatatgattgtaaaattgtgtatatgaaattgagcactggttagaaatcctttggtcgcccgtatcctccacagtcccacttgaccgtcagaattgaacctggtcctggggcatgcaagagttgaaacttgaaagatcaaagctattgcatcagcaggtgactatgtgattcttcaccacttgtattacaaaaaaatggcatccatttcattctggcggtgaatatgaaattggcaataacatgaccataaagcgaagaccatcaagccaaactgtccataaaagtttgtttctctacaccctggaacccactaaaacagcgcctggttggataactataaatctgatgaaaattcacaaaatccagaagaattgcagggctgtgccggccggtatctcaatttgggactcatcgggttcttgagaaaattattaaggtactgactgactgactcatggagctagctgctgctacactaataagggcatgtttgagggagctttagattctaagaaacagctgtttggtagccagcttctgagaatctggaaaagctctgaaacccagcttctccagcttctggctccttagttcatttttcagaatctgtaactacagattctcagaagctgtggactgtttgggggagcttctagcaagctgcagctaggagaactcccccaaacaagacctaaaactaatcgaatactactacccacttagaaaaagaaaaaaaaactaatactactacaggagtacatttgtgccacaggatcctcaggagaatatatagccactagttatggtctttcgaaaggcatcatcgttactatctctcgtcagcttccaactagagtaactaaagtaactgtatgtatatttgcatcttgtgtgactgcatgtatttgttcggctattctcttgatgacacatgaacatgccaggaaagtttcttagcctttcagccgctctgtatttcatcactcataccagtggcactcctaactcctcatgtcaaatcggagtaaaaactgaggcaggagggaaaaaagacaaatcgaatcacaaggatttcatcatcgatcagtgccagataatagtaccgcatgagattctttcaaaaatctcgttgaaactgcaatggacgttgttgttactcaatctcgtacaaacttatttgtctccgttaacctctacactctaaaagaatactcgaccagaaaaaacatggcttatcctaaaggcattttggtccacaaactaactctgtcggtccgttgtggtggttgatatatatgaatttttctctctaatttatagatattatctgaaaccggtcaaataaaagatgtacgaacggtgtaaaattaagggttggtggagatagcatatcatcttgcgaatcaagcatacacacaaacacttcatttgataggctcaatctcacaatcactatatgcatatataatatcataaaggaagaggaatctacatatcactagctgcaaattctggcgaatgcatgcttcacttatatgttcaaatgaattaagctagctagctaacgacggattaattcatctttatcgatcgaatgttcgtttatgcccatctttgagccaaaagctggagatagttgctgtttaatatcgttcctttagatataccttacaaatatagatatattgttaggcataaaggaaggtttgacgaagtttagccacaatatatatgtattttgctcagatgaaatggatcctggccggccgtgtacatacgtcataggccatgccaaattcgtacgtgatttgctaataatctttttttttcagtatactaaatactaaatttcttaaaggtgctagatttgccggcttcccagcgatttggacagacggcagccaatacggtgtgcacacgttgatttttaataggtgatctggtggttaggcaggttagtggttgtatggcccaaatgcctctctagcccaacacggcctgttcctgcccatcgccagtccggtttgccggccttgtgcgctcgtcgtttccctgtgcgctcatctgtcggtgggtctgccattcagctcgcgacgcgtgtgcttcctgtatgctgggcccggttagcattggccgagccgctatcttcctcagctcctccgctttggtcgtgaatcggtgccaccgcgtgtcggccatcggcgaggctctagcgctcagagtcgctgggccgctcctctctctatccgcccctgtctcgactctcgagctatgatggtggactgctatggcgtacagcggtgacgggattggctgctgctcactgctccactacgcggagagccccatgaccatggccaggcgatggtttgtccatttccctccctttcttctacagagagcgctagttctattctttcttgctcttcctcagctcatctttttttctccgcacggtatcgtcgttgatcgtatcctcccttgtgctatgttgttttcctcctacgccttgctctagattgcgccgttgtggttcgagggttctttcgatcatgcgtgtgcccactgatttttgggttttctgctttctaggctgcactgctggattggggattctctgttggcgttttcacttgggggagggagttgcctccctcgtctactgctcgcaaaggtattttgtgctctctcgtgcactggttaccaccttttattcggtgtgtatgcgatgaggtgattttatcggcgagatatctgctttgttgatttctgatccttattttgcccccttcaattaacaggaaacagttccttcacatatttatgttaattcgctgattccttcatatatttgtgttaattcgttttttttcatcctgctaagttacattctttcataggttgcctctgtttcctttcgtttctgatctctatagatcagtttgttcagtcgctgggatgcctgttcggttgattccatatatgtggggtttctttttttcccctttagattcgacaatagagagatcatgcgaagtgcttctttgcatcccacctctgtatgacaaattctgaattcattagcacatatacatagcaccgagaataaatttgaaaggtggctaggagaaaagaaaattaatccccaaggaaaatggtgtggtaaagcatgccaagaagttagctttgtgcactaggaatcacaagagatgttcttgcactcgtgaagaaggagtgtgatagcccccctcctttgttttccttttttagagcatggttcagtattcctgtagagtaaaggtcctacaaagtaggaagaagccttggcccttgggagggtcaaataacatttacttatgccatccaaagtttagagaaaaaaatgtgaaacgcttagttgtaaagatttgggcctgtcctgttactgaaagctgaatggccaaaaaccgaccagttatattgcagcttgagccaaagctttcttgggaatgtagtttgtttgtattgtaaccacttcttaggtacataaatcggataaaaatttttatgcctgcttaatacacatccattggtgataagctgctcttctgtatttaggatgttttttgctcacttatgttgccccgtggttctttggttttgcggccatggtcttcttcctctgtcagaccttatgccatggtgtgtttcgggcaaactctcgatgtcattatgtctttcgtcttttgtgtttgtttttaacacatctttaggtgtatctatgtttgaacctgcctcctggatttgttcttcatggtttcccaccctgtgtccatgggatatatcgtgctctatgccagtatttagacattacttatctgtatctgtgttttgttccatgtttctgtggtggttcatgcctctctcgtttatgatttgtttttacattgcatgcccattcatatgtatctgcaatgtgtctgtgttttgttggcttcttttcttgctgtacagctgccgcatggagtggtcgagatccctatgcatctgcccgcggaagcgtgcatatggtacttgctgatcttattatagttgcatgtggtgttctcatagccagcgaggctattagcgcacattttccctgttgttcactaattcatagttttgaacgtcaatagatgagtcgtcctcatgttatgctgccaatgagcgatcagtgctcgcggcaagctcatcatgtcccataggtacatatgctcggtatcctcagagttagcgagctcatcaccatgtttattgattgttcttttttgctgattcacaattttgttcggcgatagatgaaccatcctcatcctgtgcttgtgatgaacgcccaatgttcacaggtggttcatcgttctcaataggtatgtacgctcgaagtgatcatcgctatctcattgtatagttccattcctcacccattgcatatttgttctctcatatttcactacaattgttctctcgttgcgacgttgtatgctcggagcatatattcatatgcttatgttcatgtgtttgctcattcattcgtgccagcacaaatttattttgtttccattttctcattctgcctcctcatctgagtgttccacagggagtcatgggccttccctcattcatcctacccactctgccagttagttccatgttgctatttgttttgttgttcggctacctataacctttttctttcttgctattgattgccatgcctatttatgttgtccataggagaccatttctgtccaatagtaccannnnnnnnnnnnnnnnnnnnnnnggaaaaacggcgggcagctaggaaagcatgtgtcattgtacgcaaaggttgttcacctgcttatctaaacccttctttgcggtcaac

SEQ ID NO: 16014 - DNA, 2657 bp, Oryza sativa
  unsure (1)..(2657): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccttttaattgtgttcatattccttacatacacatacaggtgatgtgctcaatgctcaatccaacctcagcttctttctccaggcaaacagcaagcttcccgtccattcggttgcgcccggtcccaagtcgcttccaggccttgtcttgttcggtatgtatgtaatatcactgtcatgttctttgctacctccaccattggaatttgcactctactgtacagtcatgcctaacttctaagctcaatgcaagtgcgtgatgcctccaacagagttggaatgcacatttctgccatgtggataatcaactgaactgcaattactttctgatgctaaatgtagttttgatttccactccagatgttaatatacatgttagttcagtcaaccaatgaaattattgcttcactgcaatctttcttcttctcttatacgttcaccaacaaagtagtttgccgaaaccaccataagaaattctcacacacaccatacaatgccaagaactttcactatgttttgatgtatcatgccatcacctactgcatcttacattccttttacttggtgcaaggggataaagaaaattattggtgatggtaatatagtgttcctcattagttttcctacactgctgccctggtacattactgactatgatgccaatgttttatgttgtatgagtttttttttttagaaaaagaactatgttaccggttaaagatttacagtgacagcatagcaaacaatttatggcaggaggaatggttttgaaaaaaaattcacaatcagttttaagaactagaaagatgcattcgacagtgaaattatcctagcttgcaagagaactgcccactcacgatggctatagaatcggttactcctgatgaattttccaaactgcttggctgcttgcagattttcagtgtgttaccctgctaccttgattgcttagtcctgttcatatttacttaaagcatgcagtatttccactttattgagcctaattttggtcccatgctgtaattgctgtgggtagcagtttatattattacaatatgttcatgaaaatttatgcaggatattttcaaagactctgcttgatgatttattttacattattgaacaggccaaacaagacactattgataaggtttgcgaaatagttaagaatcagttagcagtagatgaaggcactgccgtttctggagaaacaaaattcgtggaccttggtgctgattcacttgacacggtaatcttctggactaatgtaataattcaacactatctaaatcacctggactactttattgattttttttaaaggggactgtaagactcctctcaactagcccttttcttggcaacctcatactttcttgttgaaagtccacagtgatctctgatatttgtcacggctcagattagtattaaaaattattctagtcaacatctctcctggcatgttgttgttgctctcaacaatacatttttcgcagatgcggcaattgtacacctttttatatttagtcattgtataaatgaatttattctccgttcatagtggaatgaagaatcaattccatatctagctttgtgctctcttttcccaggatctagcttattattctcttttatcccaggaatgtggcgcctttttctttcttatgaaaatctcaggaatttagtatttgctgcctgcagccatgatgcctctgattactctttatgtgtgttttgattggttttaggttgaaattgtgatgggccttgaggaggcatttcagattaccgtggacgaatcgagtgcgcaagtgattcagacagtggaggatgctgctgtgcttatcgacaagcttgtggcagagaaggacgcctaattagctgttgccaaagctcagtttgttgtactactacaaaatacaaattgtagtttacaggctatgaatgccgatgaatctcttgttgaatctagtgagtctctgcagggatttgtgcgtgttttgtttgtttcacagattttgaataaaggctgggaatgagtaagtgttctttccctgaccctgaggctgatcgccagagtgtgttccctatgtcacgcaaagaatgctgatatcggccgcagaaacgctgaattttaagttcagagcttctggaggtgaggaattgaagtcttggagcttgggacatctcaaactgcaagtcttttacatttcatctgggatttttccatcccaacatacatatccattcgaaaacaatagtagctcgtgttgctcatcactcacatgacacagagctttccaaaaaccgagctacataacattttaaccaggcgtacgttagaagggctgcaggaa

SEQ ID NO: 16015 - DNA, 661 bp, Oryza sativa
gcacatatggaggttcccttacctatcaggtgcttcttctttgcttataagcgaagctttcttggacgaaagaagctgcaaaaaatttttatcaccagccggcctaaatttctgacagagctttgttacgaatccattgtattcgtttggttcctataatggaaaacaacacctaagttacaactgagcaagcatgtttaaactatacatgaggtctcgcagcaaaataaggggcatggattacatctaactaccatgcaatcaaatgaaaataaccataggagagattacctgttcaataatgcaggccttccgtaaagcaacaaggcactccagtgccttttggtgattatcccgatcacaggaatcctgtattaaagcggttatgtacttctgcatctcttcaattgccgtctgaacccacgttgagctagatctctgtgtcagcatggcttcaaaatcttgaacaggattatgatcgccaatctccccagccttcttttttggaggatataaagcttccgaaaccccaaccttctctgcagaaggttcttctaataatttagcctgatcgtctgcgccagtataagtcaatctgtcctgtgtccgtgctttctttttctgtgatcagccaaacagatttatggttccccaaaattac

SEQ ID NO: 16016 - DNA, 1638 bp, Oryza sativa
aaagtcatgtgcctacaaatgcagccaataatgtgttacacaaccaaagctcaaataggaaataatacacaagaaatgatgttacttgatcagattttctaccagccactgttgtgtctcagtaaatggccttgatcctcctctattccgagaatcgtcttcagattgtagccttgaatcttgggcttttttccgcttctcaaggtattgctcagtgtcccagtggtggcagagagaaggccaatctgattcactaacccattccacacgagccagcaggtattcctcgtctgagagttcaattgtacgggctacttcgtctttaatcttttccccacgcactttaaagaagtagagcttgacagcatcaacacgaagttgatacatcatatcattgacgcgcttgtttgcatattgttgtaagacacggttagcctctgcctttaattcttctcttgtagaaaacaatcgctgcatgatgtgttacaggtatacaaatagatttaaaaaaacaaaaccaaacacttctttgaaatctaggataggaaagaattacggttacccaaaattcattcaccactcgctctgcacatgtctctccatattcttcattttctttcaaacaataatctgccccccccaaaaaaattttgggggggaaaaaaggggttttggggaccagggcggctacgaataattctaccatcattgtcaaggtccttcacagtgcctgagtattcgcgtttcagaataaccccaagctgtgaggtatacttgtactctgcagcatgccaattcacatacttgaattgcctgtatacaaggttagcacacttagtctcaattcacataattggttcaaatgaactagtagcaaatgactaaattagtatagcagttctgaatttttcttgcatcgcttaaaaaatttatgaatgtatacttacatttcacccctaggtataaggcccaccttccaacccggtcaaggtacagccaggctggtccttgacctctcctttcgtcctctttgtgtagcttgctgttcagcttgctcagtacttgcacgatgacttccttgactctgaccttcagcattagagttagcagggttcacttgagtgccatttgtagaaggcacactccttgagctagcaccattagcactacttgtattggaaagttggctagctgggcgcttctttgaagcaagagaccgatggcgaaggttgttcatgatctgcacatgcacatacagctaattaaataacttactagtataattaaatacataaactaaatgctattaagacaatattacatcagatatagcatatttcagtaacacaaagataccaacatccagcttatcttagtcaagtcttgtccacaacatataagaacacactgaccacaagttcacaacataagcaaggaaaaaaaatacaagacataaaacacaatcagaaatcttcaggatcataaatgatggcttcaggttcagcttcttcttcatcttcttcatcatcttcctcatcatccagctcttcatctccttgtgttggagagttacatttggcaagatagtccaaatctttctcattagttatctcatcagatatgtaagtggttgctatt

SEQ ID NO: 16017 - DNA, 892 bp, Oryza sativa
  unsure (1)..(892): unsure at all n locations
ttcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagacatctatatttccaaacctctaataggggtgacattcctggctaccttaccataatttagaactaagaatgaggttatgcccaggtgttacagttctcaacatgaggcttgtgaactgctgcatgtgttgttgacattctgctaccaaaaacgattagttctcttaacaaaataaaagaaaaaaaagggtaccatggttgcttaggttggatttttttaatatactgagacaaatgagtgttatttctttcattacacaacttacctggacatgcgcaggagacattagatcttcattagcaggtggcactacatcttcctcagatggtggttccactcctgtcttttcataaagaaactaaaatgggacagggattagacaaggctagaatgcagaatcacatattattgtacagttatattagaagggtttaccctgatcagccggttcattggaatccattcggcggcgaagttctgcattttcgcgtgtgagttttaaattttcgtttcgcaaagtttgattggctgatggggtagatggcctaggtgctgtctctttaccggg

SEQ ID NO: 16018 - DNA, 1160 bp, Oryza sativa
atgaaagttactagtttagaatatttcaaataaagggaaggagaggaagttaaaaagtaggcagaattacttgtttcttgaaccagtcaaagaaatttggcccatgtttagttccacggtaatatttccaaccatttaatcttaagtcatgacgttgcttatcactaggtgcaattctgctcttccattgttccttatcaaattgtctatatgtagggatggattagggaaaataataggaatttattaagttaaaacaattttttaatatgaatacttactcaaacaaagtgtccatctcagaaatattagtaagaatatacaagaaagcagccttgtactcctccactgttagatcacgacatgtgcgacgattaaaacaccgaccagggtactggaaaatttgaaggttacaagaactctcaaatgtagaggaaccatcatcgtatcgagggatcttattcctagttgatctcacattgtggctgaaataaagtgagaggaaatttgtgttttcctccactagataagcttcaacaatggatccctcaacacgagctttatttctaaccttttttctaagtctcccaatgtacctagaaggttgacaacactaaattaggaataaatagttgtaaggacaagacaagcacttatttcgaatactatgttaactaatatttttacctctcatatggatacatccaacgggctagaacaggaccaccaagatgagcttcacggggaagatgtacaattagatgttgcattagattgaaaaaccctggtgggaatatcttctctaatttgcataaaagaacagcaacattctgttcaagtgaatgtacaacatccttgcttagttctttagcacacaactgtctatagaaaaaactaagctcagccaaacaaacccatatattttctggaaggaatccacgaaaagctaccggaagtaatcgctcaataaaaatgtggtagtcatggctttttagaccaaatatcctccttctcagtaggttgacccctcttctaatattggctacatacccatcagggaacttcagatcttgaaaccatttgagtataatagtcttgtcattcttatctatgcaaaatgctgccctcggcttgtgccacttgccattgcccttcaaatc

SEQ ID NO: 16019 - DNA, 30040 bp, Oryza sativa
ctgaactcatggtctctaggtagaaaacgcctatggcaatcaaaccaacatgctttgccaccattacggaggcgaaatgcttgggtatcacataagcatgttggacatccaaaaataccatgggtgctccatgcagcaaaattaccatatgcaggacaatcatgaacagaccacaaaaaggctgccctcatgttaaatctttccttgcgcgaagcatcccatgtttcaaccccctcccacaacttgaaaagattatcaactaatggttgcataagaatagatagcttctttcctggatgttcaggaccagatataactagtgaaaggaatatatattctggtttcaacagtactccagggggcaaatttagtggagaaacaaagactggccaacaagaataaggagcagcaccaatattgaaaggtgtgaaaccatcagttgaaatagcaagtcgcacatttcttgcatctctaccaaaggttggaaaatctatgtcaaattgttgccatgcttcaccatcacaagggtgcactagcttaccacatgtggactgtttatgtgattgcatagcctttgcggtctcctcatgtgcataaagcctttgcagcctatcagtgatgggaagataacgcaaaactttgcgtgggaccttattctgtccatcctcaaatcggggggtgttacaaaagtcacacttatctttatgctcattttctttgtagtataacatgcagttattatagcaaacatcaattttaatatatgtcatacctaggccctgcaatagtttcttagaatggtaaaaatcctctgccaacttagaatcaggtggaagaagttcatggatcagttgcaaagtatcatcataatgtgcgattgacatattgtactctgactttaaagctagcaaacgagcaatagcagataagctagtgtgcattgtgttgtcatggactgactcattagccccatccaccattctatagaaagcactagcagaagaagttggctcttcatcaattcctggtggttggacagcccctatatcaagtaacatctcatccatgcgatcaggttgatcaaacccctcctcatgggccaagggagacaatggttcattattcctaatatgttcttccccatgggctgtccatgtctcatagttttccttaaagccaaatttacacaagtgtgcctctataatatcccttgtatgtctcatgtagttgcgacacctaccacatggacatttaatacttccatcttgaactaaatcaggtatatagaaagcatggtctagaaacatattgttcttttcaatccactcatcagagggtgcagaaccataatgccaaccattatacatccaattacgttccgccattatgttattctgtctaaagcaatatcatttaactatcttagtatataaagtaggcttggttaacaattagatcacatccaaatggaacatcaaaaataacagtccaacttaaatggccacaagcatgcataagtatcttagctaggtaggtgaactagagcttaccagattttgttgaagctaccagaccagcacgtctgagagttaacacagctagcgcatcaacaggtcaacaaggatagttcaccaggcttcacagattggggcatccttgaaaagtattacatagatctggaccaatgcatatgtaaaattcagttttgctgatattaacaaaataacacactgtgttctacttttgtatagaagctacaactaaatatgcaaaataacttccaatctctcatgcatgtcagatttaacataaaaaatcaaaacatacagactgttttgcttactatgtggaggcaaacaatagcagaaacgacttcaacactgaaggaggacttctcttggacttcagtagggacgggcagcagctgcggaatggcggagtaagggccggctgtaggggtggcggtggaggtgttgaggctgacgggatggtgtaggggcggcgcgggccgatggacgggcggagcagaaacgagtaggggatgggcggtggggggatgagggggcggcgagttggggagggaggcggcggtgctaggccggtcgatgggcggagcaggggcgagtgggggaggggggaggcatggcgagtgggggagggagaggcgaaggcgggcgcacggtggggcgacggcggcggggccgcgctgctgagtagcgctacgcgcctgcgcgagagagaaaggagtcgatggcggcggtggatctggagttccggataagattggggattttactaggttacctcaattttttttgtgggccggaagcccaaaacctacagaaaaaatatttcggagggcgccaatattcccgcttactgaaattttggcgccatattttcctgttccctcgcgccacaaattatcgtgacggtaaaacgtcaaaaaaaaatacagttctctactgccaaggagggaatgcccatttttctgtgggccgtgtccaaaacctacagaaatattacatttttctgtgggtataagtaagcccttcacaataatttatatttctgtaggtttgtttcgaaacgcacaggaaaaataatgacctacagggtagctccaaagtgtggtagtgtttttgctatatgactccgtttcaataatttgaatttgaatttcaaattataacaacttcaaagaatattttcatatactaaatgatttcaactgaaaaagtcatcaacaacaagttatataaaccatcaatatctacaacttttgttttagtcattttgctatatgactctgttttataaatttgagtttgaatttcaaattatgacaatttcaaataacattttcaaatactaaatgacttttcaacatcaaagttgtataactcatcaatatctataacttttattttggtcatttcttcatccgataaagtgatagtaacattgtttacaaaatttacatatctcttatatggttttcaagtatttaaatcacgacgaaattgctataacgtcacaggttttgggccggtttatgacaaaatcgataaactgtcatggtattatgggccttgtatccatagttgcatatccgtgacgttctctgaaaacatcacgaaaatttcgtcaaatttcatcacagattaaatagattcttgtagtgcaattcaattttctttaccctagagaaaatgcctgtacgttgcaacgggtgaagtctattttaattttattattgttatatggtttagttaagatgaaatttaccgtgagagttcgcttggatatatatatttttagaaaattatgaactgcagttagaaatccgatcgtctcaagttaacatgcgcttatcgatcaatggcaagcagactacgccttatatccttttcgctccgatcttaacctagcttcatctcaccgaatcatcggaaggaatagtcaacttttgggtgcaagctaccgtattataatggtgcagataatacctttccctgtgatctgtagatttccactgaactgatttgacattttcttagcattctcaaaaaaatagcactattctaatattaaattttaatttggcgtttcgggctccacgccgctatttattgctcaccccattaaaatatactagttgcttctatcatccaaatcgatcttaaacaatcacaactatttttcatctcaataataatctatgcagaaaaggacgcaagtaatctagaaggagtatggctgaaaataggggtggacaaaaagcttgggctcgtaaactcggctcaggcttggctcgggctcgcatacctcggctcggctagaaagccaaacgagccagcccaagcctccaaacgagccagcccaagcctccttcctagctcgttttcgaaacgagcgagcccgagctggctcatgagccactcgtgagctcgcttggctaagtaacaatagggccatatgtaaaaattttacaccttttctaactatttatttgttgaaaatgataactttgattgttatattatctatttatgtgttgtgatgacgtattaaagaaaaatatcactttgttacacattctatgtggtaaaatgttgctcgatttctcttatacatgcttgagatttacttgatgccaggctcgaggctcgagcccataaacgagccgagccgagctgcagttttagctcgctgtagcgagccaagccaagccgagcttcccttacaccaagctttcacaaaccgagccaagcccggctcgtttccacccctagctggaaacttgaccaaaggacatggtagaaaaaataaatgctcggaactacccgggttccatctagatccgaaaaaatatatgttagaaataagagaattgttttatccgctaatatatactatattatcaatcatatgtaaaaatattccgaatatatctacctacaaacatggtagaaaaatggtttttaatttcaatatatccgcgtaggggagggtggccacgtgaccggatccacgccggggaggcccaccgccatcggatcgaggtggggcggcaccactgcagatgcccgaggttgctcccatcacctgagcccgccgtcgccgctcccgccgtgctcttgcgggatccgttgcaaagctccccgcaccggaacactattttatgagctcaattaatattgcagttttttttatgtatcttcttgaacactttaattgtgtccctagattcaatatctacagacaaatatatatctgttcctgaatctatttccgacgaaaaatatgggataggatatataggatgagttgtgtgttatccgtcgttatctatatacgtggttctgaatttgaagaaaaactatagaccaggatactagagtggcagaatgtaatgacatccgagcgtaccttagccgattccaccgctaggagggagtagtgaagtagatttccattatggaactatatatatataccttttggcatgtcctgatttatatctcacggttgttttaatttattttatttttttctaagtttttgcctcatagttctagtcgacttacattatctttaaatattactctttcacaatataaaaatacgatgaaatgttttagattaaggaatactctctctggttccttattaaacaggggtaatgctttagataagagttaagataccaattaatgatgataattaattagagtgactatttcctattgtatccatattaaatacatctgtgtgactagcttaattaatatgttttacatgcatgcatgtaaagggagtaaattagtccaaagtagccacaccaaaggtaaaacgtcagtttttatttgcatccaaacagttcaaatctctaacgtcaactaatatattaaaccggagggagtaatagatatgcattacctaaccagctgtactgcgtatatgtagtacttaatatggtataatgtatatatagaagtacacactcactactagaaaaagcatttttcttgacgtggggtctttctttcgcaggcggacataatctttagagacaaatgaccgcctacaaaaatataaatcgaggtgaagttcactatccgcctgcgaaaatggttttcaccggcggaccacctaagcggcgcctgcgaacatttattttcgcaggtcaccttatgtggtctgcctgcaaaaaatcgtacctacccaaaaaaaaaacattaatacttatctacacctccaacccctccccacaactcatttgcccaaacttatcttctcaactctccctctctccctccaccggcttctcagctctctctccccctcccttcccctctccccctccacgggcagcggcggaacgcgcggacccggcggcggcgacgtggttccccagcctcccctcccagatccggccggagggagggccgggggaggacggcggcggcggcggcaacatgggcggctcccctccagcggcggccctctcccggtgcggcggcggcggctccccggcctcccctcccagatccggccggagggaggccatgggagggcggcgacggctcccctctcctctcagatccggacggaggaggccagggagcgcggtggccgcgaggcgcgcgtgtggacgtcggcggctgcggcgaggcgatctttttaattggattttcgcagacgggctattgccccgactgtgaaaatggatgattttcgctgtcgttgatatacgggtggtcctcccctccgtctacaaaaattgcttttggtcgtatgcaaaaaatgctgatggtagtgacttaggctttccggccgttgaccgcgcgttacccacgggaacgaagctcagccctctataaatacgggcgccatgcattatgcatgcccaccaagacagcaagcagattaattactattagtacttaagctgctaattacgaagtactactagctagctagtaacgacctaattaagcagtaaatagcttagtcgtcgtgtacgtgtcaagaaacaaaaatatgacaatgctgatgacctcgtccagcagtaaggtgatgatgctgcttgctgctgcagcatttcttctcctcgctgccccggcttttgcttccgacgggcagacgcctgtgggttatgctgaggcgccgtttaccgccaatggaggtgagatctctatcgactaacatgcatgtactcttttgtttgatttcttcaattccaggcagatagaaagggacatgcatgcatgtttctcctatttcagattaatttataatgttataatgtattttatctactactccagtagctaaattatcatatcctaagatggacatattatatacacttgtttcctttcattcgttttctcaggtcagcaacagcaacaaattttaacaaaatattaaaaaatattatatctcgtactagattaatttattttcgaacgagataataccagcttaattggatgcttgcagcctttagctactcagaataatgtttgctatggtatcagcaataatgttttagtcattcagtcccgcaggtccgtccgtcgcgtctattgtcagaataagtgaattcaaaagtgtcatgtcttgtatggtgtgcttttgtattggttatcctatcttaaaaccttaaataacatgttgcattggatgaatgaattcttttattcaaattctacttactactcagtactctctccgtctatcccaaaatactataagagattttgatatgacgtgacacatccaacaaatctagacatacttatgttaaaatttgctataataggatatgtcgcatcctactaaaattccttatatttagggacggagggagtacttctgtttcgaagtgagttcatttttatattaaccagcgtcataaaaaaagtatgtacatatattatcgtttagtttactaaacgttactacctctgtttcaaagtgagttcacttttacaataaccaacatcgtaaaaaaaacaaagtatgtatatatattatcctttatttactaaactttccagtctacatatatatgatgactttacatataatacaaagcgcaaaacacattttatatgtgacaatgacatgagcaaaatatagactagtgtgcaacattgcacatatatctataactaatataaagaatcgtatttttccgttcgtcaccccccaaatcccagtcggtactccatcacccccactcaaaaaaaattcccaatcgaaattcaatcacacaaataaaattagaggaagcattatacacacaaatatatcaaaaaaaaaaagatcgaaggggaggtcgtcgtcgaaccgccgccgctgccgccgccagcgcagggacgccaggccgccgcagcacccctcccgctggatccggcagaggggaggggcgccgccgccgccacctcccctcccgctagatccggcggattgaaaggcatcggtgcccctgtccgccgtgtcccctcccgccggaagggagggcgccgccgctcgcctcgctcgagcactcccggggccccatggcgaggaagaggaggtcggctgctgctccacgccgctgcccgtcgccgctcaaggggagggggaggggggctcgccagtcgctgctccgtgtcgcctcagccactcggggggcgccgctcgccggtcgccactccatgccgccgcagctgctcggggggagggggaggggggtgccactcgccggtcgctgttccgcgccgccgccgccgcatccgtcgctcggggagattgggggcggggagggagggggagaatgaatcctagggttagggttagggttagggttagggttagggtttgggtttgggtgtatttatttaggttaggattaatttggaccgtccatttgatcggacggttccagttgctcccgcgtcgggccaccggcctattgggccaccaaatagaggacgcaaaatggacttcaacggagaaaggaaataggccagacacattgaatagataaaagggaggtaacataaacttttctatattcgacccaaacctagaaaggaggattttgattctttttccaattaaataattgttaaatgatgtttgtattattaaaaattggcaattaagctctgataattctaataaaatttcaaagagcgtaactaatcgtggagaatttaataaaattaaatttaaccatgtcattttatttctcacacttgctttacttgtaaattgatttaattattcacctacctacttaaaaataccaaatgttttagtaaatttctattttaattaattacataatgtaaatatttcttaactttttctcaattttctggtatgtacacttcccgttgcaacgcacgggcacttttgctagtacaaatatgaaaagaacaaagacctgcttggaaacataagcccttagttgatctgtaaagtgtaaaataccgatgtcggctttctctccatgtatgttatggagatgttgctatctccagaggagtctgttgacataaaatacatcgtgacgcacgaaggcttgagagattttgttggctctagtgcaagtcttatcaattgggtttgaggcatgccagttagtttgatcatgcaactaataaggtagaaacatataatagttaaatactggggccaatcgatcataaggtcggtacaatatcgtatgcccggccgatgccgatagtgttttagatcaacggctataaccgatgacatcggccgaaacttagatataatataattgtaaatagtctatctttattaaaaccaatcttgatagatcagatctaactgagatattataagattgagggtaggtaataaaagtagaaatcaggcaattatataatctccgatgaaacaatgaatgatatcaattgatttgagaaaattcacctagcaagttacaaccttgttaacaccaaaatttggtaagcaccgaagtcatcatcggcttagagtcactatcaacttcagcgtcttggaatcggccgatgggaattatcaagtcgacaatggtcggattcttagtagattcggttaaagaagttaatcaataaagaaaatttatacagaagaaaccgagttcaaagaggatgcggtactacaatttatcttttaattaggatgagtctgttaatttccttttatatttagaaaagtgtgtttagcgtccgataaggactagtatccacccctataggtataaatatatacatcggggtcattgtaaaatatcactcaatcaatacaactactctcggcgcatcgctaacctcttttccgaggtttttaacttatcaccgacggaacttggcacctgacacggggctgcattgacttcgacttccagtgaagggataagtcctacgttccgccggccctgacaattgtatcggctacatgtgttgttcaaggctgcatcgcttcgttctcttggattgctctgatttatttgatatacttgtctacctatttatcatatatcttagttaatctaagtcgattattcaatttacgtgtatcggtcaaatcttttctaggattttgctagtatcggctaaattgttttgtcgatctagattagctaaggtatccataaccctgaaaatcagtcaaatgcttgattgtagatattatgtttcttttcatacttagtactgcatcaattgggtttgacctactaagttgtacttggaaccataatctctagcctgcttctggattgccaataagggtttcatcggagtttcagtctatgagttatctagtcgttgtatcggcttatatggattacatacaagttggatttagtcgatcacaataaaggtttcactgattatttaatcgtttgaatttaatgtcatcagatctccaggtgatgtatgcattaaccttcggatcaacgcttattccattatactccctccatccacaaaagttacacctattacttttgtcactaagaccgaggagaaattaaattatcttagatgttacaaaataataaaggagtaaatgcaagcatgtcacgcccggaatttctatccaaaattccaaacgcttacatgtgtgttaaaccctcgtccaggaatcaaccgaggcacacaataacaaaattgataatagaatacaaataattaactatttaatattcgcaaataataaattgctacagaggtagatagttcctctcaaaaaaaataaccttctacgcagcggaaaaaaaaaactataacaaactacggaacagctatggcgactccactccacaggcatcttaaccagaacaagctcaatccttcagatcatcacctttgctgaaatactcctcttctgatgattgaatattgcaagaatgagcatatgacatactcaacaagccacacagcaaatatgcaagtgcacaggataacaaaggacggcataatagggtttcatttgcaaaaacagcatttagcaaatatttgagaatttaataaaacaattaagtaataaacaatattaatccaacgctatacaacataccctgttatataggcccaaccattcagaacaaccatcccggctgcacagttctatctccaaaccaggaatataccattccaaaccaggagctaatcaaattattaccaattaaagcatcatttactatggtgagaagggtgagactaatcacgaaaaacattgctcaactcacccataaccgcgggtacggctattcgaatagattaaactctgatcagaggcgtaccactgtacccacaagacacaaccccacatcatgtcaccctgtgcctcaataccaccacggtacctcggaaaggagttgtgacaataccccttgcacaacataatccattacagcgcacctttcctggatcataatcgcccccttataaacaaggcatggactccccagcgacccccgtggacttctcgccacttcacagtctggcgcactataatgaatcatgctatataaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataattaaaataataaagtaacatagtttataattaatccctttagttagctaatgtttctaagcatggctaagcaaacttacatatgacatttagctgaaccaatccaacatataaggttcatgctaatcaaatttataaccccataggaaaataagatcatcttcggccattaattaattgggaaaggttcaccacccgatgacattcgaaaacaatgcatagttgaaataaaataatagctttaaacgggttcaacatgctcaaatgtttgtttgggatctgtgtgacttgccttgggcttccgcaaacgcttcggaatcttcctcaacggaaacgctctcctccggaacgtcggaaactaaagcaattaaacaaaaattaacaaaacagtacaaaaacaagcataaacagtacatgtggatatttttaacatgtagatcttgattttagaaaaaaatttaacaacttgaaccacctgaaacggatctacggtactcaccaatgcgtccaacgacgaccgatggtggccggcgactagaggaggcggcgcggtggttcggttgaccggcggcgacggggctccggtgatcggcggcgtcggcggtggtgcggccgggcttcctcaccccttggcgaacccaacggcggcgacggcaagcggcggcgacggcgcaaacggcgcggcggcgcggctggactacgaccggcggcggggcggcttgacacgcgcggcggcggcgctacggagcacgggagaggatgggagagagggcaaacgaaagaggaggactagggggtcctatttatagccttggattgaagagatcggactcctcccgcaagaaatcgactcgggaaaacaaaaactcggttttagagataaactcgaaaacgagttcgattcggacaagatactcaacgattagctccgatttttgggggtaaagatagaggagaacgagaggataaaaactcctcaaacaatcggaagaaaaagggccggattaggtgcggatttggaggggaaaaggggcggctcgggctagcaaggccggccggccggaggtaggagaagggcccgacatgtgggccccacatgtcggtgtcccatgagaggaggggcgggcggctcggcttgagccgactcgggcggccttgggccggctccggcgcgcggaagagagaggactgttgggccgaattgggcccaaccgcttagggaggggtttttgaactttttaattaactagcaaaagtgcccgtgcgttgcaccgggtgattacagagtgtgtatattgaccaaaagtgttgtttggtttagcaaaagtgtccgtgcgttgcaccgggaagtttacagatcagaaaaatatgcaattaattaaaatacaaattcgctgaaatatttggtatttttaagtaggtatatgtgtataattaaataaatttacaagtaaaattctccattctccatggttaaataaaatgacatggttaaatttaattttattaaattctccataattagttacgctctttggaattttattggaattttcagagcttaattgctaattttattaatacaaacatcatttaacaattatttaattggaaaaagaaagaaaatactttcttataggtttgcttcgaaataaacatattcaatagaactataattgtaatgcttctgaaaaaatgagcactaaaaatgtacttattctctttttttcggctcgagggaccaacaatagacttatttccgacctatgccggtcggcccacggccttttgcgcatgcgcgggcgcacttttcctcccccaggccgcaacctgggcttgggccggaaaagaggcctcactctcgatccctcttgggccgatttcggcccggacgacaccggccgtccgatctctagggttttgatcggacggccgagcgtcaatagtggagaaacaaaacccactccctcttagccgcggaaccctagcccatttcccttcctcctatctcacttcgccgccctctcctccacgcccccgagcggcggcggcgacgacggcgcccctcccccaccaccgatggcggcggcggcggcacccccaccacccacggcggcgtcggcggcatcctcccccaccaccggcggtggatctagcgggaggggaggcgccccgcgagcggcggcggcggtggagtcctcccccaccaccgacggtggcggcggcgctctcccccaccaccggagagtgccctctgccgccgccgccggcggatctagcgggaggggaggcggcggcggcggtgctctcccctccaccggatccacagcgacggcgacggcggcggttcggcaacgacggcgacggcgacggcggcagcggcggcgacccccttcgatctaattttttgtttttatttggatatatgtgtgctggcggcgacccccttcgatctaattttttgtttttttgcaaagtgctataaggctgcatgtgattctttgttatgtgctatgattttttatactatgtatgtatatatatgcacttgttctcctggtgatgctaaccgaataggacttggtataattcaaaccaagtcctattcgcccaaacagaaacaaaatcctaatcagctcaaacgaaaacagatgggagtttgtttcctatttttgtggaatcggacatattcttttaccgcgttgatgaatcggattcgttccggttttttttcacccggttttttttgacggacgatggaagcacctcttattttttaagtagtagtagaaataatttgtgaaatgttgtttcaattattaaaaatacttcccttgctcaaataattcccagaaaattctagaaaatagaggaacaagcaaagtacttaataaaattttatctagctcatttttatgttgaaaattttcctagattattagggtttagcttgtaggcttttaattttaattctaataaatgatttaaacaatgcatttttaatttaggcgatttttagggcgtgacaaacctaccccccttaaacggaatctcgtcctcgagattcggaagaactggcgaagagatgaagatgagctgacttcaattcatcttctcgctcccaagtggcttcttcttctgaatgattactccactgaaccttgcagaatcgtataacgcgattcctggtattcctctcgcttacttccaagattctgactggcttctccacataagttaaatcttcctgaagctctatacgatcaggatctgcttcctccgtaggtacacgtaaacatttcttcaactgcgacacatggaacacgtcatgtattcccgccattgacggaggcaactctagctgataagctacttcacctcttcgactcacaatcttaaaaggtcccacgaaacgcggcgccaatttccctttggtctggaaacgatgaacacctcgtaatggcgtaacccgaaggtatacataatctccttcttcgaaagccaaatctctgcgacgattgtcggcatagctcttctgacgtgactgagcaacgcgcaacctttcttggataatcttcactttttcttctgcctcgcgcaatatgtctgtcccaaaaacttgacgttcaccggtttgatcccaaaggagcggcgtacggcactttcggccatataatgcttcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtttgagggtgataagcggtactgaaattcaaacgggtacccatctctacttgtaatttctgccaaaacttcgaagtaaactggctacctctatctgacactatcttcttaggaacaccatgcaaacataccactctggccatgtataactctgcaagcttattccccgtataggttgttttgaccggtatgaagtgagcgacttttgtcaacctatcaaccactacccaaatagaatcatgtcccgccgacgttctgggtagaccggttataaaatccattcctatttcttcccacttccactctggaatcttcaacggttgtaacagactggctggcttctgatgttctgccttgacccgctgacatacatcacatagagccacatattctgctatttcacgtcgcatactggcccaccagaattgttgctttaggtcttggtacatcttagtgcttccagggtgaatggaatacaaagtttcatgagcttctttcatgatagtatccttcaactccttattttctgggacgcaaattctttctcctaaccacacagttccttgctcatcttctacataaccgatggcttttcctcttctcatgttcttttttatttcttggatatcaagatcattcacttgagcttctctaacttgatcaaacagagtaggttgagcctgtaaagtagccacaaaacctttgctgactatatccaagtttaacttttcaaattcttggcataactcccaaggtaaatgtcgaccttctgacatattacagtagctcttcctgctaagagcatcggctacaacatttgctttccccgggtgatagtggatttccatatcataatctttaatcaactctaaccatcttcgctgacgcatgttcaaatcaggttgagtgaaaatgtacttcaaacttttatgatccgtatacatctctctacggttaccgaaaagataatgacgccaaatcttcaatgcatgcaccacagctgccaattctaggtcatgcgttgggtagttattctcatgaggacgtaattgcctagatgcataggcaaccacctttccttcttgcatcaacacacaacccaaaccgagtcgggatgcatcacaatacacttggaaacctttcctcgaatcaggcaaaattaacacaggcgcagtcactagccttttcttcagttcttggaaactttgttcacaatcctctgtccacttgtacttcacttccttctgaagcagacgagtcattggtctggcgatctttgaaaagttctcaataaacctgcggtaataccccgcaagtccaaggaaactacgaatttctgaaaccgtcttgggttgcttccaacttaacactgactccacattgcttggatctactgccactcctctagacgagatgacatgaccaagaaacttcacttcggacaaccaaaattcacatttactgaacttggcataaagctgatgctcacgtagtttctctaaagctagacgaagatgctcttcatgttcttccttcgtcttggagtaaataagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcaccttctagttgatcaaacaggtcatcaattctgggtagaggatacttattcttgatagtaacctcattcaacgctcgataatccacgcacattctctgagtatgatctttcttctccacaaagatgactggtgctccccacggcgaagtactgggtctgatgtatcctttctgaagcaaatcatccacctgtctcttcacctcagctaactcattagctgccattctgtatggtctcttatggatagggttggttccaggtaccaagtctatccgaaactctatgtctctcttaggtggcatacctggcaaatcctcgggaaacacgtctgggtagtcttgtactatggggatctcttgtaaagcaacttggtttaagatcacaccatgatatttaggagaggacacaaagaaagaaacggtttccccattgctactgcttaaagtcaccttacggttggcacaatctataactcctctgtgacgagataaccagtccatccctaagataacatctagatctttggattctagcaagataagcgaggatgggaaaggaacttcttctatttctatagtaacggaaggacaatactgtgtcgaaaatacttgattgcctggggtattaactagtaaaggtctcccaagactaataacttccatcccattattgctcgcaaaacttttagacaaaaaggaatgtgtagcaccggaatcaaaaagcacagatgcgggtatagagttaacaggaaacgtacccaaaaccacatctggtgcattctgagcttctgctgctgcaacatgattaacacgtgccttcggtgctggagcattggagttgttcggggctggaacgttcttcacgcaccgaggcttaggacacttatcagcataatgtcctggatcaccacaattgaagcacacccctggcttgcttccctgttccttcctgacggactggttctgagctggagttgctgcaggacgagcaaccatgttgcggttgtcattgccacgattaccagtattgttgttgtagaactggcgttgggggcggacaactgatgaagatcctccttgagggtacgatggagcttgaggtcccgtaacgagacgcggcctctggttactgccctgttgtgccttgaattgcgcagccctgcgcttcttctgctccatccggttatacttgtcttcctgacgaatcgccttgtccaccaactgctggaaatcccggaaatccgtagacatcaaggcataagacaactcatcattcagtccctccaagaacttctcctgacgctcttcatcggtaagaacatcttccggagcataacgagctaaacggttgaaatcatggaggtactcggtgaccgaacgagatccctggttgagtgctctaaattctctcttctttagagctacaacacccgttggtatgtgtgtcttcttaaaagcggccgtgaattcctgccacgtaataggctctccttcagccctgccttggcgaaaatgatcccaccattcagcagcaggaccatgcaattgatgcgaagcaaaagaaactttctcctgctcagtacactggatcaaatccaacttcttctccaccggatgcagccaatctcctgcttctactggattggtggtgcttgaaaaggtagggggtctcacacgtaagaaatctgccagcttgttttagggaggtgggggtggattctggttctgattgtttgcctgctgcactaacagattgatcagttgtgtttgttgggccagaatctgagctagcgtgggatctcctccattattagcagctccgcttccacttccacttccacttccggtgcgcgtgttcaccatctgacgataagcagagacaacaggaaagaacgacagagagacacccttagaacggagttatttaattaatttaaattctatattgctcttaactgtgtatgattacatttaaattgcattaacactatctcaccaactatcttacactctgacaagcaaaagaactagactcatgctgttacatcccaccaatgatgtaagcaacaactaaacccacacactcacaagcaaacttaaacaagcaatctaacacagcgaactacggcaacgatctaactaagcgactaatcccgccttgcgtcggaacgaagcgacggatcttcttcctctggagtagctggctctctttcttcagggtcttcctcttcttcctcatcacttatgatgtcgatgacaggttcagcacgattgggcacagcttcacccatcacacgaatcttcgaagctaactggagacgaggtggcggacaggttctctttcttgcgatgaggcgaagcttgggtgttggcggcggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccgcatgcatcagagcggcactctcttcaccatcaggacaggtataggttccatagtcttgaccatgaggcttgtgaggatgatactggaaagctgatgaatccaactcttcttcaaagcgttgacgcaactctccaatggccaccaaagctgcttcttgacaagcatggctgtacgatcttcctccagcttcgaacttaatggacggaaggtcttcacgatcactagccaacgtcacacgaacatgacacttctcctcgttggggtcatgggaaatccggcgatactcaggagcaacttcatagcctacctcaaaagccatcaacctcaactccctgacgaatcctaacacctagatcaaatttctcggtgaatggggcggcatctaaagaaacatagaagagaggaattaatgcatatatttttttttaagttagctgcaccatctagacttaactgatttgaccaaagaggaagaaaattaaaagaaaagacacatactaagctattatatatatatatttttagaatttaactttttggacagagacaaataatttaatttttttttgacaaataactaaaataaaactaaaatacttatgatctattataagcacggtacagtgtcaccataagaaagatgagtagtacttgtgctaccatgattgtatcgataccataatagatgtacagtgccgactaatcaatgaagtttactaaggcggaataagaaacattttgagaagaacaaattttttttttaaaaaaaagaaaatgaattaaattgattttgtgcataaccttgcatgtgctgccaacttaattaatttataagagaatagagaagagcagttctatttttgtcaaaatattttgaaggctacttaaggtttaccatttggcttatcctaaggtcagggtggctctgataccaacttgtcacgcccggaatttctatccaaaattccaaacgcttacatgtgtgttaaaccctcgtccaggaatcaaccgaggcacacaataacaaaattgataatagagtacaaataattaactatttaatattcgcaaataataaattgctacagaggtagatagtttctccggcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaagattattgcgtcagcgggctagggtttcggtggaccgggcgcacgggcggcggttcacgcgaacggacggccgagatcgatccaatccaaaacggacggctgagatcgaacggtccacgaccggctcacggcggacgaccccgatgacgtcggcaatgacgtcaccgacagcggcggcggctcggcagagcggacggctcgggcggcgcacgctcgccggcgaacggcggcactaggacgcaaacggaggccaccagcacgtagaggacgacgcggcgaacacaccggtgaccaaaacggcggcggaagaacaacggacgacgacggcgacgaggaggaaacggcggaaaccttcgggttgatgacggcgacgaagctctggcggtcttcggcggcggcgaaggggcggacgaggacggcgacgacttggcgaccacgacggcggtcttcccgagcgacggcgacgaccgagacggcggcggcgcacggctggagcgacggcggcaacggcggcgctagggcacacggcgctagagcgattccgacgacgagaggcgaaggcaagggtggcggcgggtagaggagacaccggggatccttttaaaggggctcggaggcggcggcaaaggcccacggcggccggtgacgaggaaggaaagatcgggaagaacgaatccgagacaaactcgaatccaacgctttcaaaaacgatttagccaaagattccaaaggagaaaaggtagaggagatcccgaggatcatttcccctctatcaattcggccggaaacggaaaggagcggccggattggaaagcggcggcggcggcggcgcgctagggtttcggccggaggaagacgacgggcctgacaggtcagcgagggcgcgcgcgcgggcggcggactgggccggctgggccgaggagagagaagagaggttttgggccgactttcggcccaaagccaaaagaagacttttaaaactttttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttttaggcttttaaaatcatttctaataattccttttaaacaacaatttataatttaaggattcttaaacaagaaaagctcttaataattataattagatcattattgatcaaataattactgaactgttctttgtatcatttaggaattgagctccgaaaaatctgagaaaatttcagagagttgacttaatcatggagaatttaataaaaattaaatccatccatgctttatatttaggaaattttatttcccacatttaacttcacttgtaaattaaagaacatttaatataaattctattattaatttattaaataatttataaatcctgaaacgaaaatcaggatgtgacaaaattgactcgggaaaacaaaaactcggttttagagataaactcgaaaacgagttcgattcggacaagatactcaacgattagctccgatttttgggggtaaagatagaggagaacgagaggataaaaactcctcaaacaatcggaagaaaaagggccagattaggtgcggatttggaggggaaaaggggcggctcgggctagcaaggccggccggccggaggtaggagaagggcccgacatgtgggccccacatgtcggtgtcccatgagaggaggggcgggcggctcggcttgagccgactcgggcggccttgggccggctccggcgcatggaagagagaggaatgttgggccgaattcggcccaacggcttagggaggggtttttgaactttttaattaaaataatttgtgaaatgttgtttcaattattaaaaatacttcccttgctcaaataattcccagaaaattctagaaaatagaggaacaagcaaagtacttaataaaattttatctagctcatttttatgttgaaaattttcctagattattagggtttagcttgtaggcttttaattttaattctaataaatgatttaaacaatgcatttttaatttaggcgatttttagggcgtgacaaagcatgcaaccaatgagtatttagatgactccttgggttataatcaaacatttaatttatctcttcatttaagtcttgaatacataaagactacaaataggaacaacttatttggaaaaactcaaatgtgaaatatgtttaacttttgtgaatggagggagtatcattattagccgattggtttctactggattatacttcctccgtttcatattagaagactttctatcattgcctatattcatatatatatatatatatatatatatatatatatatgtgtgtgtgtgtgtgtgtgtgtgtgtgtacggtggcgctacccagcgccacacacaggcactggcgccacggaacaaaatggcgccacacacaacgagcagatgtcatcccaccaaatctatccaaggtactagggagttaaaatttaactggtggaaattgtggcgcaaacgaaaagactgcccactaaaccaaaccaacggactgtggagttaaaaaataacttgcggaaaacatggcgcaatgtgaagcaacgaaccctctcctaccggaccaaacaaaaccgaatgtgaagttgaattttaactaataatatgttgggtgatgcgctgcggtgatttcgttgttgagttaaaattttacctatgttccggctgtatgaatgagccgtcattaacttaaaattataggttggtggttatgtagttaaaaatttactggtagattcttttttttatggatgtgtgttgtttctgatgacaaggaatatgatttaaattttaacttatcgtaaactggtacgagtagatgaaaaactttgagacattaggcagtgatggtgatgtgtgacgtaattcacactttattattagagttttattgttttgatgcacatctccccggaaattacatcgatggaaattaactgatgattaattcaccggatagaaatcaacaccatgtcgccggatccgccagtccagaaactacgaaatcatagcgtgcattgatttggcgttaattcaataagctgttagaggaggccccggaataggcggaattttttttcatgcgatacatcctgttgtggtggataatgaacagagtccttgatccgaaaataatgcttgtacacctaaatttagttttctctccatagggaatggaatttctgtttcttttaggtatggtcagattcaactatcgtacatcatttagttacttttactgacaaattacaaatagtaaatattttactctaaacattacatatagtacttttttaattgtcaatatactgatatgtagattgcaatttttttgcaagatgtctggatgcatctaatcatataggaatcacatgtattagaaactaatcacacacaaataatgcaataacacatcggtgagatcaaataacaggacaacgtccaaccaaaatcaggaaaaataattgattgatggtgttgttgatcctggcagctttcttctccttctggatccgtcaaatggaaaaaaggtggctctcgctggtttcctgattgagaacggaaacaatgggctgtggccactccttctaccggtgaagaagatgaaaatggaaaactcggagagaggcatgctcggtgccgccgtctccatggatgcccgctgctccatggatgccggagaagctcaccgccgtgaaggttgccgccatcttgcctcctgcccatagtcttcacccatgcaggatccacgcgggaggaagggggcgccggatccggcgcgtcaaccgcgctggatccgcgccgccgtagctgcatccgtgcacatggggcgcagagcggcagccggatccaccgccgcatcgcctcctggccacagtcacccgtcgataccgcacatgccaccatcgcgcccgtccacgcacctcagcgccaccggatccgccgctcctccttgacgccggtcctcctcatccccgaactgccaccgctcctcctcgtcgccaagccatcaccggaactgcctcgccaccactcctcatcccctaatcgccatcgccgttcctcctctctgcacaagaaaccacaagtcgtcattgatccgtaaaatgtggagaggaagaggaaagagtgggtagacgatttctaagatgggaatctgtaatatatataccagatagagtcagtatgtcgacttaaaatttaactgtgtggtatgcatcagatcgagtatgcgtgggggtgggtagctgagctaaaatttaactgtgtggtatgcactagatcgagtgcgtgtggggaagggttgggttgtgggtcgctgagttaaaatttaacttgcgcgtgggggtgggtggttgagttaacagtttgtagcttgcaccaaatcaagttcacgtgggggtggcggggtggtaggtcgctgagttaaaaattaactgcgtggtctgcgtggggcaagggggttgattgtgtcaggcgccatctaatacgtggcgcctgtaataccatatatatatatatatatatatggtgcattagataccatggtgcccgggcaccatggtgccccatatatatatatatatatatatatatatatatatatatatatatatatatatatatatatggctctagagcaatcgtgttccatcatgttcactgatcaccatcagatgtacctactggtggagttgctatataggcacgatatatagtaggtaccatcagatgtacactccaattgctagtgtggctattgatgtcagtggatatattcatgacgttggaggagagagatttggcctttgagtttttttctcctgacaagaagtaaattccggctttgacctttcatttgttcactgttgtgctgattttcttcagcaaactaacctgccactacagtcgatactctaatttgtgctgattttctattcttttacactaactttgcacgtatttaatcatgtgtattttttatttttttatatatatggacgtatccacacgtatccttgtttcttcgaaaataatatatccacgtatagcgtatatgtactcgtatccccgtatctaggtaatctatgtagagagtggttaactgattctttttaattagattcattggcagcattcaaattactccacgtgattagatattaaacatgttgattttaatgagttaatataaacagcttgtttagtatttccaaaatttaatctaataagtttggttttattgggatataatatatcaagatggttctccactcaccatgcaaaaacaatattggcaaaaaaatggaatttcaaaaatgtcatttcgcaaaactgatgtccaaaaatgatatatcacttgacatatatttaaataaaaaaacacatgactgttatttttttcatatatatgatacattctaaaatataatcttgttataatctacagagaaaataatgtagactacagtttgttgacaattaaatatcatgttgcaaaattgacatccaaaaatggcattgtaaaaatgatatatcactagccatatattaaataaaaacacatgattgttattttacatatttatgctacattcgaaaatataattttattataatctatggagaaaataatgttcactatagtttgttgatgcgaaaaatgtaacacaatgaaaatatcattttgcaaatagatgtaaaaaaatggcgttgcaaaatgatactccctccattccataatgtaacgaacaactattttttaaaattgtttcataatataaggcgtgcatgcatgtatgcatgtcattaactagctcatctttttcactaaaatcttattatttaaattctacacaatcaacatctctaattttattgggtacatgtattatatttattagggtaatctaaactataaggtgataataattatttgttggtctttaaattaaattaagagtggtttttatattttgaaatagagggagtagtattttccgaaatggacatgtatggtacgtacattccatacatggatacaagaaaagagaaaagaaagaatatttaaatgggagaataaatactacacgatgaggtcaacttcctctcacctaccatctctctcattactcaggaagtgcatgctccatgtcagagagttacacatgcatcctaccaccctaatcttattaactctcaatttgtgaaagtatggtacattttgaaagcacgcatcttggaatagttgaacggatgtgattctgggtgcaggtgaaccgtggttctattttgattttccatatatatatatatatatatatgtatatatatatatatatgtatatgtatatatatatgtatatatatatatatatgtatatgtatatatatatatatatgtatatgtatatgtatatatatatatatatatatgtatatgtatatatatatatatgtatatgtatatatatatatgtatgtatatgtatatatatatgtatgtatatatatatacatatatgcatatatatatatacatatatgcatatacatacatatgtatacatacatacatacatacatatatacatatatacatatatacatacatatatacatatatacatatatacatacatatatacatatatacatatatacatacatatatacatatatacatatatatatatatatacatacatatatatggtatatgtatgcgtgcgcgcgctttgattcattagcatctatatgaatgtgagcaatactagaaagtcttataatctaaaacagaggtagtaatgttattttattatattatcatcaactgattgcctttatattattatttattcaagtattataatatacattggatatatagccgattgttgaaaaccctatcgacatcagcgggtatcgttccatcggcttgcagccgatcggctctttgatcttcaatgctaggcggatctccaagctactgtgttcgtcgatttaggtcgctccaacacagatctagtaccatcggtagagcgcggattttcgctccaacacagatttggcacgcccagtgggacacgagttttataccatatctctaaagaaaaagtcaatgccaaaaaagattaagaagactcaacttcccatgtcagtggttgaaacacttcaatataaagttgatgaaacagttcatcatggcttcttcaatcaatttggaattctggtgaataaattgtaaaatttaaacaagagaacacttgatgagttaattgtttgaggccagctagtgggcagattgaagaacaatagcaatatcggcttaggggacaggcacatcactatcagcatgataagtcaaattgttccttaaatattatatggtagatctaaagatgcagcatgtcccttaattatattgtactttctccgtgccaaaatatagcaacctatcagcatgataagccatggggtattcaggtgtccacatacattaattggaagggtcacatccccttgctatattttgggatggagggaggctgaatcctgctgatgacgacccggactagacgtcatcaggagataggacccgacgtgggctgacgtgggctgccactgctcggcatgctttccccggggacacgccacagttattatggacaaaaaaataaacagcaactattaggaaaaaacagattgtctcacgtgatggtaaaaaaagtaaacatcagctattagggtacccgcaatggttatctatagactctctataagagatccatatcagcatattttcctacttaaaagagattaaatgcaaaacgagagcaaaattatctactaacctgaagatagtttatagagaaacgaggcaatagcttagagagctataggtacccatatagacatactattgaggtggtttactattaatctagtctattattgagatgtacatgttttatagagagcactttactttaccattgcgggtgctcttagcaaggttgtctcaagagacattgcttgctactccctccatctacttatgatagtcatatttccaaatctgaataatttatttttgatagacatatttcaattcaacaacctatcatcttaatgactttttcggatttaatacgtgactctccattcttccgcacaagattggctacatgaacatcgagaaatgtaaatattaatgaatcgcttgagtatgaatgaccagtagcatgtttaaatggatgataagtaaaattatttattgatatatgtgtcaaaataaaatataactattaaaagtagatggatgaagtattaattactaaaggagtaatggtgacgagatactctcaagtggtaaataaggaatggagcgtctctagaagctgattcttaaattatgtggttgtctattaattacaaacatgtagtctttgtgtcaggtaaattttaaatctcgatagtgtttgttccaggcctgcggaactgcacgttttgttcgagcaaggaagcacacaaatatttgatccaacttttccgggtacgtttcgtgttgcaccactccttccatttaatattatttgacgtttcgaaatcaattttcaaacctatagccaaataaatttcaa

SEQ ID NO: 16020 - DNA, 21122 bp, Oryza sativa
ttcctgcagcccagaacatgtaacaatatcacatactagattaaatctgggagggaggtgggtagtaaaataaatatgaacaattctctcttcaaatttattattatttgaattgattatattaggatgtataatattgttgtctagattgatttactagtccctaaccctaaaccctagaattttatgatgttcagattcataatactagaaaatgtctcatccgattttaaattctaatatattaggacagaggaagtatttttgaacagactcaatctattttcgaagagacgaagtagtacgatggctcccacgtcataactatactgtactatattaactgctgtctagtttgcacgtgaaacatgagcagctagattcgcgagagaatggttaattacctcccgatccgatctaagcctggctaggtcaatgtgtatcagtttccaaataaaggtttatccgattcgaaggaataaaaactttttgaagaggttagagtggatgcaaacattttgaacacgatttcgtagtacatatgcactctataatcctaactatttgcatatgcgatttcgtgcataccattgccatgtatatttcttttttatataactaatatttttaaactgtatattatttcagtaaatttcgggcatatttactttgctaccattttcaaccttaacaagttttggtattgccaaattttggtaaggttatcaaaattttagcaaggttgtcaaattttggcaagatttcatatgtatttactaaaatttagcaacaaactaaatatagccaaaattttagcaattttaccaaaaatggtatggttgaaaatgacatcaaagtgaaccggcctttcataaacccccaaattatataaaaccagagggattttaacacatggcatataaacctagatattatatatagttctaaagtgttacaaaaccaaattgttaactaattttacatactactatatcaaaaatcttaaaaacctttacatgcatgcatgaaacatttatacgatgaataaaaacttataaatttgagatgtgattgtagacattaaaagtatggcagataaaactaaaaactctaacattgtagttattttaaataacgtggagaattaataccatctttacttttaatacaataatgaagagttactttgtttttagtagtgcagttaatactaatcccatcttactataaagttgatgtccactaactactaaggccatccccaaccctctatgtcatctagtgtccagagcatttaatacattgccacataagtaaaaatgtgatatggtaagagagtcaatgaggagagagataaaaagttgaagaaaccacaagatgataggtggataaaaggagagagaatatagatgattggataagaatttaatttgaagataccatctattggatagatagtttttatgcatagtgtctatatgacatggcaagtatgatgactactaaatgatttctgggttggggatggcctaaaacttaacatgcaaccataccataacaccacccactaacaataattacatatttaacttcatgcaatcatacaaatcgtctatgatttatttaattctacaaaatcaacatgcaagtatatctaattatcaccgatcacatcattttcacaagattttaccaaatctatctatcattttataatatttaacatatacttatcaatatgttacccattaaataacgggtattatttgtttgtttcatgataagtaccgataaaccctcacattttatcattttcttttcttcttactcctagctcgattgttgaaaaatatatattgaaaattgcttattaattcttgtagcaaagcgtgaggaatcacctagtgctataaaatgttactttcctagcactgtagttacttctaacaacttgatttttttttagatttactttcatgcttatatttttgttgttaattttatatttacttccctgtagcaatatagttacttatagtggtgaagagttacttctaatctagtgaaaagttactcctacttttggtaagatttacttcccttcagcaatacagttatatataatatcttgaagagtaatttctctattctttcagttactttcctgcagtagtattgttacttctaatatcacgaatagttacttccctctagcagcatagttacttataataccgtgaagagttataaaattacttttttcataaaaaataatacaaatattaattcaaataaataaaacgcatgtatgtatcttcgctgcgtttgacatgtgaattataattcacatagtattttttttaagaaacacagtgcaaaaatagatgctcattacacccacacactcacccctataaacgcatacatgcacaccctaaccttatgagcacgtaaaaacacacaggtgcacactcaacgccctatgatgcagacgtgcaaggggatacaaagatggtttgtggctttttgcataaaggcatattaaaacattttattaagcaaaatagtaaaactgttgtgtaattaaggtaatattaaatctccactgatcaacgctacaccacgttgaacaggcccaaccatcccacctgaactaagtgcattgagtcgatttattaagggtgagactaatcacggtgaatctggtcgatcgatcataaccgcgggcacggctattcgaatagtttactctggccagagatgcacaactgtacccacaagacacaatccaccggcatgtcaccgcgtcatcatgcgcctatgaagaacacgtcaccatgtcaagtgattgtgacaagacccttcatataaccctctgaccaatcgcacaacacctcaggttacgcccccgcccccagcaggcagccccctctcgtgtcacggtgaatccgaaagccgatcaactgaacagcccggatgacccaaccccatcacgcccaccctagcctaggaacatcagccagaggaaagctatactacagatcaagcagttacccattcccacttgtggtaagcgcggtaagtcttccagtgcatccggcgaaccggtccttaattgccatgggtgcgactagcaaaactatgcacccacagcccaccattcagtcgcattttagttggataattacaaccaatgaaacatggtcgggtgtctcgagcacgcagctcgtcatgatactaaaaaggtctaatactgcagttatcccatcaattgagctagtggtaattaagcatggctaagcgtattgttctagctagatcacataagtaacatgagctagtcgaattattacccaaggttgacaaaggacagatatcaagtaaacatggcacaagtgactagattggtaatacccagatcccatgtaattgacaaaacatgcatatttatttgcaaatggtaaaacatttataaattgggatcaacatactaaagggtaatgtgtgacttgccttgcttcttcacaacaaccttctgaactctgatccttgcgaccgcgaacttccgaaacaacggattctacacgctggcacgcaagataaggaaaaactctaataaaaaccaaggaaacagtacattaaaaagtaaacaaacatgtagatctcaattttagataaattttgcaagttgaatggcccaatttagagttcgtataaattagacatgaattttagaagtttttagccatttaaatgaatttctataattattaccgatttatgacgcaattattaatggctgacattgtcaaggggaaggggcggcgccggcaagcgggccccaccagtcagcggcacaagggcgccggttcaccatggactgggaccacggaggcggttcaccgccggtccacgggaaccgacggcccagatcagcccaagccgatcgggcggcgacgaggcggcgcagccaaggcacaggcgtggcacaaggccggctcggccgagccatggcgctgggcggcgagcggccaccggtggcagcagctggcggcggcgcggcgagtggagccgaggcatggcggcgacacacaagtggtggccggcgcggcaaatagagggaaagaaagggaggggaggagggggctggcggagctcagggtggagagaggcggcgacgcgcccgcaagcgtgcagcgccaacagaggggcggccaaggagcatcgtgacctgaggaaggtgatgggtgggttaggcgagcgcggggtggccggaaatagcgaggagaggcagccagaggcgacaagggctgcggagctcaccacacgcctagagaacggagtctcaacagtggatgacgagggcggagtgttggccgggcatcctcacggccttgcgaagctgaaggtggagacaagctggccccacgtggcgtccatagccggcggcaagcggctagagatgacgatggctcgggggtgctcggtggaagggtggttgcggcagcggattggggaaatggagcggtggccggtcttgcccttgcggttgcgaagccagtggtggagagcgtgagcccgagagctcggagcagtggggaatggcggccggaggtggacggctcgggttggtggtggacacggtgcttcgttggtagtttggggaagaggagcggtggacggggtgcgcacggtggctgcggtgccggggaaggcgatggcgcacagcggggtggacgagagcggtggtggtgcgcggctggagtcggcgtcggcgggggagagaggtggtgcacgtggtggcggcgtttcggggtggaaggagggaaaaggagtagaggccggggtggagttcggcacggcgattccgatagcggtggcggcgcagcgcggtggccatgcacacaacgggaaacggcggccggagcactccggcaagcggcagtggctcggctttgcgtggggagagcgggagagagcgcggggagctcgggcgaggaggggaaacgagagaggaggactgagggaagctttttaagggatcgggagggggagatcatgcccgggagaggcggatttgaaggggaaagggtcgccggtgacgtgcgtgagtggggctctaccggcgccgtttttcgcagggtgagggggggattggcgcggacgtcggcggtgaccgcgtccacgcacgcgcgggagagggagtcgcgcgggagagacggcgacgtggggtggtgcgggtggcaatggcggttgccggcggggatagatggaggttggggatgacaggtgggcccacaggtcccacctgtcggggatagagagagggagaaacgggctagggaggcaaaatggacttgcacggggaggcaaaggggctgggccgagggggaggaggagggggaattgggccggggagggaaaggggttggctcgagagggaggaaggaaggggaatttatattcgttttcttttcattttaattgagttaatgaactttgtgctatttaaattatttcttgagatccgaaaattcacgggaaatttcagagagtatattggggcacaaagaatattacaaaatattctcggccaatgatttttaaaggaaattttttattccctaactatttcacttgattaaattgctttaacttttaatataatttctggaaatgcattatttaataatttttaatcccgagcgaaaatcggggcattacaacagctctcgtgggccacataggccaaatttcaaatgggccaggatgtcacaacccccctcccaaaaaaaaaaaggacctgacgtccccgttggtccaacttacccgtatagctacacaggcataggaaaatgtccatgaatgtgtcccctcttagtgcacatccatacgtccagtgcaaatgccatatgccctgccatgtgcttcacacaacgcgcaaccgcgagggtcagctcagataccatttctaacagctcaccctctagagccgcttagcccaacctatccgactggagggcccacttacagataccactctgcttacatttccattcatacttcatgtgaaagggttaactcggggaacatatggatggaggaacaagcccttataagttagttccacccttcctaaactaacaaagtggtactaaacatgtgcacatagctcttgtgaaccacacatgccaaatcctaattaggccaggatgtcagccttgggtgccggatgagaatgtgccccgagcacaacccacgaagggtcgtgctttgtgggatgaatgttgatgagccttgagcacagcccactagggggcgtgcttcgtgggcttcatggagcatccctcttcgattgtgtcttaatccagcagtgcgacgggggccctagtacccatttctctgacagtagcccctggccttgaacccgggaacggggccagatggtaccaaggttgaggcttcttctgtcaaggcggatgtgcatatctttgctgtttgttgggttggttcattggccacccatgcttgtgctcaggtgaccggtgagctcaagagttgtgggatgccccccgaatgtgcggtttcaagttgaccgatcatggcacgaggacttcaacagtgcctggagtggagctggccggaccgagtacggcagcgcatatttgatatctagtctagcctgatagaggtgttttgcttgaaacctcgggactttggcaatacttgggcacggtccaagttccaaactctgttaacaccaaaatttgctacggttctttagtacattcgggttgaggaaagaagccaattagtatatggaagtttagtaagatcaaactgaattcaaagaagaatcgtgaagaccacagcaagatagtgtcatatttttagtatatctctaaaatatgcaggattagttatttttcttttcttgttaggagtcttatcttgtgtcccattaggacttatatcaacccgagagtataaatatgtactccccggggtctttgtaatctatcgccacagatcagtacaattacttgtaagacccggagacattggatcttgtacgatataacagaaactctatcccctccgagtaggactttggaaatcacttgactagtagagatattttctataatttgcaacagatttcaacggcgtacatgggaacaatccgtgtacatgaaggtatgcaatattcgtatatttcataagtcgtaggataggaggtatgccttatccgtaaccatgacacttctgcccagagttttgagtcattgtagattttatatgtttcgacactcctcttaaaccaagaggggtgatacatttgtcgacaaaagtggccccaaatctatattttcctatcatttttaggatgtatttcttgtaagctttgctaggggagatttgctcagcctacacagagtaggggaccgtggacacaccatctaggatcccctacgtttaacaccttaatatatggattttgcacgtcactatgctccaataagtggagcatgcgtcatgtacgagggcaagagtgtgtccgggccccaaaacagtccgggttcctggtcacttgtgaggacccaaaataggacctcatatgtatatgtgctaatccaagatccacctagcacatacagtgacaaagataatatgacacccaacataggcaaagataatatcacaggaaagctaatatttattaataaaatgattgtaataagccttatggccccacttaattacatttatttaccttaagggcaactcaagaataagatagcacaacggaaaagaacataaatgcacaaaaagctccattcaacatgccacaagcagtcaactggggcacacggcctagtcctcaacttcagcagcaaattcctcaaagaacagcagaaactttccttttggagttgaggcaattgtaaagtgagtacatcaaatactcagcaaagtacaaggaaatatccatatgcacggctgacaaagaaaggctaaagctattttgcataacatagctgttgcagttataaataatgggtgttaccattcgactgcccacacgggacctgtccacataagaccacacagctatattcattaacctgcacaaaagtcattctcattcaatgttttcgcaaactacctctcatgagatatcaccgagcatgtccatgaccgcggatgcggttattcgaatagattagtttaacactctacagaggttgtacagcttacccacaagatacatcatctttttgacggccagttcgacaatgtcaaactttagattgtgtgcggccaaggagtctagaacaaggctttttagaaactccaccgcaacactgccttacccaatgaaacacattccctcacataaaggagaaagtacccatggctaaccttaacacctatcgtctagccacctgggtgccaagactcggaatcctactaggccaagtccttcccatcaggacatgtggttgcacgataggcttagatcaacggcttatgaagtgaagtccttaattgaccaagtcaacttgctaaactataatagcacacatctcaacagtaggctcacatagagaccatgcccgtcaatgattacatagatacattaccgccaaactaggttcacacagaacaacccatcaccccggtccaaatcattttatccaaccgttgtttactacatgatgcaacacatgctactagaaacatagtacacagccacacagatcatataaaaaacaattataagtatataattaatcaaagttatgttttgcttgtgaaacaaccttgagcggggctaagtataactactctaccttgagttgagcccaatattcaactcacaatgactagggtaacaaggtatcacaggtaataaataataattaaaggtaggatataataacaattaggtcatactactcttcgataatttataaataaaatcatgcaagttcaaaacaaaacattttataaactaggttcaatatgttcaatgagtgtacttgccttgcatccgagtactgtccttgccccgtgtcttctgcaaggaatatctcctttgctccaatgtctacacgatcgcaaacgagaaacaaataaacaaaataaaagctagctaaataacatcaaatgaaacaacaaaaagaaccaggaggtagagctcgattttagaagaatttaggaaaaagaacaggtcaaatcagagttcgaacggaagaactatgacctctggaagtttgaattcagagaaaataggaggataaaaagaaacggaatattccgagaatattctctggatatttaattccaggaattgaattatttttgtgaaggaaataaaaggtggggcccattggtcagtggatcagagtgtggtggactgccacatgacgacacgtgaacagaaaaagattatgtggcgatgacgtggcgctgacggggatagatctagggctgacatggcatgggttagggttatgtagatccgacggtgtagattgaatctagggaattggatggctcagaattgtttactgattttatgttgtggggcccattcgtcagtggcacacagaggagggaaggaagcagagctcggcacgctctggccattgcaggaccgacggcggcgtgacggcgttcgtcggcggcggcgaaaggcggcgccagaatgtggaggtggagacgaacgtggtggcgcggcaccgagctccgtgtggcggcatggacggcgcacgacggtaaggttggtagcgccagagagagaagacaagagggaaacagagagggaaccagagctgggagatggagaggctttgcctcgcggctcaccggctgtggcagcgcttcgggaggatggggcgacgacgacgcggctcccatcggcgaaacgatgaggcggcggcggcgttgattgcgcacgggtggaagtggcggcggcaactagagctcgggaaaaggaaaagagagcgacggtggtggctatttatcgaggatgatgagctagggctacaagcagatttggaaggcggcggctccggatttgtcggcgacctcgaggggatttggcggcaacacggcgcggcgcggcctcaggtcgcgacggtgtgggccgagggcggcggcgtgtggagaaggagaggagcggccgggacgaggcgcagcacgtggactcggggcttggcctccctgggtcgagctgctcgggtggaggagagagcttcggctcctggcctaaggaagaagaaggtggagggaaaaagcagaggggcctaactgaaaaaaatgaaaagaagggaaaggaaaacgaggaaaaggcaggggagttcccggaaatttccaaaattagaatatttgtaattttaagatgatttaggagattaggaattgaataagaatatttttgaatttggatggaatttgattaggactttgagctccacaaccgaaatacaaatcaaatccaaccatctcctgttaagaaacaacaaagccgatgtcgtaattaattagttaatcatattaaatccttttgattgacgaaactttcattaacctatttaaggcgaacaaaccaaaggtgaattttcacgattcgacagaaagaacagaagaggaaaattcagggtatgacatcgctcctcagtttacttctctaagatatataaatgctaaagcacaaaggataaggtctcggaccccgaggtgggtcctagttgccttgtgctaggtacccaactacttatggttcaagtgttaaaattataagcacataatgatttaatttatttcataaataaatcatgacattgcagatgtaaactagtatgaacgcatcattagatctacatatgtaaattaagcagtaaaacatgaacagatcaaatatgcgcaacatgtcgaacacgtatcaaggtggccgaaagaccggttgctcggcaggaactactcgcggttgcgggtgtcgacgaacgtgcgcagcacgcgagcggagaggaaggtgagccgtcgcggacgaacagggagcagtcgcgcgaagcgcttcccaaaaaccttattgccgccttctcccggtgtaggacgtcgaaggcagaggttccggagacctgctctcccgatcgcaggtgcacgccggcgagcatgatgaagtagtctacgagcgacggcgcatcacagagtaggaggcaaaccctagattgatttcgcgtgtgttgcatgaaggcgatggctcggtttatacagagataggttgcttgatcagggtgcccgcacgatctccactccgcgtaaccgaactggataagtcgtgcgtaacttatccggactccatgccattttcacgcaccggattttttagactgtttccaaaacgaaacaaaccctaatttcccgcagcaaaacaaaactgcaccggatttttcagaatgtttccaaaacgaaacaaacccgaatttcctgcagcaaaacaaaactgtaaaaggaggctgcatctgtgcaagggtgaggagccagcgagcgcacgcgtgttccccctcttctctccaccatacatgcttcaagtggctaggaaggcatcttcccttttaaggaggtcccctctcctagaataagcaaggtgttactaaactccacatgcatgccatcccatgaggtgggtttttgtgattttccaaagaattaatcttcgagtgggctaaggcccatctattaattccaacattaagcatgccatttatcttaattgtaagttcatacctaatttatcggggtaatggggtaccctagtttccttatgaagagaattattcccagtcatttggggtagaataaacctttaattgataaatgtcaggaaagatggtaaaagtaaggattaatgcacattcaatcaagctctgatgaatacaaagtacaaaaactgccaatgaaaattgaaaaactatctatcacttctatgattttagagagcatgactaagttgtatttacttgaatgttatgcactggaggagggtgaaatatcgaagaatacaaaggtataaatcatcttgtccaaaagccttggaaaaaataataggacaagaactccagttccttaaatccctaaagtaaccggagatgtctcatgaaaaggggatgaaaggaactttcatactcataatcaccaaaagtaacctggaaaatggtatggaagttctgaagaggcacgccggatattctcatcaaggtagaaatctaccagttggagtgcacaccaacggcagtacactgaaatgattattcccgtaccaaagaatcaaacaagaagaagaagcattacaaattacatgtccccatatattcatggatcctcgcaaagtgtctcatgcaactaacagaagttggcaacgagacctatcatggacaatattttcttcagacatcaaaactcattggtagtcaactagaagttgaaaaataaactaaaagattgacttacatattgatccactgttgacaatgcatagctaaagaaatgttggattgagcactcaaatataagtatgagaagctccaaaccaagatggtgatccgaatagtgtgaaaatacatatgttcctcggtgtcacgcccggaatttctatccaaaattccaaatgcttatatgtgtgttaaatcctcgtccaggaatcagccgaggcacacaataacaaattgataaaaagtacaagtctttatctaatttattaaacgaaaatatagcattattacagaggtagatagttcctctcaataaataaaattctaagcagcggaaaataaagataaaagggtaggcgactcctctccacaagcagcaacttgacaaggactcagcctaatcctcctgagcatcaccttcgctatagaactcctcctctgatgatggatattgcaaggtgagtacttcgaatactcaataagccacacagcaaatatgcaagtgcacatgataacacaaaggatggcataatatagctcatttgcataaatagcatttaataaactttagagagtaataaaacaattgtagtaattagacattattaaatcaacactatacaacataccggttgtataggcccaaccaaacctgaataacaaagctcggtcgtacagatcaaacctccaactaggaattaaccattccaaaccaggagtttaactagaatcatcattcaccacattattattattattgttgttattattaatgaatagtgtgggactaattacgaaagacattattaaacccgcccataaccgcgggcacggctattcgaatagttttactttgatcagaggtgtacaaatttacccacaagacacaatgccacagaatgtcaccatatcatcatgtgcccatgctgaacatgtcaccatttgtgtagttgtgacaagacccctcacataacactactcaaagcagcgcaacattcctggttcatagtcacccccttataaaaccaaggtatagactcccgagcgacccccgtgggcttatctccgccacttctcagtctgcactccacaatgagccatgctatacaaagcgtctagtcatttcccactctggcttgtggttagtactgttaatgtttcacaacagtagctcgcgaactggtccttaattatcatgagcacgaccctcaaaatcttgtgcttacaacccaccattgttaggttttagttggcaattcattaaataactaatcacaattagccatcgtgagctaccattaaatatatgataataagtgaattatatgttatcccattaatgaactaatgtttctaagtatggctaagcatcctaatagctttagctagaatatatattactccctccatctacttttgatagtcatatttcatcttggcacacagaccaaggataagtaattctacttatcatctatttaaacatgctactagtcattcctcgtaaacaagcgattcattaatatttacatttctcgatgcccatgtagccaatcttatgtggaagaatggagagtcatgcattaaatccgagaaaatcattaagatgataggttgttggattgaaatatacctatcaaaaatatattttgcagatttagaaatatgactatcaaaaatagatggagggaatatgtcctagctaaccatattattgaccaatttacaaaggataggtaatcaatagcaaaaaggaccatatcaaaggaataggttcactacccgatgacattaaaaaaaatgcacattagaaataaatagagactataaatatagggcaacatgctcaaagggatgtttgggatctgagtcacttgccttgcgttgctttgtaagcttatgaaccttcttcagcgtaaacggtctcctccggaacgtcggaaactaaagcaattgaacaacatcaacaaaacagtacataaacaagcatgaacagtacatgtggatatttttaatctgtagatcttgattttagacaaatttagagacttgagccacctagctaattccgagttacgatgaattagttatgaattttctaagattaatatgattttagccttatacataaaatgatttacgattaattttctagaaaagaaaaaggctgctgaagccactaacatcagcgatgacatcatcatcggcggagcggctcgggaccctatggactctgtcgatctagggctaggcggcactagctgagggtaccattgcgacgagtgtgatgcggggaactcaccggtgcatggcacgacaacggacagtgacagtgacggcgaaggggcggacgaggtgcgtctcctcctcacgaatccagcggtggcgatgcgagcggaggcggtggctacagcggcgccgcagcacagctagaccggcggcggcggcggcgctagggctgaggcggcagtcgggacttgagggaaaggtagaggatggctaggggaggctttatataggcacgacagagagagagattgatcccgcaacgagaggaattggtgtcggaaaatctatggtttagtttggagagataaactcgaacttgaattcgattaggattatctacgtggaattgtgctccgattcttatgggagaagatggaggaggataaggggatgatttcccctcttccggccaatcggactcaggggcaaccgatggcagcggattcgactgagaggcggcggtggctcggactcggccaggcggccggaggttgaatacgaccccgacgtgtggggcccacatatcggtgggagggagattgagattgagagagatagagaggagtggcacggctgggccacgcagtgcgcgcgcgggagggaggagttgggcagagattctaaataatgcattaaagaatatattattaaattaagcgattttcaggatgtgacactcggacatagttcaccaattctagcaagtaatatggttcgaacttcgtccaaacctcgaaaccaatatcaagaagaatatgtgcgtcacaccaactttaatagactgtacgaaccctataagtcagggaaaaatgttgcaatatttgactattggatcatcacttgcattatcttttgaaaagatgcaagcaactgagttcgaacggttgaaatttaaagaacatgcaaaattcaggggaataattttgctagtctattatcaaagcttgatctaaaaaaccaagtacccaaaaccaactaagaaaaccaaagcaagaatttgaatagattaaactcatttttttttctcttagataagttttccttcactcttataaaggtttttaaccatgcgacatacatgcgcatgctttctccagtttttcccattatgtttttctggagatttaaaaaggcatagacatcacgcggtgagtaccaaaaggactgttaaaaaactttaggcttggcacatgaaggccgggctaaaatacacttattgtgtctatcactgaaccttccatatatggatttgcactacataaatagaagagggctgctcacttgtacatttgaggttgaaaagagatggttcccattatcctcgagttcttagtcaaactcagcttcatccacctttcatggatattggcacaggcaagcgaaggaaatgaatggaataaaacaatacagtctccacatttgtcgatagattatatatatgttggattacttagtagcaggggttgtataacaattgttagactttgcactaggatcacctaggttagatctagtcgggtggttctatttgggattgatgtttgaactatagagattgaaaacgggagagggtttagatagaccgaccggttgaggtgttggaggatgaagaagtgccggccatcatcgtcgttggcgctcggttgtcgtggatgcggcgccggtgaggtcgacggcgatgacggctgcgggagtgacggtcgtagatgtcccggcgatgaggtgtggcgcggcggtggcgcttcccgtcactggctgcgccccctctcgatcggattagggtttgtagggtggagttggcggcggcggtgaatctcgtactctctgccgtgccggcctccacccctcttttatatggcgcagtgtgacgggcgcccaccagccattgggctgggcgcccccgatcagggcgcggtcaaggcccccttgagccaacggctcaaggggagagagatctatctaacattctcccccttgatctcactttttcttttagctttttctattccatcacagatttgtaaatatagcatgtttcatcatcacggtcaatcaccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaatatagtactttatgtcaatgtgtttggcagcaccacttgactgattgttgtgagcgtacattactgcgggttcgttgtcgcagtataactttagtggtttctcaatactatcaaccacctttaaaccgggtatgaacttctttagccagttcacctgccccgttgtctcatagcatgctataaactcggcatacatagtagaccctgcagtgatagtctattttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataatgcaagactttctttattaatttccagtgctctaggcctggattactctgaaatctgccaagtaacccggtaacaaatgccaagtcaggtcgtgtgcacacttgcgcatactgtaggcttcctacagctgacgcatatggctttgttttcatttcattgagctcatactgatttctgggacattgcgatgccccatacttttcgcctttcattataggagcaggtgtagtactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggataagaatttctttgtttcctgcagtagactgacatcactactagccagtagaatgtcatccacatatagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggattccaaccattcagatgagcgagcgcttctcatggcctcttcatatgaagtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatttatttgaggctgttgtagctcctcctctggtgtggcaaccatttctgttgaatcctgtataacaggttcctcactctcattcaatgttgcgacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggatagtagaaacgatagccttttgatctttcaggatagctaataaaatggcagctgactgttttggggtccaacttcccaatatttgagttaaatactttggcctctgtaggactcccccacacacggaggtgagttagcgagggtactcttcctgtccatagctcatacggtgttttgggcaccgatttgcttggaactctgttgagaatgtgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccagtgcttctaatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaatgagaacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttctatttctctggacttatgttgtagttgacaataaaattgtcaaactgctttggcaatgaggccataaccagatggaccagaaagtcatctgttatgcccaaatgtcacgaccggaaataacccaacgggcgttccttacgtgcgtgcattaatccttgtcccaggaggcaaggtacaccaaaagttgatacaattcaaagtttaacaagcggaagcgtaaatagttaatttattacatgggcagcgaaagcccagcacacacaaagacaaacgacaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactatagagggttagggttgcagtaaacagcatttaaagacattagttgctcagggctattttgcaaacacgattctagtactatacaatattatttatcaaagccgtgaacccacacgaacctgccttaacccaaagcctacgatgattca

SEQ ID NO: 16021 - DNA, 35835 bp, Oryza sativa
  unsure (1)..(35835): unsure at all n locations
ttattcgacttttaactttgcacattttaattgttggaggctttcacatggattttactaattctatgcatagttttgaggatgtattttagagtcgttttgggacgcgacaaacctaccccccttaaacggaatctcgaccccgagattcggaagaactggcgaagagatcaggatgggctgccttcagctcgtcttcacgctcccaggtagcttcttcttcggcgtggttgctccactggaccttgcaaaaacggattacccggttcctggtcctgcgctccatggtgtccaggattttcactggcctctccacgtaggtcaagtcttcgcgaacttcaatttgctctgggtcagtctgctcggatggcactcgaaggcatttcttgagttgcgacacatggaacacatcatgcacgttgcccaaggaggcgggcagctccaattggtaagcgacttctccgcgtcgggcaacgatacggaaaggacccacataccgaggtgcgagcttcccttttgtccgaaacctgtgtacaccccgcaatggcgtgacccgaaggtatacaaaatcgtccactgcgaattccaggtcacggcgacggttatctgcataacttttctaccgggactgtgccacctttagattatctcgaatggttctgactttagcttcagcttctctcaggatatcagtcccgaacacttggctttccccaacttgatcccacaagagcggtgtccggcatttgcgcccatacaacgcttcataaggtgccatttgtatgctggcttgatagctgttattgtaggagaactcggcataggggagactcttatcccaggtcttcccgaaatccaggacacatgcgcgaagcatatcttctaggatctgattcagacgctcggtctgcccatctgtctgcgggtggtatgcggtgctgaagtttaatcgggtacccagctcttcttggagcttcttccaaaagtgagaggtgaattggcttcccctgtcagatacgattttcttgggaacgccatggagactcacgatcctagcgaagtagagctcggctagtttgttccctccataggtggtcttcacaggaatgaatcgagctaccttggttaatcgatccacaactacccatatagaatcatatccaccttgggtctttggaagtccggtgatgaaatccatcccaatttcatcccatttccattcaggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatactcgatttccgttccatagggttccgtgttcatcctctgtgaaaccagcggctttaccctgtttcatattcttgaggagtccatgcatgtccggatcgttcttctgagcctcgcggatttgatcgagcaaggtaggcttggcttccaacgcagccaagaatccgcgaccaactatgcttaggttcagggcttccatctgttgactaagttcgggtggaatgccacgaacgttaagagtgttgcaatggctttctcgacttagagcgtcggcgaccacgttggccttaccaggatgatagtgaattcccacatcataatccttgatgagttctaaccatctcctttgccgaagattcaggtcggactgagtgaagatgtatttcaaactcttatgatcagtatatatttcacagcgattcccaatgagatagtgccgccagatttttagagcatgaaccaccgcagctaactccaaatcatgggtagggtagttgccttcatgaggccgtagctggcgtgaggcgtaggccaccacatgaccatcctgcatgagcacgcaccccaatccttagcgcgaagcgtcacaatacaccatgaaatccttgcgagtatccggcaagattaacactggcgaggaaaccagcttttctttgagagttttaaacgccttctcgcattgcgggctccacacaaatttctcttctttcttcaacaactgtgtcatgggtcgagcgattttggagaagttctcgataaaccttcggtagtatcctgccaaacctaagaaactgcggacttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaataccagacggagatggtgctgatggtcttcctcggattgtgagtataccagaatgtcatcaatgaaaaccacaacaaacttatccaagtattccatgaacactttgttcattaagttcatgaaaaaggcaggtgcattggttaaaccgaacgacatcaccgtgaattcatacagtccgtatcgcgtggtgaatgcggtcttcggaatgtcttcttcacgaatacgtaattggtgatatccggaacgaagatcgatcttggagaatacagtagcacctttaagctaatcgaacagatcattgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttgacttcggccagttcatttgctgccgtacggtagggtcgcttgtacagaggagtggttcctggagcaagatctatccggaactcaatctctcgtttgggcggcataccgggtagttcttccggaaacacgtctccgaactccctgacgatggggatttctaacagttctatctggtgaagttcggaactactgacagaggttgggggtgcaaagaaaacaaccggttgttccggccctcggtacagagtgacagtgcgtctcgcacaatccactactccttggaattgagccaaccaattcatcccaaggatcacatccaagttcttggtgtctagcagaatcagatccgagggaaaaggaatcccctgaatttctatagggacggcagggctatagtactttgctgtcataacccctccaggggtggtgatgagcagagggttcctaagcctttctacccccaactgatttctccccacgaatggcacagatataaacgagtgggaagctccagagtcgaacagaatggtagcagggatggaatgaatgaggaacgtaccgacgatgacgtctggagttgtcagcacgtcctcggctgtcacgtggttcacccgaccccaaatgacatccttctcaccgttgttggagcgggaaggcgcttggccttgctgacgcctcagctttgggcatttatccgcaaagtgcccgggctcgaagcagttgaagcacagacgttgcggaccttgagcgtccctgcggccttgaccaggttgcacagttggcgtaggaggacggggcgcacgagtcccttgttgattctgctgctgctgcggctgtgggacgcgcaccacgaattgaggtcgaggcgcgaagcgaggttgctgctgctgttgttgctgctgcgaggaagatccccctggatagggattggtgtagcggatcctttggttagcaccctgttgattgcggaaattcgccaagcggcgcttgtgcgactccagttccttgtgcttggcttccaagcggatgcttttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagggccacgactccggcgggcacatgggttctccggaaagcggcggtgaaacgggcccatgtaataggttgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttattggagctagagaaggtaggtgggcggatgcggaggaactcggcgagtttagagtgttgtgggggtggtggtggagcattatgttgtggcggattttggaggtggtggaggaaagcagtcatcatgttggcctgctgggcgaggatttgggtgagaatggcgttggtatctggtggtggtggtggaggcggaggaggaggtggaggtgggctgccctggtggtggtggttgcttccttcaggctggttgccatcaccggtgttagcactcctcctggtcatcaccatctgaaaaccccacacagaaccagcaaacagagagagctgacaattaaagctaaccacccacgactaccataattcttgaatttattactgctattaaattggttcattaaagttcaagttgcttaggcaaataaaataaagacaggctccgacacagttatgccacacaccggcataaaccatgccccacacaactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttggggcggcagacctctccctgggcgatcttgagctgatgcagctgcgcctccaccgcgtctaggtccttcttgagctgcaggttctcctgacgcagctccaggatcttcaagttgttctcgaccatcccacggcgcaccatctgatggaagtcgatacgagccgcgtcgtacgcctccaccatgcgcgccaggtgcacgatggtagcgtcatcctccgagctagcatcccggaaggtggcgtagtcgcgggctcctccgcggcgagggtggtagcggtagggcgagtgctgcaactcgtccgggtagcgctggtgaagagtgccgatggcgaggagagcggcgctctggctagcggcggggaaagaatctccacccgcggtgactgccagcgaagtccgctcgggagagccagcgaggatcactgcagtgacctcccaagcagcgtggggctctccatcgtcaccctcctgctccggaagcggcctgccctggtagtccactccatgtggataccccaggacaacgcacatgccccgcagctccaagacgaaaccagtcatgtccaaaccgcgacgggtgacgctgccggccatctacaaacaaaaacaaaaagagaagcaacattttaaaaaaaaaatcagattttggcgataaatgaagcagcaagacagagaaagactagagggttttcacaaataacagaggatttttatttcgaaaatactgctaaggcttgggatctacggctcatcctacggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactatagagggttagggttgcagtaaacagcatttaaagacattagttgctcagggctattttgcaaacacgattctagtactatacaatattatttatcaaggccgtgaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctcggcttgcccataaccgagggcgcggctattcgaataggttatactctgatcagaggtgtacatctttacacacaagacacatcttcctcacgtgtaaccacgtgccacataccaccacggtatacagacgaaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatatccatcgacccccgacttcgtccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccattccatagtgtccaggtgatatgaatattcccaaagtctagagttgaaaaaccacctaatattacctagttaaatagcgaagcatctacctaaaatcatactagtggtaccatgagtagagtgtccactagttggggttttgtttattctagggcgaacaaggtaataataacaataacaataataataaggtcgtaacaaaggtaaataggcatggctaaataaaacagtgataacgcgggaatttaaataaagcgataatgcaataagttaaatcaacataattttacaaaccgggattcaatatgttcaaaaatgatgtgacttgccttgctcgctttcccaaacgtcggcttcaacttccacgaagagcggatcttctgaagctgcagcgtctacacgaccaacggaaaagaaaaggcttttactctaataaactccatataacaagcagaaacaaagcacaaaaatgggttcttgacttcttaaggaaaaattagagacttgaacggtccaattccaagttcaaatggccaagttatggccatttgaagtttatatgctctttaaatggatatttacgaatttcttcatttaaattttgatttaaaatcggatttattgcgtcagccgggagagaggagcgcgcggaccgggtccacgggagtggggcccacgcggcagcctctcggtccacggtggaccgggtgcacgcggcttacgccggccggcgccgtgggtcccacgcgtcagccgcacccgaggacgcgagcggctgacggccgggccccacatggcagccgcggggcacgcccgaaggcggcctcgccggcacagccgacgggaggcggcgcacccgcgccccgatggtcgccgccggcgaccaccggcgcggcggagcggcgcccgagagaggggagggaagggggaagtgaaacggcggtccacggctcaccccgggtcgacggcgacgacgggaacggctaccggagcggaggaaggcggcggcgcggctcgggtcgacggggacagcggcgttccggcggtcggcgggcgaaacggaggggtggacgaggtcggcgaggtcgcggcgaagccgaaggaggcgatgccgaagctggagaaggtccgaggcgacgacgacgacggacgcggagagagacgacgacggcggagagagaggacgacggcgcgagctcgattccgacggggagagagagcggcgagtggcggaaacggaggagggaggcacggagagcgtttatatagggttgggagggggagagagcggccggatgagggggaatcggccgcggaagatccggccgccattgatgcgccggcgaagtttgcgggagtatttccaaacgaatccgagggagagagagagagggaaaagtggggggaaagagggagggaatcacggggagtgatttccccctctttattgcgcgcggggacggcgggaggcggtgggattcgcggcggcggcggcgctagggcacgggcgaggcggcgggagcggcgcgaggtaggggatgacgggtgggccccacccgtcagcgagggtggcgggcgggcccgcccgtcagcggcgcgcgcgcgcggggagggggccggatgggccgcgggggagaggagagagagggagggaggtgggccgagccggcccaagagggagagggggagggaaaagaaactttttagggtttttctttttataaaacctttttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcatagttttgaggatgtattttagagtcgttttgggacgcgacaccaaatccattggcttcaacttggaagccatgttgctcattctaagtatgtggtctctaacaccacctccatggtacctttctgtcacaagctgcttgatcagctgtgtagcataagtccttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagcaggttctataggacatggggtagtcaacacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaaaactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaattgacaaaataaaatggaaaaattgctactgttctcttttattcattttcgcccccccccgagggacctcatacggactttttccggtcggcccgcggcctttttggcgcgcgcgggcgctcccccctcccaccaggccgcaacctgggcctgggccgggaaagacgccgcgcgcgctctccctcttgggccgtttttggcccgaccgccgccagccgtccgatcttctagggcttcgatcggacggccgggtggggagatcgggagatcaaaacccgacccccagccgccggaaaccctagctcctcttctctcgtgggcgcgcggccgcgccgagcggcgtcgccgacgccggcggccctcgcgccgccgcgccatgaccggcgcgcctttcttttctcttcttctccgctccccccaccgtctctaacccccaccgtgtgagagagagagatggcggcggccgaaaaggcggagatggcggcgccgccgcgggctccctcgccggtgcgcgcgtgcaccggcgggtgcgctcacggccgtcgagtggctcctcggtggtgccctttgccctcccccttttgccggcgacggccggcgacaaggtagggttagggtttcgatcttttgatccgtgcggatcgtgtggcttttctttttttggatttcttttcccgaaccgatctaatcactagggttgctctgataccattgttagactttgcactaggttcacctaggttagatctagtcgggtagttctatttgggattgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcccggcgatgaggtgtggcgcggcggtggcgcttcccgtcactggctgcgccccctctcgatcggattagggtttgtagggtggagttggcggcggcggtgaatctcgtactctctgccgtgccggcctccacccctcttttatatggcgcagtgtgacgggggcccaccagccattgggctgggcgcccccgatcaaggcgcggtcaaggcccccttgagccgttgggctcaaggggagagagatctatctaacaacaattacattcgtatcaaaataaatttatttttatgtaaactatgaagttattattttaattgaatagtgaatttattttagggccagtcaatacagtaggtagactaggtggaatcaaatttaaccgttgaacttgccttgatacttttagactgtgttcgttagatggtgttgaaagctaatctcctatgcacgtaaaacggagagactcattagcgcataattaatcatgatttgttatttttttaaaagaatagactaatatgatatttgaaagcaatttttctataaaaaaacctatgagaaaacgtaacgtttactaaatttaagaagcgtgcgtgtgaaaaataaggtgatttaacataggagggagaaaaattaatgtgttcgccggttaaaaaagtctagctcataaggccagtcccaacctaatgactacgatgacgtccgtagcattaaataaactgtcacctagaaacaaccattgacagcctaatctacagctcgacacgtcacactattagtttcttagatcacgagctgtacagtgaagttaaaagactaaggccctgtttaagtccctatcacatcggatgtttgaatattaattataaatattaaacgtagactattaataaaactcatccataatcttggactaattcgcgagacgaatctattgagcctaactaatccatgattagcctatgtgatgctacagtaaacattctctaattatggattaattaggtttaaaaaatttgtctcgtgaattagctttcatttatgtaattagttttgtaagtagtctatatttaataccctaaattagtgtctaaagacagggactaaagttaagtccctggatctaaacaccaccttaacaatccgctgctttcggacttctttttttaaacatctaaaattattttagagtaggtacaatagcagactataagccagctataaacatattttaaagagataaagaaagagagagaagagcaacggctgcaacatggactccaaaacgtaccgtgtgtatgacagataggaccaaatattaatagtatagtaagcaactattgtatgaattagctattatattggctataggtgatttggagctaacagttgagtattctagcgttatcctatcacagcacatgtacagctcaacaggaatgtcacgtactcactcagcgacagtacgtggaacgagctacctaattatgctaactagcgcatgtgcatgaggaatctacctttacagacgcgaccaagcgcacccttcttactatgatgttttaaatcagacaagagtagatgctcttagcacatgcacatcctctgggaatttgagccatcatatcttcagcttatcttgatgagactatatatagggcgtgcacaattccatcgagataagcaagacaccgaaagtacagtaacagtagtacagtacacagaagcgatcgagatttgtatctgaagggagacaatgaagtactcatcaggtatggcatgcattctgtgatctatcatgcggtgatgaatactctttccgtcaaaaaaaaaaaaaacaacctagtattagtattaggatctgacacatttataacgaatctggacatatttagatttattgcagtaggatgtttcacatactaatacgagttgtttttttctttggacggagagaatacgttggattctagttttgttcagagctatacgtaactttgtcttaaagttcccatgacaaatttttttattttctttattgcaccaaaaatcaaaattaataattacaaagatagaatgtatcctaaaatttttctcgtgaccttctaaaagttatttacttgaaaattttaaaactcaaaacaaaaaggtactgatctgtactcaactcggagtatcaatttagtatttctttttaaatatattatagaaatcaggaattagtaagtgtcaactataattgatgtggactttcaattagattttcttatttaatattttcagattcgtacaattaaatttcaagttatattcggatctcaattatagcttttctattatttaataatataaacattctgaactagtaatatatatgaaagctgtatttgctttgtattactctcaattataactgtttaatgaacaaataattaagaaattcgtaattcaaagtatagagttgtatcttatttggagtgtacaaaataagaattaataatatacctttaatagaacatataaatttctcaaaatgcctgtctagtttacatttgtggcgaccatagagtatctttcttggctctgcaacatactcaaactatccgacatggcctaatatggcgcgcgactagtcaagaagcccacaatattaattaagcacacgtacgttatattgtacgatgtatatattgttattatataatatatcacaatctatttaatcatcggttagtaatttcaattattagtatatagatagataacggtccatcgaaccgattgggcccagcatcatcgtccaagtcgtcgacggcgtattccatagcgccgtcatgctcctgtagtccttcttgttcgatccatattataaaattttttggcctcttcatctctcgtttagttttactaacgttcatattaatctgaagacatatatgaaaacatatacatagattcatggataaatcaactcaaaactaaaaatgtctaatgtgaagcagagaaaacagtatatataatagctaatttacttaggtcttgtttgggttaatccctaaaagaaagcgttggtagaggattgaggggcttaattccacatttcaataggcacagaattaatatttacccgaaatccgtataaatttctttgggtgggattagactggccttagagctatcattagttatgcaattcaaaacaagcagcagacggaaaacgcttggacgtattgatcacactgtagtttcaatcaagattgccatctaccggacgcccaatatagttttccggttttgccattccacgttcttaattaattgaacaattatagccttcttagttcaattgccattaattaaactgttagtaataaacacgagatgcagggttatcaattatagtagcaatggagaccatcctaaaatttgccatgttatgttagacatcaattttttttcttgcgcctgcacgtccaaacggtccaaatatatattagtaagacccaagggatatttgtttgttcttgttactctgtaagccgttaggtgctgatgaaaaaagaaaatgcaatttgcttttataccgtcactcctataataggaaaaggttaagcatcaagttgagtgtagctcagcgcaaggtttcttgcgatgacataacctgcccaccttgttagggtctctgactcagtacgaatgctcacattaaagcctaattcgtgtggtgactttatcaatcatgttaagatacgttgggatatgacacgcttgtgtgtatttatagggaaaatctgcaggggtgtatatgagttgttacatttatactatgtttggaaaaatgtttaaatgagtaattgctgcctgtcgatgttttctaaacgatcgacaataataaaagggatggcatatagatgcggtaatttccccattggggacgttgccgggggcctgggcacacaccacagggctctgcgacgcgccccctttagtccctctatatgtatttattatatatacacacgtatacttcgtatgtatatatatatacttatatatatataacttataattatatgcatatatttttgtcatatgtatacaaagtttttataactatatatacgtacatataaaaaaaatacacctatacacttatatgtacgtaaaaagtatatatacgtacctatataaaatcatataaaaaaccataaaaaaagggaacggaaaaactaaaagagaaaaaaaaagaaaaaaccgaatggaaaaactagaaaaaaattgtgcaagggtcatctcctgcgcgccgtttcgtcccacccccctctctgcgcacgccacatggcatgttgcgcaacggtgaggcatgcgcctagtcgcagttaactccaaaatttgtagtttgcgccaataaagatctggggccataggccgaacacggatttttcgtcaacagtcacataataggagtttcaacacggccctgccaaggacccactcgtacggggcctaggacaggaagaattctcaacccatagggctgctacggcgaggacctgacttgttgctggggcagggatgggttatgacatctacctgcgggccttggaattttgtaactaggtgaaaccccgcgcattgttgcaggaatttagtatgataacaataaaaaaataacgtgttagatagctagataacatcaaattaagtaaattaatgtggtttatgataattaaaatttaaatagtatgtagaatggtgattcaaacataaaaggtggtatgactttatggaagaagaaaagtagggagatagtttggaccgtagattaatcatctgaaggctaaaaacaattgatatggtagaggaaaaaaggagaaagataatttggaccatagattaatcatttaagcactaactaagtaaggatgaactatataagcatataggatatcataaaacataataaagatatacattgaaacattattgaattatgttggatgataatttaacatatttgtatttgaaaagctcttaaattataaaaactataaagatatagcatgtttgcatgatgtttaaatgtgatgattgttagtggatgatgatgtggcatcttgttaattagtgaatgatgatgtggcatctttgcatgttaagcttaaggagttagtgggggataactttatagtaagataggatatcagagatggtaacggcccctcaattatgaaaacaaaccccacttagcccatgcaacaaccctagccttatcacttcccaaaatctctccgcacaagtacaccacacgccaccgcatgccaagtagcgatggagcgagtcgcgcggtgcccacactgttgctctacctgttcgtgtgtccccgctgctgctctacccactcttgcgtccctgccttggcaccacctgccatcattttcaccaccacgtcgccactccactgccagctgcttgttaccctctcctcttcttgttgcttgcctcgtgccccattgacaaagggcctgctactgctcttggtaccctcgtgctccctactatctttcaattgctaattcgctctcaaagtcttgccgccacccgcgaaaacctcgatcccggatgtgcacctgggtgatgcggggccctgctcccctgatgggtccgttgtggcggctcgcacaagtgacgtttttcaccggttgcctttgcggggccggagctgtggatagggcctgggggagattgtggggagcggggctgggccgttcctatcgaacctagcgtcctagtagcgcaaaagacctaaaagtcgatggatgtaaaaaaaaaggatttaaacaggttcaagtactctcgacgagaggtaatatcccactccagtttgaggattgtattcactgagtgttgtgttcatccgataatctaattgtggttatgtccttggagggatagggttccaaagaggaaaacttagccgaatacagtttgagtctcataatctatacatagtagtaatcaaccgtggctctaaaccctgcgttaggatataagaaaacttggataatacatggatccagcccacctcttatttgtagtcatatatgtagcccatgtgggtacccggtatccatatcctccatagtagtccgcgcacatgcgctggaaatttatttttatcattaatgtttatgtgtgggtgacttttccttgaaatatttcttgtactctattgtgattctatttttgtcaaaaaaatatttagggctgctttgggagtcggttatgacattcctcgaattacccttgcaacatatgaattctaaactaaaattacatggaacggttcaatcttgaattaatgagaaaatattgtgatgcaataagggagttgattactatgaaactatcatttgtaaaaggtgagtcgatgtggctatacctgcctacagtatttatagagtatgaggatcgcgagaatcagggtgtatgtgagattgaggcagagagacgggaaacatggatttttataaaggtgcgggccccttaactaacaagtaatagcgccctactcctgctgagtgaagccagtatggcttttatatgtcattctcacatgagtacaatattcggaatgatgtaatctagtccctgtcagtttggcggcatggagttcttacacgtagtcgatagctagtgtagtcttctttctcgaacttgaactcattgagattggaggtcgctctagatctcccttgttggcctttgtgacttcagattgggtttgtctaaatctatccatattgccatctgtactgacctctcccctcttctcatagggagccttatatttataccctcagtgcccccttgtccaagtagaactatggaaccaagtatggatatgatccatgtagtacttatcgtgcccatgtaggactttggttctcctcccttaaatggaacaacttctgtatacaaggcatgattttgtataagacttggtatatggtgggccccgccaagcctaacgaaaaagtattaggtatgccttatccataacactgacaatgctctctgaccttaacgcaaatgattggactagcgttctcgaccgcgtaacccatggcatctaactaatccaatagtactaagtgtccccggccaaggttctaagaccctgcaattacatagacgtaacgtaataggacaataaaaaacgactccaaccagtagcgatataagaaaaagaagaaaacttacatagataaatgatggggatggaagaatcactacacacactagttgagcgagaaccgagtggatatactaaacaatcgcagaggtggtgagaggatcgctactatgttggtcaaggactagatgtatagtcgcacctcgcccggttgtagatgtggtcggaggatcgccagtatgctggtcgaggaccaagtgggtagttgtacctcgcccactcgtagaggtggtgggaggatcgatcgctactacactggtcgaggaccatgtgtgtagttgtacctcgactactcgtagatgtggtgggaggatcgctacgatactagttgaggaccaggtctgtaagttgtagcttgaccactcctatgatgtgttggaaggatcgctaccacgttggtcgaggaccgggtatgtagtcatacctcgaccactcgtagacgtgggaggatccctaccatgctggtcgaggatcaggagtgtagtcatacctcgaccactcgtttgttactacgctggtcgaggacaaggtgtataatcgaacctcaactacacgtagacttggtgggaggatcgccactataatagtcgaggaccatgtgtagtcatacttcgaccactcgtagatgtattgggtggatctctaccacgctagtcaaggaccaagtgtgtagtcgtacctcgaccactcattgatgtgttcggaggatcgctactacgctagtcgaggaccaggtgtgtagtcatacctcgaccattcgtagacgtggtgggaggatcggtactctgctggtcgaagatcagttgtagtcatacctcgaccacttgtcgaggtgtttagcgcttgggtctattattacttgtgcatctcatgtggccagtattacttgacatatttgacttacaagcatatgggacatcccttcacaatcatgttaggtgatcaagtcgacaacgttcgcgaggagattgtagctagcaacattttcacatgtagaccacgcttgaccggtattagatgtgagataggccgttggtcgttgctaataggtttggtccaacaactccgtatttattcaagaacgatctcggcaatgaggcgtgtaatcgaaagttgcctacaagaatgtccgattatttctaaaatattttctagaaggtaatataaaatagacaatatcgggtacttgtgtaaatatatgtgggatcgatatatctacggaattagcagattaacttaaaatttaatcttggtaattactttggatgacatgtgtgtcacgttgtatactaatgtatgtagttgatcatcctcttttatatgaccatacatggacagatgtgtcaatgtgtcggaaaaatatgtcgtgtacgtagatgtacccaagtaggaatctggctaactaacatcgggtatagttcttcggtctgattttgattgaactaggctgacgaaaacacatcgatcatgtagtcgaccagattggtccagtcaaatttgtgcaatgacgtcggtgcgaaagtagtcggtccaggctgaggtttcatggtcgacaatatgaatcattgttctccatggcagcaacatcttgatgtgttgttgatcttgatagatcaaattgttggatgacgatggttccggtcaagtcaggtcttatgatccaatgttatcgaagtatccaccgtcgaaagatccactgcggcaatgtcttgatcaagatggggatggttccgatttggagggaaacacactttgctcgggtcatatttcctaggtctgaagtcatcgaagagtttttttttgtcataggatccatcatttgaacccatcttgtcaaaaccttgaagaaccaagtcccccacctggtgtgccactgttggcagggctatacccgcctatggtatttgtagagtatggggatcgttagaaccaggattgacacttttggccccttaattgacaggtagtagccctactcctattggctgaagccggtgttgcttttatatatcagtatcatgtgactacaatatgtgggataatgtaatctagtctttgtcggtttggcggcatggacctcttagacgtagtcaacagcttgtgtagtcttattcctcgaacatgaactcagcgagattggaggtagctctagatccttcaagttggcctttgtacatccagatagggcttatctagatatgtatttccgtttgtactaacctctcccctctcctcctataggctcttgtatttataccctcggtgcccctgtgtccaagtagaactagggaaccgagtatggatacgatcaagtagtccttgtcatttccaagtaggactccggttctctttccttatacggaacacctttcatatttaagctatgattctttgtaaaacttagtatatgtactgctgtgaaaaccctttttaatcccggcttgcaatcccctttagccatggtctttagtcccggttgaaatacccgggagtaaagatgcatctttagtcctggttgttaacaccaatcgagactaaagatcaaccatctttagtcccggttggtgttaccaaccgggacaaatgtttttttttcttttttcctccttggttttttctcttcttttcctcctttcatattgattcatccacaaatatcacaaattcatccacaacatcacaaattcattcactcagatcatcacaaattcattcacaacatcacaaatttgttcacatcacatcatcacaaatttattcacagaaatattcacaaacacattcatatatacattcacaaatcaacaacatccacaaatcataaaaaaaatcaagaaaaacttaaacagatcaaaacccacatcgtgccacccggccactggccggcctcccatcctgccaccggtcagccacccttcccgccgcctcccctctagccagatttggcagatgggagggtgaggccgctgccccgcgcccggccgtcgtcggccgacctcccatccggtgttaccaaccgggactaaagatagtagagaggtctgacaccgtctaccatttattgaaccgtgactaataatgatctttagtcccggttggtaacattttgatccgggatgaaaaatggtttttagtcacggtttttgagcaatcgggacaattatggtttttggccaacctacgaaggatggtttctccagtagtgatggtgggtcccgttgagcctaacccaaagtattaggtatgctttatatatccgaactgttcttaatatttagcatatcttacttttgaattaagtatatgtggaacatttataaatgttaggcaccgtcgattaagtacaatttagttaggtcgattcttattttgataacgtctattattatttcatatataagtttaatatcattttccctaattaattagtatgaaatactcatataccatgtgattttaatggaaatcaaagaggacaaaacaaatggcctatacttcggatactttaggttacttctttatgcgccgaatcaccgaatagaatagtccccacattttaagcatattcttatgatcatatagtccatatcattatttttaaatgacttttcataaccaaaatgccagcatatgagctacttgttattgtcgatctaatttaattgtgcatatttgtgaactgataatggatatacagtgatatggtctatatatatttttttaaattttcacttatgttagctacatatatgtatgtccacgtatagagcccaggtggggtaggtttgggaggtcgagtttttttcctttataattgatatgatatatgatggttgtaataatgaatccattttacttttatcattcgagatctaatgtgattattgtgatgttaattatgtaaaatgataaaatctacatcaataatttataatctttacagatttttaaatagtatacaaaagttagaaaatataaccaaaactgatatatttcttttcaaagtctaattctagttaatatggattctttaattataaatttaatctcaactaatttaaagacataaacggatcaagatttatatgttatagttgtttaatacttttacacaaattttgatttctaatttattaatatagtatgaaaataggagagataattggaggaaaagatgaggatgggattgagggagtggggcgtacgttatgtacgtacaatacatccacgtatagggtttgggtggggctaggtttgcgaggtgtatttttattattttagtgggtgtaaataatgggtctacttaattaaaatatatgttgttttcatcttataacttttaaaaattatatctaatttattagaatgttatgtgacggttcatgagtcttcgtaggataccacgtgatggtttaggagtataaatgggatgtgtaatggactttcaagtagataatataatagatagacttgtttatacaagtctatttcgtgaactatattgcacgcatcgtctagcaaaccgtagttctgtcactacagtcagccaagaaaattttcgctcacggttagcacccaaaaaatctggatttccctgatgcactagatttgatggttttcactttacgattggtcatcgaaatataattccttcacggttttgtgttatccttggcggtgtttggccgttatgaaaataatagattcttgtagcatatataatgatcgcaccctgactactggatgaaaatttcaggaaatgataaaatgacaattgacatcgaatctctggtaaaggatgtgacgatctgctggcagcgtgccgagggagcgaagagccgatcgggatgcaagattccgtcgcttgatcagagagacaggccggctgcgatgtgcatcggccctaaccaccacaatcccttctaccgccagatggaggaggagaagaaggcgatgctctacagcatattgacccaggtggacgagcaacacaaggctgcagtgctgaccagattaatggacgcgatcaaagccctcgaaaacgaagcaagggaccattacctcgaccgcgccgagagcatgagcagttcggagttcgtgcagatgctggtaatcgacgggtgctacatccttggcaagttcgtgctgcctcactcctgctgccccagcacttcagacgacggggcgcagaacgggagtgcgatgcagaacatggaattggtgcgcgacgtgttctaccgcctggataaccagatacccttctgtgtcctcgacgagatccacaaggtgctccatggtaagatcatccgctcgtgcacggcggtcgccgacgtgttggtaacccacgtcggggatctgctcgagaacctgagctactccagggtgcacgcactcgatgttcacgcgagcccctggcacttgcttcacttgctgcacacgcgcctccagcccaccgccgagtggggcagcgagaagcctaccaagggcgccgctgcgcatgtcgtcgtcagctgcgcatccacgcccggtttctaccgctggcgcccagcgacgcagtacgacgccgctggcgtgcggttcaggaagttcgatggctccagctgcatcctggacgtgaagctcgacggcgccacgctgcgcgtgccgtcgcttgtggtggacacgaacacgtacgccctcctgcgaaacctgatgatgctggagcagcacaacccagaccagctcggcagccacgtcacggcgtactgcgtcttcctctcgcagctcgccggaacgcccggcgacgtcgcgctgctcgcgaggaaggggatcatcgtgcacctcctgcccagcgacagcgacgtcgccgtgatgttcgccggcctctgcgtcggcatcaccatcggcatggacgagcccaaacacaactacctgcacaaggagaggaatgatctcgagcgaatctacaacagccgcctcatggtgcaacacactaggaactgcgtgacactgccgcatcgcaacccgatgctggtggtcgcgcttcttgccgccacgcttgggttagtctgccttcttctccaggccatctataccatgaagagctactattgtaagggacatacatcttgaccgagcgttcgatgcaagaccaaacgtcggatggtcatataattaaggtgaggttcacagtcgattcaatccatatcctacaaccttatcctcttattttcagctcatcgttttttttgcgctcataggaagcacaggatggcatcaccatcatcgccacgcccaccgagatgtgaagagggaggaggttgccggcggctacgcgggtggcgacggggcaacagaagaggaaggaggacgcccgacgccgatgacactgctggtgacggcgggggatgctgaggcgaaagggaggacaggatgaggtgctagcactctgccggcggtgttgatttatttcagctgtggcccaatgcaagccgattctctcggagctgatcgggaggacgaattagtctagcaggagtttgttagagatgcaaataagtcgcgaatcagttgatcgtgaccgagtcgagcgctgggagtggcgtgcgtgtgtgcgtggagttcagaaaaagcggatcgtgggatggcgcgattttagcctcggattccaaatttgtttgttgagtataagtagttgtcttagctctttatttcagttgtaaggtttacattcagttgaatgagaaaaaccccagaaaattgccccatacattctcgcaagaattcgttctctgaaacttctcgtctgctctgttttgctgctctgttcgttgttgccgctgcagttcttgtcgtgccggacgtgaacagtctgcccgcaaggtgtttgatcggagtttttgctatcgccaacaggcggtagagcagtgcgaggcgaaggagacgctggactggatgccaatgtggctggccctagcggggtcacccatctgaagtctctgcatgccttcattctcttctacgtcattatatatctcgcttgtctctctaccagtcgcttggtttcgatggttggaagtgaacaagttagaggtgggttttcatggaaattttggtgatgttgcatctcatttgtatttttgttgcactttattatattaattattatattaagatgttttattccgttttgattcaatgttgcacgcattgatttttttattgcaatcgatacttttgaatggtgtatttagatgaaacaattatacttgagcgctgaaacatttttctcttattgtcaaacatccggaacattttttttcaaacaaattttatcaagggtgaaccatgtgaaatattttttaataacacggtgaaattaataagggcctattcagattgtagccaaaataaaccttaccaagttttggcaataccaaaattttagcaagatggcaatattgttaaaattttgacaggatttcttatgtattgactaaatttagcaacaaattaaacatagactttttttggcaactttaccaaaaatggtatggttgaaaatggtatcaaagtgaacaggccgtaagctacgctaaacttgtgcttaaagtgggtaggtcgaccccggctcatgtttgtaacagactaggaacttgcttagttgcttcttggctcataggacgtggactttttactacttaatttagagttgagttaggagggattttttaattgttctattctcaacctttccttaatttcagactggttatgatgaccagtataagcatgggaaagtgtttttttcatgagtggatatcccctcgtttctcgcatattacctaaataattataaaaaaaagtccgataatatagattagtatgtgatacgtctcatgacaaacatgcaagttcaaatttgatatctataacttatcctatgtaagtatacatttgatctccaattgtaataccctgagtttcgaattagtgtatttcggggtatacactttaagcagcacgcaccatcatcgctgaagcaaaggtacaagcagaagcaggtgggaagcatccctctcaagaagctaaacggcgccctcgtcgactgattgatcctacaccaacacgtcaaagtgaacgacagaaggcaatggcaaacgtggatgcaccggtggcaaaccgagcagagtttctaaaaaagattcataacctcgaagtggtagcaggtaacaaattcgaccctacaagttcaattctatctttgtctaacaaaattctacttgcaaatatttctaagctaggagtttccctaggtagaaatgacatagaagtagatgagtctatttatggtacaaaaatttctgaagttgatagatttgtagttctacatgctagttcttctgtttacaatggttcttctagtaatgtagataatgacaaggatgagcttttaaaattatcttctatccagtacttatgtagtgattggcaagaagagagtgagggtagcgctgacgagtcttttgattcatgcagcgcacctcaaagaaagaaaattttgacaaatgccaaaaataaagtggtatgtccacctttggctaagccaaaaatgaaacgcaacaaacataaaaaatgaaaggaattttttggaatagttgtggtttcggtgatccagctaaatttagatttatctctgagtgtgttaaggaacatcacttggattttattgctatccttgagaccagaaaacagtcattcactcccgcaaatcttagaaacctatgtgttggaaaagattttttatggcatgagaaacctcctgttgggaggtcggggggcattcttttaggggttaatttagccgtttttgatatcggttcaatttcagagggagatttctatgtgaaatttctacttagaaataaagaagatggttttaaatgggttctaatggcagtatatggtgctgtgcaacccgatttaaaagaacagttcttaacagaattagcgcatacttgcagtaatgagtctcaaccccttttggtaggaggagacttcaatatcatcatgtcgcaagaagaaaagaataataatccctttgatccccgttggccttttctttttaatgcagtgatcgatagtcttaatttgagagaaattgatctatcggggaggcaattcacctgggcaaataaccttgaaaatccaacttatgagaagttggatagagtgttaatgaacactgaatgggaacaaaaattctctttggtaacatgtaaagcactaccacgcaccatttcagatcattcacctattatacttagatctagttcacatgcccattttggaaaccaacctctcttccgctttgaattgggttggcttcaacgggacggtttctatgaaatggtcactaaagaatggcacaacataaataaggggaacacccccatggagcattggaatcataggattgcccacttgagacaacatttatgaggttgggcacgaagtacaagtggtgcatacaagaaggaaaaattaaaccttttggctttcattgatgtgctagacaaaaaagctgaattttcagttctctcaacagcagaattagcttctttgaagcaagccaaaaatgacttggcaaagctgctacgggaggaagagctatattggtaccaacgatccaaagctaaacacttgctcgagggagatagtaatacaaaatactatcatcttttagccaatggtaagcatcgtaaacaaatgatctttcaagtggagcaggatggagctataataaccggtgataaaaatctcaaagagtacatcaccaattattataaaggtttatttggcccaacggaagtgaatcatgtttctttgatggaggaacagattcaggatatcccacaagtatcaaaccttgaaaatgacatctttactgctgaatttttagaaaaggaagtcaaacaagcagtttttgaaatggaacataattcggccccgggtccagatgcttttcctgtagagttctatcaagatttttgggaggtcatcaaggatgatctttggaattattgttttattacccaaaagagccgatgcaaaacaaatccaacagtataggccaatttgccactaataggattacatcggtggctcacaaagtcattcacccaacccaaacggattttttacccggtagaaatataatggaaggggtggtgattttaaatgagactattcatgagttgcacaagaaaaatatggatggggttattttcaaaattgattttgaaaaggcttattataaagtcaaatggcaattcctccaacaaacactacgcatgaagggattttctcagcagtggtgtcattggatttctaaaatggttgaaggagaaagtgtccgtataaaagtcaatgatgacttgggtaataattttcaaacgcacaaaggcctgcgacaaggggatccaatgtcacctatacttttcaatattgtggttaatatgttagcggttctcattgagagagctaaaggcgatggtcaaattagaagagtcattccacatttagtggacaatggtttgtccattctacaatatgctgatgatacaataatttttctagatcatgaccttgaacatgccaaaaatatgaaatccatcctatgtgtgttcgaacaactatcagggctaaaaataaactttcataaaagtgagattttttgctttgggaaagccaaggaagtggaggattaatatagacaactatttggttgtaattctggatctttcctgtttagatatcttggtattcctattcattatcggaaactccgaaatgttgattggaaaggagttgaagatagatttgagaggaaactcaacacatggaaaggcaaaaacatgtcatacggtgggagattgacccttctaaacacagttctttcaagccttcccttgtttatgttatccttctttgaaattccatgaggtgtgcttcaaagattggattactttaggtcacgttttttttggagtaatgatgaccggaaaagaaaatactgactaactaagtgggaaaacatatgccgaccaaaagatcaaggtggactaggtgtccataaccttcatataaaaaatagctgcttattaagcaattggcttttccagttgtttaatggtgaaggcctatggcaagaccttttgcgaaataaatacttaaaggataaacctctttctcgtatgtccagcaagataagtatttctcagttatgggccggtttaatgaaagtcaaagaccaatttcttaggtttggttcgtttagatgtggcaatgggacaaacataagattttgggaagacacgtggttaggatcgcgtgctttcaaagatcaataccctatattatataatgtggctcgaaagaagcagtctactgtggtagaggtcatgagcacaacgccgctaaatacctttaagagagctattgttggccaaaagctaatcgagtggaacgatttgatccttaggctagctaatataactctgtcaaatgaaaaggactgctttgtatggtcgctccataagaattgtcaattttccgtcaaatctatgtataccgcgatcatgaattataatattcagatcaaaaagagaattctgtgggacttaaaaattccactaaagatcaaggtctttttgtggtttcttcacaataaagtaattctaacgaaagataacctagctaaaagaaaatgggggggggagacaaacattgttctttctgctatgcacaagagacaatccaacatcttttctttgagtatcatgtcgctcagtttgtttcgagatgtgtgttttttgcttttaatatcccccaccccataacgccgaatacattttcggtaattggcttagaggggtatctaggtgcattaagaagatgattctaattggagctagtgctatatgttagtcaatttggtgttgtcgtaatgataaagtttttaatggtaaacaattatctaaccctgcatatcttcatgtcttcctactagctccacttttggtctacgacgctgccacaggaggagcaggatactatgcgcaatagtgctacactcttggaatcggtagccgagggtctcttattccactatggatggcgtagttccattagaattgttagctaaaaaatttttatgtggtttaatgttagtcaataataaaggggagttggggatttttcccatcaccttatttcttattttgatttacttttaccttacattttttagtattaaacttatggctgtgtgtcttatgacaagccggagatgtaatccatttccattatgtaaaaaattagaacaaacgtgtaaaattttaacttttaaaccgttgttcgaataggcgatcaggaaccgtggatgtatagagctctccgagtagtacaaaatagactataagtttgtagtaatcggagtcccaggtatttccgatgatcgaattaatgtgggccgttcgattttctttaacctctctctatataaccaaccaaaaaaacgaaaaaaaaagaaaaaaaaaagagggatcgctcctgcagccgtagccgccacaactctgctgctgctcttgccacagccggcgctgcctctgcgccgccgccgctggttcagccgtcgttgtccttcgtcaccaagtgaatccatctgctcttctccttggtgagtgctgctgctgttttccctgctgctgccaccaattgatctgtgctggtgttgctgctgatacctgtgcgtgctgtgccttgctgctgctgtccctaaaacgaacaaagaggaggaggaggaggttctgaaggcagaggaaaacaataggggaaaagaaggagaaaaaaaataagagaggcaaagttgggggttttctagggttttcacaaattgatcccaattttttttctcctctgcaagggtaactcctcttagtccatagaaattcaattttcatgtgcgaatcgattaaatcgtcggcggagtgttttcttagttgctgattatgggctgacaacagtattttcaaatctggtattaaaccatcgggattcaggttagttgtactaaataaagtttatagtcatcgtcgatatctttctaacggcgctagtttcactcgattttgataaatagtttgggagaatcaacagaaacaatactactgaccgggtccggaaacgagtacagcaattcgttttccttaatctggggacttacataggcttcgcctaacatgaaagttgtagacaattttgtctagatgatcaaagttgtattatttaccaaattccgttagacggtttgcatgttacgcataaaacagtaatagaactgctataggttattttatacaaatcggtaacaagtttatatgttctaggtgtcgattttagtaaataccccttgtaagtatcattagttgaatatagtggtttattcatagttttgctctataggtgtgaagagatccgatgtggagagtgttacgtcgggttaccgttaaggttaaaggcaagtgcatgatgaactaattaattagatgtgtgattcatggattgtttgttctattttttcatttccgatacatttctatgtaatatgtaactgcttatgttcagattattgttaacgccatttagatttcaactttatcttatgtttacgatgttattcttgtttcaatatttcggattctagttgtggttaaataaattcaagtttcatgcttaatatagatgtgcaatatggtttcgatttggtcttttttctcggtttcaattattcaagtgccatgcgagtcatggatgtgctatctggttttttattcatgttcctatgggtaagcgctgatcacgcttactcggttttgccggcaatgctaggatgtattcacaattgtccgggatggaaactaatatttcaattcatgtctgcccgggatgagaattactattttctttgacttggtgtttgaaaaagtgtttcttatcaaagaaagaaagatttatattcatgctttattgccaatgacgtgcatatgtgttttctagtttcgtattgtacttgctgagtattaccgtactcacagttgtgtatatttggttttaggtacatattgagattgacatgcgtggatggaaagtagcacccttatatacacatttacttgcatactatcaaactatattgcttaggtctataatggcacttaaactatattctgcgatggtcttgtaataatcttttagatatctattagtttcttcccacggattatatagatggatagcactgtgggaaggatattattattagtttaatttattaatgtatgtcgtgtatgtccatatttataagggagactttaccgaaatttctaataaattttaggagtttgtggtttaagtgtattttggtgtggcactctaggtacgtgattacctggggtgttacaccaacattggtgcagccacgtcatcagaattatttttagccattcgatcaatattggttgtccagattttattgcttccaaccgagtagagcaattaaagaaaagcaatccaaatagttcagtccacattgttatcccttcagctttggtaggtaaactacagcacaatccctaagcaatgggaagcagatcagttggaaaatttaattcgtccatttactttcacggctattaatatctctgccagtctgcctggcctcttccatccacaactattctcatccccatgctcttttggtcatttgtggagctaatatcttctttctataaaactaaggaaaaagtacgaattacccctcgaactatcacggtcgtctgaattaccccccctgaaccacaaaaccggatattcttcacccccaactatgcaaaccggacgaattaactccctcgacccaatccacggtggttttatttgatgttttgaaattcaaaattttaattgataaaacaaagtcacaagaaaaaaatggccaaaataatagcagtaagaacacaataacatgatagagcatgattttaaaaatatttagaaaaaagaatcatctaatttggagttcatatgactgagatacactaattttaaattttttcaaattttatttttacatacgactccttaagtggcccgtatgaaaaaatcgaattttccatgggggcgcttaagtgagccgcatgcaaaagcttatttttgcatggcctcttaagaggcccgtatgggaaaatcgatttttccatacgggccacttaaggggccaaatgcaaaaatgaccatcgatttttacagacgccgttagttatggtccgtttgcaaaaattaaggggcaaatggaccataacttaatttcactacagaaatcacttttgtagcagtaaaccaaggttattcgtaccggtcctcgaaccgacacttactttcgaaccggttctaattttgaattggcacctatgtaacactacaggcacctataggggtttacccgtttttaatttttgtaggtgctaaaaaacccgaaaaaatatttggatttttatttggtacataaacggtcacacttcacttccaccaacaagtcccatgattttttcaacccatattcataattatgcctccagtaagattcaaactccaaatctccctctccatccaaagcacttgttgtattggaaacaaatgctattcctataagactactgttatccgaacttataatccatatttaacatcatagatgagctcaaatgatttttttttcaaccacaaaattgtagatctcatctagatctacaacttttatatatgttgtctccatccgagatcgtttacaaattttgaatattcacttatgcaaataggtctgagacatatcacatttttgaacatccaaacgaccttaaatcaaaaagttatcaactacaaatttgtacatctcgttgagctatacaaatttggtataaagtttacattcatttgacattgtatgaaaaagttatatgaaaactcagcacctataaccaaactcgagccacgccacaaggtaataggtgccggctcgtcatctcgagccaagacacgtcaccaaggtaataggtgccgaaacctatttcatagaagctagttttcagtgaacagccgccacctatatttttttttgaccgtttggtgggaggttctttggtgccggtttttatgtaatagcggcaccaatgtgtctctcccaaagaactggcacctatagtgttacgccctgataaatccattccaaattaaaaataactttctaaaggagtaatagaaattattaaaagtctaaaaaaatcccaaacactaaaatacatccaagaaaaattcgaattggcttggagtatttttcttaaattctccttgctctaaaatatctcttcaattttaatatctcgtcgtatccgcctccatcacctttcagagaacaagaaataatttaaatgcaacaaaaaaccaatttcagagtaaattaaaaatgaaaaaactaaaaataattctcttctctttgggccattttcggcccaaagtcttcctctccctcagcccgtgggcgaagtcctcttgtcctctctcgccctcttccctctcgggccgacctcctctcttccggcccatccttttggaataagttcactttgactcccttaaaagtgacccgaatctaatccgtgaccctcaaccgcaaaactagataggatgactccccgaactattaaaaccggtgcaatttgactccctcggcggttttgaagagcggtttcgctgacatggcgcgtctatgtggcagtgttgacctggtctaccattgacgtggcgcttaggtagcattagaattaaaaatatacatttggtacccaattgtcattcacacagaggaaaattttgtggggcccactgacatgtgggtctatcccttcttcctcctccctctctctcccccttatctctctttccccctcttcggcagttcggcgagcgggggccagcacggcagcggagtggcggtggcgggcaggagggcggcggcgtcgagggagacgagccagagctcgagggagccatcggcgtgccaccccacgcttgcgggagctccatcaggacgacgacggcaagtagcagatgccagcaggccatgctctaggggctctaggaggtagcgacaggatggagctcagcgagggggctctagggaggtggcgccagcagacggcagtgacggagcgcgagtcggtgatcggtggtggcagcgacggcagcgggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16022 - DNA, 740 bp, Oryza sativa
catgctatatttacaaatctgtgatggaatagaaaaagctaaaagaaaaagtgagatcaaggggaagggaaaaaaattttggggttttttttaaaaagggaaaattagatctctctccccttgagccgttggctcaagggggccttgaccgcgccctgatcgggggcgcccagcccaatggctggtgggcgcccgtcacactgcgccatataaaagaggggtggaggccggcacggcagagagtacgagattcaccgccgccgccaactccaccctacaaaccctaatccgatcgagagggggcgcagccagtgacgggaagcgccaccgccgcgccacacctcatcgccgggacatctacgaccgtcactcccgcagccgtcatcgccgtcgacctcaccggcgccgcatccacgacaaccgagcgccaacgacgatgatggccggcacttcttcatcctccaacacctcaaccggtcggtctatctaaaccctctcccgttttcaatctctatagttcaaacatcaatcccaaatagaaccacccgactagatctaacctaggtgatcctatcgcaaagtctaacaattgttatacaacccctgctactaactaatccaacatatatataatctatcgacaaatgtggagactgtattgtcttattccattcatttccttcgcttgcctgcgccaatatccatgaaaggtggatgaagctgagtttgactaacaactc

SEQ ID NO: 16023 - DNA, 408 bp, Oryza sativa
tgccccaggtgcagtgacaatgcaggggtccaagccgatcttacaatagaggaaatcggctgaatcaaaaaatagtgcctgttcatcagaggttgggtccagtacaccaggatcgttttcaagatgaggatgaacacgggaaatcacatggtgcccttctggtatttttactaagaatcagaagagaagtgtccagacgatgaggaacatggagcgttttcaagaagtgcaacaagaaatcaaccatcggctgaaaaagacaaaacaagaatggcgcattaagagcaaagttatagcaaccgatgaggttgaagccaacaaagcagagtggttgctcaagggcaaagctgttgcatcttcatcggtgaatatggtttttatgttgcctgtggaatatgaggctaaaca

SEQ ID NO: 16024 - DNA, 2255 bp, Oryza sativa
  unsure (1)..(2255): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacgttgatattcttttgtgattgtgatggaggtttcatcaaacatgccctatctgataaacaagaatcagatttgataaaaattagtttttgtttacttgattttcagtgtgctgcaactagtgagtgcatttgctatttggctccatgaagctcatttgcaataacgtccacatcagaaaccgattaaagttagtgctttactttttatttaaagtagaatgtacagtttgactattacttagattcattcaactaattccatttggattatgctgtgtgcttttagcatttctctgcttttttttcctacttaaaaacagttaaccacttccagtttatttaagttgactactataaattacgccaggggtatcatctagttatctctctatctacatgtacttgatgttggaaatataagcaattcaccataatatttaatccaaaaataaagattgcaaatcatgacaatgtaagcaaaaaccatagaaatattattctcaaccataggaatatgcaaaatagatatgctataggtgtaaatcatataaacaagcatgtctaattcatttgcgtaataaacagaataaagaaaaaggaaagaagaggataataacacatggtgatggagcagtggttgcaacggtagcggaaagagaactgttgttgttcccgtcgttgttcctgttcttgtcatcagccatgatgaagaagaagtagtcgacgtagtcgtactcaagcacaagcgagcagttgcacaatgctctcccaaaaacttgattcgcttcctcttctcggtgcaagatctggaaggtgggggttccggaggcctgctctcccagcgcgtgtgcacacactcgtcgggatgtgatcattgtagcagcaacagaagtgcaaatggatgaaaatgtgtgtattctcacacgcgggagatcaaatccatcttcttttataggagaaaaaggaagatgaaggggaaaggactcatgtaatgtaaagagaaagatagaaactgattgtcatcaccaagccatcaatcatccttcactacaccaccatgaaacaaccattcgattaattaatcattggattaattctcaaaaaattcttcatcttaaccattgataactcatgagaagatgaatacacatatctcctagcataataaaacttagaatttaattgatttaaatggatcaattacctaattaaatctaacacttgactaatgagttttattgatattttagtgaaacgagtatagattatttggtaatttgaatcaaacagggggttttgtagtgagccttgggctctcggcactttttttctcgctctcacatgtccagtcaacaattaactctgttcagtgtcaaaaggaaaacaattaacattgggttgtcttggtttgacattaccagtgttattactggctaacctgcaaattcccttatagatcagaataatccgtttattttgatataagtggattcacggattagttacttacatccttagttattgctactccctttgtggacatcatgggtaccgcatacccacttggcctgcctatccgactagcggtaggaggtggaccgaatccatgtattatgtaatagagtaagacttcgttgccgtattgccttgtatcctaaagtagggtatagagcttcggctgaatactaacatataatagattagaaaattgatgccgtcactactacacaaaacattttcctggacatgggacacttttgttttcaggcgggccccgtaagagaaaccacacatgataatcaggggaccggcgccgagcagttacctgcacacaaaaatcaattttcgtgtgcaggccactgaacggggccggacgcgagaatagccttattttcgcgtgcggacgtgccaagtggcccgcacgcgaaaataggtgcccaccatttaatccgggcgcacgcccactcctccctctcccatctccctcgcccatctccatctccatctcccatctcctccccctcctcccaa

SEQ ID NO: 16025 - DNA, 10171 bp, Oryza sativa
cccccccccccccgcccagatccggcggcttgcggggcgtggatccaggggcagcgaggcttaagcatccattggtgacggtgcgcaaggggaagaccggatcaatgcgatgggcaccttccttgatgagttgagtgctcgtgtttcttgctgctcgatctttcttgcttgtttggatttggatgtgttgctgcttgatctgtctgcttgctgcccccttgacgaggaggggatgtgctcgctgcttgatgtgcgcgcggcggcgggcgaccgcccctagcccggatctggcagctgccccatgaagttgcatttatccccctagcgggttttggtgattaataataatagggttaagggactaatgagttttattgagtaatacttaggtgttttagtcccaagatggcattgtgtggtcaagagatgcttgggagacccccacaacatatattcgagcagaattggaactcgaggtgtgcatatgatagtttatttcttgtaatcgagttttaggaaaaaccgtactattaagaggggttccaggtgtggttctgggatacatcaagtgctcttagtgagatccaagtgtcaaaaattttttagagctatttttgagaatagccctatccaggacagatcaggacggccgaaagttccggtcctatggacccggaagttccggaccattgaagggtgaaaatttcctaagtgttgtccggaacttctggaggacaggaagttccgaacctgtttccagttcaaaaatgtgagtaacagctggatggcatcacctagccgtccccagttcactctttggccatttcacttttgcttttccattccatagccgttgctagcctctcccaagagtttatttgcttcctccacctgatcttgagccattcttgagagagagtgagattttgagggtgaaggagaagatttggagaaggtttgaaggttaggattggtgtgagcacttggggtatcttgtgggctgacatctcggtgcttattactcttggagataatctcctagacggttaggtgttgttcgcgagcttcctttcaattgtgcatgtcccgggaaagtttgtgaaggtattcctcacctccgcaaggaaacgaggtaagtgagtaaagaatcttgtgctgaagtcctagaggttttcctagtgtggtgttttctagaagaaggttgggttggatcttagtggtcactcaaattctagaaaatgacctaaaggtgttggggttgaaggctgtggatttcctctgagatttttgcacaaatgaggcaaggggttaatcgagacccggctctttggagcacctcaacgaagagtaggatcgtgagatccgaacttcgggaaaaaaaatcctctttgtcccttctgtgatgaatctgtgcatgtgtctgtgatattgctacctctctgtttacctgtgattcatctcgtgaattttggctaagttcctgttagtgattcctgaatttgtctgttgcccggaagttccggtataagaacaccggaagttccgaactttttgagcagataggaagttctggtgttctacacctggaggttctgggcctgtagaattttaccgctgcgatttgtttttgagttttctggcaagcctattcaacccctcctctaggttacatctatgcatgttcacccccccccccccggatcgtgcgacaacgacagtgcgcggcccctccctcccctcccttcccttgccttgcagatccggtggaggggaggggcgtcttcagccggtgacgggagcgggcggcggatccggcgtcaggagcaggcgacgacgacggcagtggtggcagcggtctcccagcgtctggatccgttgccagcgaccgcgggggcgacggcggcggctggattacggttagggttttggttttttttctttttttttgtttcaattttttattttcccgtgcgggtgcctcacctgcacgaaaaaattgtgattttcgcagacgttgggttccagacgggtgaaaccaccgcacgcgaaaatgagtttccactgcacggaaaaatcgttattgtagtagtgcgtgtctggctaagtttttctctttgtaactctgcctcccaactaatattagatgggcatgaagccctacaaggacataaccacaaattgatcattagatcaatacaacacccgacgaattcaatccccaaatagaagtagagggcatgaacctgtctaaaccattgacctctttactcattcacttttagaccttgtacactacacccttttcttattgccggtctagaacaatggcatcctccatcctaaaatataaggcataaccaccacaaactcaaaaatgaagaaataatttaattaactagattgtatcacctcgatatatgcacgcaatgtgattagagggcttgatggtagaggattttaaataaaccaaatttagaggaggaagatacactaattaatatatgcatatgtgaacgcattgtattatgagatatgagaaaatgttcaatcttatattatatttttgggatagcgaaagtaataatccagcttggttcagactttccatgctcactgataaattatttatacatgagatgttgtatccagggatgaatctaggataagattggagagaaaactcacattcccctactcttcctcctctccctcttctccatttcctccctccttttataaatggtgaatccgaccatagatgatgttgatgaacgaacattggagttgatcaggtgttacgtaccacacacaccaaaaggccatatatagcgtccgtacgtaccgtacgtggatcggtgtgttcggtcggcatcaattgggagtgccgccgttccgttccgttggggttgcccgtgacgtgacgctgacgcaagcatgacgtcggccgtggacagtcaatcaatcagtcgcctcggtaagggtacgtacggagtagttactacatcctgttttctggagtaacagatgacgccgttaactttttctcacgtgtttaatcattcgtcttatttaaaaaatttatgtaattataacttattttgttatgagttgttttatcactcatagtactttaagtgtgatttatatcttatacatttgtataaaatttttaaataagacgaatggttaaatatataagaaaaaattaactgtgtcatttattaaaaaatagagagagtactacgtacggcctggaccgatcagccacccaacgaagccgtccccatcacgttctgtcgatcaacggccggccattgccatgcacatgcatgcagatcgacacaaccaacgacatgttgactgttcggtactatgctgctcctctatttgacttcctactcgcagactgttaaaaggtgactttgattggtgtattccctccgtcctaaaaaaatcaacatattaacataggatgtatttagttcacgctaaaattaaaagtttggttgaaattggaacgatgtgacggaaaagttggaagtttgtgtgtaggaaagttttgatgtgatgaaaaattagaaatttgaagaaaaagtttggaactaaactcggccatagggcatgtttagatcccaccaaaaattttacatcctttcacatcgaacgtttgaatacatgcatgaagtattaaatataggctaaaaaaactaattgcacagatcgcaactaatttgtgatactaatcttttatacctaatttctctatgatttaacaatgtggtgctacaccctatataatgacagaacggactctttaattagttttttatattagtgcccgggcacctcatacgataccctatataatatccgatgtgacacgctaaaactttacacccctgatgaacaccccctaatttttgctgttctagttatactaggccgagtttagttccaaacattttcttcaaactttcaatttttttatcacatcaaaactttcctacacacacaaacttttaagttttccgtcacatcattccaatttcaaccaaacttccaattttaacgtgaactaaacacaccctactcctacatgttttcaaaatataatatcgtagcagcttgccacgagtactcccagaatttttattatattcttcactgttactgtaggtcaggtacacacggaacactgtacatactccgcgtgctgcatgcatatgtgtacggccctatatatcgtcgattaatttattaatacatttaagcaactaataagttattaaattaacgaagtttatataataataagttcagacttcatagggctactcgtaatccgaatatccgatcggtcaacgttagcgtgtcgccgaccgtcggtcgatcgatgacacatccacatgcctgcatggtcccacatacggttaattactaggataaatttaatctatatcattagggcaagtacaaaggtactacgttaattagagactatcacgttacaatagttaagacagtacagtctctaaccattaatgtaccaaaatattttcttactagccatttttcttttattagagcatgtacaaatgtgagtctaatatgagctctctatactaattatgtcactagagactatcctcctacaatagtagagacaatgagatttctaaaccattaatgcactaaatatttttttaattatacttctttccttttctccactctcatgcaacaaattttccattaataaatgctaagagttgactctacgccgttgtcatgcgtagcaaccatctttctctttccttcttcctctctcttccacgtcaccgaatatgcttgcatgacaataaagagagatcgctaataaatacattgtacataccctcacattttctatttcaaaagttcatcattactatttacgatataggtctaatgcttctgaaattttataaaattaaaactattccatcgtcatcgtattcttttctttcctccttccttccttatgttcccttctttttcttttttttctcttcattaattgtcaagcttagatagaaatgcaagcgaacagatccgcgaatttacttgtggtataaataaatggataacccggtgggtacgccgatctagctacccgcttctcacgctcgtgctcagcaaggatggggcgtgtgctcgagaacagcgacaacgaggtcgatggggactcaacgactatggtggtgtttttctcctgaagatgaagataaagataaatattaagtgttttacgcaaaacgatgtgatattaacgtatgattgattgagttttaattattacaaacttgaaaaatagattaatttgatattttagagcaattttcatatagaaagttttcgcacgaaatgtaccatttagcagtttaaaaattgtgccacaagtattcaaaattttatccaagttttgttggagatgaggtgcttgtgcgccacggccgcgcggatgaggaagacgacgaggaggctatggtgctccacacgtacgcatggcctcgaggacgatgactctgagagaacgctaagctgtgttctgttgtgaaaaatgatcactttgtacatatgtcccgattttttgagtaaatcgatcttgatgcatgacgtgaacgatgttgaagctagtacgttttctcgaggttgaacatactttactctttaatatttgtccttttatatatttagtgtattatatacttgaattacgcatatattaatgacttgaaaactatatttagatcatttataagtagcacgagcgttggtggtatctatctcgtaccaaagcaatattaattgacgatgggtttgcatgcctagaacacatggatatttatagtttgataacgtttattttaaggtgaatatggtttgtggtcatttgttatattactgttaggtactatggtcgttgtcacgtgttaagcatgcatgtgccaaataggcatcaattatttattttgtgttacatataaatgaccgggacatatcttggaatcctacgtatatacaagcttatggtacacactccattcacaccagctaacaaatgtcactaatttttttttaaaaaaaagtaaatataatagttgtgcatatataaagtatcaacttcaaatttattatattttagctataaaacaacaaaaaacctacagttttaagagtatatatgtgtaaggattttgtatttttaaaatataaaatataatgaattttaagatgatatgcatgtaggtataatactattagaagtaacgcatagttgtttgttttgaatttttagtgaaatttgttagttggtgtatacggagtgtgtactgtgaacttgtgcatataggatatgttgtctactcacctgatgtgtagagagaaaagcaaagctaaggtatataaatccctctgtccccaaactagtttatctttaacctctactatttatcctaaaataagtacattcctttatctatacgtgtgtgcagtccgcaaatcaattttactcgttcaataccccttagctacccatcaatactataattttctattaatcgaggatactttggtctttttactccacattaatttgtgttccaatggctaaagatgaatttatttgaggacagagatggtattaataatggtccaatttgtactcaattatgtacaaacatgtatatatacgtacaaaaaaagtccatttaattatcccctaaactatttcatttgaattaaccgctacaatattttttttcctaattttaccctaaactactaaaaatagttcactttagtactgaatattatttatcaccttttgtttctctttgtatcagtcctattttaagctaaaatttttaagacataaatgacaccctatcaaagttcccaaatatttctattgctatttactttaaatttaaaaccttgatatttagatcagcctatgtactttcaacatatgcaaacgacaataatagaaattctcaaaaatgttaagaggtatatgttataatgcatctactaacccatcaaatttcggagcataatatgacatatatatagacacagacaaaatattgttagggagtaagattgatcgtttttatatgaagtaagatggagtgctttttatagttgagggtgtgaaatgaaccaaaaaaatatttacgggttaaaagctcagcgaaatagttaggagtaaaatgaatttattttctagaattcctactttggcgcaaatgtgctagcaaccgaactggcgaacactttatccacttatccgttcactcgatcggttacccctccatctgattcccttggtttcgccccccaaccttgatgtttcgttccaccatagatgagatgccgctcctagctcccctcgacactaccaagcgaggttcatttcttcctcctcccccagcaccttgcacaccctgccccccttttcttcctcttgagcgattctaagttccccttcctgctcatccttggcgagacattgatggcgtcgaacggacctcggcacctcgctaccaacttccacacgacgcaacatgtgagccgccgctctcatagaccttatgtctcttcttctttggggagactcgattctcctttctcctcccagcgagatatcagtgttgtggggaaagctacgggaatgggatataagtgagctcccctcggttgaaaatttgagttttctaaatttggaagtttgttatgtaagttaaaacttttgaggttatgatttgaaacttttcaaaaattcggatataaagtttcagtatatagttgaaaatttctaaagtatgaattgaaagttttcgacgtcgagttgaaaatgttatgaattgtagattttatcgattgggttgaaaattttataccacaatagaagaacttttgagaggttccgattgaaatttgagatttaggaggaaattgattaggagatgtattcttaatccaagttcaaatagggggagaaaggctgtgtttagatccaaactttcaacttttttcatcacatcaacctgtcatacacacgtaacttttcagtctcatcgtaccaattttaacccaaacttccaactttgaaagaaactaaacacagctaaagctaactagactgtattatgatagaatcagatagaagcgcaaacacgtttgtctagttcgccacgcacccctttggccctttcttttctgctatagtactacaactgaagaaacaaaagtatgaagctcagccgcagccgcgtcagcgtcatccgctgctactagtcaattgctatccgtcgaggtagagcggtggccgggtcgatctagtccgtccatccgtaagatccgacggttgcgaggaggcgaagaggtgtccgggcggcgaggtggaggccagcagcaggctaatccgcggctggggcgcgtgggtcccacctggcagcctccagccccccttgccatccgcacgaaggcgcagccaaactgtcgcaatcgcaaaatcgcaatcaatcgatcacgggatttctcggtgggccggtggggcccgcagcgggtcgagcctctgacaacgcggcttctcggtttgtcgcctgcctctctgactgacagactgacaggcgacagctgcttgacccaccccacgaccaccaccgccgccgcgagcccgcgactttcttcccttccccttgaagcaacaacaaccaggtgatcaaaccgtttcggtctgggtcgacgcccattgcacaatcaatttgtgttcacacttgcctgcctgacgcgtcccccatcgttactactcccattttgagtttttcttgtacgggttgaccactcgtttaattaaaaaagttagaattattattttttatttattttattattcaaagtatttaagcacaacttctcgttttttatatttacacaaattttttcaataagatgtatgttcaaacaatacaaataaaaactcaaaatctcttatattatgggacatagagagagtacagtccttttgatgatctggcggtgcacgttgctttttttttccttcttctcatggttgcttttatatgtatttttttataggataaaaagaatgaggtctgctagctaacatattgttctttctaaaataaacttttaacattccaaggataatatacctgactaggatcctacggtaatgactctgataatcgccgtgacaccaccagaatcctacgtgacatgacacacgggcattgactattttctttttttttctttttccccacctttctcttctcttctgccctctgcatcatgtgagcaaaaaaattggaaacaagagaagggaaataagaaacatcacactccctacgttgtttttctatggaatgaaaggattgtggcataacataatggtctattttggagaaaatgcaaattatggtgttattgaaagagctttagtactatgttccttgactaacaagtacggagggagagaattaaaaaggaacatgtacttaagctgtgttcggaactctgtgttcccaactcccccttcttgtttttcgtatgtttcaaactgctaaacggtgtatttttttacaaaaaatttctatacgaaagttgtttaaaaaaatcatattgatctttttttaaaaaatagtaaatatttaattaatcacgtgctaatgtatcgctctgttttccgtgcggaggagatttgttcccaacctaccgtaacgaacacaacgtagttgtcctaaaataaaacatgtagtagttgtggacttatataatataatattggctactattccctttgttttatattataatccaatttaactttttttttcaaagtcaatcttttaaagtttgatcaaatttataaataaaatataataatatccctaacacaaaacaaacatgtttatcaaactataaccaatgtcacatttaataaaactaatctcctattatagatgttactaatatttctctattaacttaaaccaaatttagaggagtttttttttgcggttatatagttctaatggaacatatattatttgttgaatattactactagtagtacatgattaacaatgtaaccagcgtgggg

SEQ ID NO: 16026 - DNA, 11347 bp, Oryza sativa
cccccccccccccccccccgccccccccgcgccggccacgcttttctctacctgtgccgcgcccacggttctagtaccactagaagtactagtacggagtggtattgagtttctcaaaattggtcttggaaaagtattagtttctcaaattaggcctttgaaaagtacaagttttttaaaatgcaggcacatttttttgccttaaattccctctactaatattttctatcagaaaatttcccccgacttttttgaaactaaaatatactactctaaaattacttactagtagcgaagacaccacacaaatgggacacattgggtttgaggtaaaaggcttagtcttaaaaatccactgaaatcttatcgaaatataatgaaaattcaagtatctagttttgaacgtgttaccataatctggcggcgggggctgactcaggtatcatcttaatgtaattaattgagtctaaataaagcttccattatcttaaaaaactataatctagcgacaactctgggtacattccgctgggtacacccacccatttttgcctcgaatgccttcccctcgactataaatcccaccgccctccctccccctttcccaaccacacccacccacccgcccaatccatccaccaagcaaccacaccatcaccatggcgaaccgctgcgtcagcctcgacgccacctgggcccacctccccgcgccgcctccgccgccgccgcaccacacctggctctcccccgccgccgacgacgcgatcaccgccgcgctctgggcctccatggcgccgtcctccgcgtcctcgtactgtggctccgccgcctcgccgacgccgtcgacctccaccaccaccacctcctcctccgccgcgtcggcagagatcctcgcgggcggcggagcgcgggcggcggcagcggcgacgcggccgagcgggcgcgtgttgaagcggaaggcgcgcccgtcgcggcgcgcgcacaccacatacatcaccgcagacccagccgacttccgccgcatggtgcaggagatcaccggcttccccgtccccggcgcccacaccgcctacccctccgcctccgcgtcgtcggccccggcggccccgcacgccgccgcagcgctcgcgtgcgtgctcccgactctggacacgtccgcgttcctgctcgaccgcgcttcacctccgccgccgccgccgcagccacagccggggcggaagaacgacaagacgcccaccaccacaatggcctccacgccgccgcagccgccggcggcggcggacgaggcggcggcgtcgtcgctgctgctgcaagagctggaggagttgatcggcgcgtcggccttcccgacattggagagctgggggatgatctgattctgacctcgatttctcctctctttttttttctcccataaaatttcagggttttttttggtccgtccgatgcgaggatcggacggctgcgggttgtcctccccttagccaagctgatgatgatgtcgtagccaagtagcgtagcactagaaaccaaatcagcctctctctctcgctctctttttctcatggtgtaattattactcctttctgtttgttgctcatcattgccttcatttagttaacgagtttaatgatatgcttaattagttctaaaccactgtgtcttgattcatccgctaatttgagctgccgtaataaccccaccgtggtgatgatggcaccacgtaatgatgtagtgtgaacgcctttaatgtggtatggctttcgttcacgtcgctagtggctcgactcgtgcgtggccacaaataaaagcgcaggcagggggtgacgtggacagtgttatcctcctacgtgatgaaatcaaattagctggaaagggttaatgtgaaaagcctgcaaagggtaatgtgaaacccggctttggccgtgcttgtctttattgtaccgtggtacggacagctttgaccccaccactggacctgcgacccgacgaccttgatcagccatgatctcgtgggaatatttgctccatctttttcaccttacttattgttcagaattatttgatccacgcttactattctttaacgaacttttatccacttcattttattccaactaaatgtatttcttaaagtatttaatttaccatataatcaatccgtgacaatgaatagtgtgctactatcccaaatataagaaattatggttgaatgtgatacataatggactgaatagacatatgatagtattacaaatctagacacaccatagtactaatgttggatagattcgtagtactaatgtattataatgtgcctcattcgatgctaggttatatatggagagaatattagcaaataatcattttgagatactgctattaaaggttgtttgtgatagtgataggccgagtttagttccaaactttttcttcaaatttccaacttttccattacatcaaaactttcctacacataaattttcaacttttccatcacatcgttccaatttcaaccaaactttcaattttagcgtgaactaaacacacccatagttaaggggttgttatgccatttcaaaccatatcattttttggtaaaattaacaaaaatgtgtatatatttagttttttgctaaactttggtaagtatataagaaattctgtcaaaattttagcaatattgtcaatttaccaaaattttggaattaccaaaatttgataaggtttattttggctataatctaaatacatgtatacgaacacacatttgaaatattaaacgtagtctaataacaaaacaaattacagattccaccagacgaatttatcaagccaaattaatccatcattagcaaatatttaatgtagcaccacactatcaaatcatggcgcaattagacttaaaagatttgtttggcaatttcctagcgaactgtgtaattgatttttttttgtctacatttaatactccatgcatatgtccaaacattcgatgtgacaacgtgaaaaattttgtttgggaactaaacaggcactaagacaagataaaagtaaaagacttgaaaacttatgaagtccgcaacatatttcagtcacccatggtttgagcctctttgacgtacacactgcaagtcgccaagtcctgtaaccggcactcttttgcatttgaagaacataagcatatacggggctacaacttaaatgagtactccaacatgagatactcatttttctctagcagagaatactgatcaatgagattacaaggatcaatcatgacttcgcgagaaataaattattcagaacacacgcattacaacatatcaccacctgaacaacagtatatgcacattggttttctacatatatgtatatatatacggaaagtcgatataacttctacctatttcccttctgtattttgaccttctcaattgattccatcgcatcctcaaatgatttctgcacattatttatcaaacagctcattacattacatcagtaaaaaacaattaagcaaacatttggcaggaagaatatggttcaaatggcttggactgatttctcacacgtcgtgtgtaatctcctcctgccatgcttctaatcaatcaagtgttcaacaacatatcaagcagacagctcaccccaacccaacagtactcaaacatccctaggatgctaacggtactcaaacatccctgggatgcttaatagaaacaggttatctatgacaggatatagcatcccatgtttgcaccgaacatttcagacattctagaatgagtaaagtgcataggcggtccttaaacttgtagggttgtgtcatctaggtccccaaagtctcaaaatgcagattcaggtcctagaacttgttaaagtgtatcatttaggtcccaaatcgacatagcccctctaggatcctacgtggcgctgatgtgacacgccacatggacgtggcgtatcattctctctcttttttttcttcttttctttttctttttcctttttgttttcttctaattcttcttttttcctttcctttcttctgctcgggttacagagaaaggagaagaaaggaaaaaaaaggagaagaaaaagagaagaaaagaaggaaaaaggaaaaggaaaaaaattttaaatgggttccatttgtctcgtcatgtccgtgtggcatgccacattagcgccacgtaggatcccaaaaggggttgtggcgatttgggacttagatgacacactatgataagttctgggacttggatatgcattttgatagtttaaggacctagatgacacaccattacaagtttaagaactgtctgtgcactttactcttctagaattccagtcattggtgcaactagactaaatgcacattgtagtaatttaaaaaagtaaggcatggacatattaaaaatgcaatgccatggtttcgtatgaaaaatggcatatatactagagcataggatgtgagaataacctgaatctactatacaagggtcaccctttactttctactaacacacaatacaagaaagtacacacactctctgactctcatagtaggcgctatatgagaaaaacaatacagtttgtaatccatgtgaaatcaaacattatatatgcagattagatacttttcaacatacaaaacaaaaacaatgacaataaagaaacatatactatcttctctccagcattgttaagttaaatacatggatggtttaatttcctgaaagaaaacttttgctctttctataaaacaaatgaaaatcacatgctgacaccctaaactcttccatagtgttcgatggtacacaattacaatgaaaggttttagaaatcaaatctaaatgccatagattttaattaagtgtcctaatcattcagtccttggctccttgcaagttgcaaggttcaatagtaaacaaccaataggggaaaaagcaaagctgtttctgctgtttgaaattttatatatgaacaagtcatcgaagtgatgccgcttttacttggtaaacacatttatctccatttttttctagacctttcagagtacactagtgaaagtttccaattaactccctccttacttgcttttattcagctcaaatttcataattaccgatgaaatgaacaaactaattgcatgcctaaaaatctgctatcagcctatcacatccttatggacaacaatgtgcaaagtagccactcaattcaatagccagtgggtgtttgatcaatacatcactaagttcaaaagtgtagagggtcaattgaatgagctgcgaaataattcacatagatgcaaggaaaaaaagaagtattgaagaaacgttatgcagggtgctccaaataaaatgataagctaacaaggtgtatacttaccccagaattattcatcttccagatttctaaaatacttccatcaagaaaagctgctccagtcagcagtacactgcagtacagagttgtcaacatgagctaacatctcaaactctaaaatgctgttacatttcaaatactaaaatacttccagcagtagaatacacagaactgctgcaaaaaagtagtgtgtggaatgacatgagtctccaacatcagggtgcgttatttgacagattttgacccaatacatggcattttgttcttcccgtcaccttgctcaaaatctatgtatagtaccagatctggctggtaccaacaatagctactctaatttattttggtagttgctatcttgctggtttaactgtctcagcagtcgttaaaatacaaactgaattgatgagcttcctttttacgaagaaccattggaacatcaatggtcataaagatttgatcctttttcttatggaacagcaacgataatacttttttatggaaccgttgaatccacaccaagtgaattcatgtttgacacaacagaaatggtcataaagactaaatcctcttctttcgtaggtcataaatgggcatgcaatttcaacggtattcattttatctgtactcggcaacatttgcaggtttggttctattttgatctcggtcagacatacatgaacatcctatgctgtcctattatttatgaacttggcaattgctttttccacaatgattccctcgagaaaagccagcaatgtaacggatcagcacaacaatcacgcaatggcggcatatcaaatcagccaaagcaagaaaagcatcagcgcatatgagcagcttcacctggcgaaacccagattgatgaggaaccctcgccgcgtgaccgacttcagcagcaagtcccaatcgaatccggccgaggcggcgccccctccgcccggaggcggccggcgccaggtaccacctccgcgtctgtggccgtagccgtagccgtagtcatacgaggccgacgaggaggaggccgaggccgaggcggaggcggaggcggaggaggaggcgcggctgtagaaggaggacgagcggatgcggaggtcgtactcggcgcggagtcggtcgtcggagaggaccctgtaggcgtcggaggcgaggcggaagcggcgcgcggcgtcggcgcgcgcggccgcgtcgggggagtgggcgtggcggtccgggtggtcgcggagcgcgcggcggcggaaggcggccttcacctcggccttggtggcgtcctgccgcagccccagcgtctggtagtggtcgccgcccatcgccaccggcggcgacgaccgcggcagcttggagaggatctcgccggccggtggatcacgaaatttctcggcgagggagaaggggaaggaggaggcgatggagcgcgacgacggttgcgtggcgtggcgtggcctttcttcccgccgcgcgtttcctcgggccctctaagcccggcccagttaggcagtcagtttagaaaatggaataagtgcactttcactccctcaaaaaataagtcaaatctgatctcgcacatgtcgaggagatatttaactatttgccacttttagacaactatttgccactggacccacatgtcatagacacatgtagacccacgtgtcattgatatagtggtggcaaatagttaaatactaaatctaaaagtggcaaatagttaaacggtgcaaaataactaagttcaacatgacattgagatatgttgaactcttaactatttaaacggtgcaaaataactatctcggtggtttttggggtggtttttcactgacatggcccattgacctagtgtagccgctaagttcgcttcgcccctgcaggagcttgcccccaactgctgccactacccctcgtcctcccatcgctaccgtcgtcgttgtggagaagggaaccagaaggggagaggaagataagggggagaagataaaggggggaggaggaagaaaggaaagagagaggatgacatgtggcccccataatgatgacttagcggttggactaggtcaatgggccatattagcgaaaaccacactaaaaaccatcgagggagtcatatgttacaccagttttaatagttaagggttcaaaatatctgacattgcaattgagggatacaaattagatttgatgtatatttgagggagtcaaagtggacttattccctacaaaattgtactccctacaagatgctcctaccccacgcgcgggggccttgtacggggagcttaaggtcctaagaacttgtttgttggtacttgatagccaacttctgagaatataaagaagctgattttctaacttctaagtttaatttatttgctaaaatatataacttctgagtatccgagtgataatttgaactattcgagggaagcttttagcaattgcagcttttaacaaaatctccaactccaccaaacatgtcctaagtcgcgtgtgcggtggactagaaaggtattggtggggtccactggtcgttccacttcaccaaaaagaaatcttcccacgcgcatgccccttcccttttttctttcaggaaaaagttccttctgcgtgtgtttcttctctcttatcttgttttggagttgacttgaacaaactttcaacttagatttaaaaattttcaagtcaagatttttgaaaactttcaactcagttttgaaaaatttcaagtcaagatttgaaaactttcaactcagattcaaaaaatgtttaactcagatttgaaaactttcaagtccagatttgaaatttaaacttagagtgaaaactttcaacttagatttgaaatttaaacttagagtgaaaactttcaacaaggatttaacaactttgaactgaagatttgaaactttcaaatcaaatttgaaaactttcatctcagaattcaaaacatttaactgaatgcatggttttttctcaacatactctctatgtccacaaacataatcattatgaccatttaaaatggcaaattttgttataggacatcaaaaatctgttgctgatagatattgtgaaaatgttccatggctaaaaggcactctaaaaaactagtcattttctagaggttatattttgggcttgattagagagataaattctgaagaaagacgagaatgcccctaggaccacatgcttcaaacatggcgttagagtgaaaaatctagaaattatgcaactctaaatttgccatcaccccaagtgcatcactagcatacatcatatttcatcttcactttagcctaagctaaaaatcttttaacactatgtgcttttcatctttttgaaaaatttctttctccaattgagacaaaagtgtccttcagcaaattacctatttttaggttaatttttcggtcatgacacttttttttatgtctacaagtaaattatataaatttttagtgtcctgtaataaattttgctatttaaaacttatcagtatttttacatgtcccatcaatggtacctatttaaaatttctttttgtcttaccccaccttgtaaattgggtgggatgggccaacatgttacctactccctctgtcccaaaatataagagattttagttagatgagtcatatcctctatccagattcatagtaatattatatgtcgagtaaattgtacccacggtacaatatcttggcaagtgggtacgatagagtgtaaaaacttgagaattaaatgtccgagtgtaataacttgacaaatgggtgcgttctagtacaagaacttaacaatttagtattttggtgtatcaacttggctaagcatatgctaggtgagttttttcatgatttcaatatgccattacataataatcatacggatattatcttataatattgaattcaatctttaagaattatactggcacatagtagtacaatttacatccaattacctttaagaatttttttgttttcttcaccttctcaaatatcaaccaaaatataataatttctacatccagtttaattgactttcagttattatttattaggataaaaatataatacacttatacaaatccgcgctagtatattgtcaaaataagtacttaaaacttgattttatattaaaaaatgctccaaataattgagttgttgcaaatttattgtatcaaaatcgtacctagcttgcaagttgttgcattcatacgatcacttataaagttcttatactaaattacacctacatatcaagttgttgcactagaacgctcatttctcaagttattgcatcaaattgtatccacctgccaagttgatgcaccttgaatgcaatttacttttcgtagtaatattatatgtcttatcctatcaaaatctcttatattttagaatgaagggagtacaaaactatactcactgttttatttggggtggcctatcaaagttactgtggataagatttttgatcgagtcgtctataaatatagatatgactatctgaatagtttcagactccgcatagtttacttaactgtacataaacgaaaaggccaaacgaaaaggctgattgtttgttcagtcttgaacttttcggtttataagctggtttacaatcctaaacaaagatagattaaatttaaactaacatataggaggctcgttgtaacctgagctaccaccaagtatatgcacgcagattatctggaaatgtctcaccatttggtgggaattgtttccttttgcatatttgcatgcctcacaaaacatcaagtcaatatacaaagaagcgtgaatcaagcagaaatagctgaataaatgaataatggatatggaaacttcacgacaatgttaacaaatactgtgagaaaactgagaatcatgtgtaaaaaggaaacaaatttgcacgtatgatattcttttcgcgattttctttttatgacaagtgctcgaacacacgaggattcgagaacgagatcgacgcttccaacagccaaatccggccatcaaattgctttctatatatacaacattaagagattcgcgaaaatatttttaaataagctagcaacaaaaccagccgccagagcctcacttgccatgcatggatgataaataccgattaaaaatcacgaggccaatcgaaaaaaaagggcaaaggtcaagaaagaaattaatggcaagtcatcaatccaagattagcccgacttctatataaatcaccaacccctaagcaatcgtcgtactcatcagaactcatgtgttcctaggctagaagaaacctatatcacaccccccccccttttttttttgttgcgtttgataagtagaagattgacgatataatattggtgtgatgtgaaggggatcagaagatgatgaagaagaagagctccctttcgatccaattcaggagaggaagtggtaggatgcagctgccggttcatggatacctctggagtgcagggcaaatagtcctaccctttcatgggtttgcatgactcgggagatgaacccgccattgtcttcctctattgattggattgaagggagctcctctagctacatctctgtcatctctctctctctctctctttgatattactatatcatcatgcatggtatgtgtattaacgttgtttgcagctagcttcttgttcttgattaatttggggttttttttatcaccacaggagtgagtatacaatgacaggaaagcagaagaagaggtataaatgtcacatcttgttttaggttagtttttatgagatagaaggagtatatattagttgtcggagggccggaggcagattgtccaagagccatgattatcaattacgagaaaataaactagcatgtacacggtacttttgtttctttttctaatttactcattctggtcaaggaacaatataatgtatatataaggacatgttgcgttctggttttctgca

SEQ ID NO: 16027 - DNA, 1091 bp, Oryza sativa
gggagcgtaaaatcgtaattgatcgttaccagccacgaagcaccaaggccataactaggtgaatatcacgtttaacgctgaggttaccttgtaaatttaatttactaaaggaccaaaatacaaaattgcagtgacatccttatcgtctactccctgctaggtttttcaactcgacatcatatcacccgctatttacatgtaactcgaatagctaaaaaaaattggaaaaagaatagtaacatcaattaggatgatatgaatccataaacaaaaatacaagactaaatttaatttagaaccagagaaaaaataataaaatcaaggagtgaatagtacctacacaacgtagataaaattcgttatttttctttcttcatgtgtagattgaatttagatttaatgtttatatagtgtcttatattatcaaatatcttattaaattttataaatattttaaataactatttaaaccacataaatatatatgaacaccgtagcatataggtgtagaaaatacttttcccctgcccatctcctctctcgtcttctcacggagggccggcggggcatccggagatctcttccccaatctctcttgcccactcatcactctctcccagctcatcaatatgtttgagagaggataggcggtagccatgctttttttttttcctttctttttttttatcttttctttttcacactttaatcttcattattttcttcactttaaatcaattgaacaagttccaactttaacgtttcttcttatatattcaccaactacagttctacatccttcatccttcatttatcaaattcaacaatgaaaatcatctcagtttgatccaacgtcccaggctgtctacactggttcctcccaaaatcgcagagtgcagttctacatccttcatttatcaaattcaacgatggaaatcatctcagtttgatccaacgtcccagactgtctacgccggttcctctcccaaaatcgcagtgtgtcattcatgatcagcgaccacgaaaatctcgcctcggctttcacgataatatagaatgataagataggtcacgtgataagaaagtttagg

SEQ ID NO: 16028 - DNA, 18144 bp, Oryza sativa
gagaatccaccagaattaatcggtttagttctttgcttcaacagactgcttcagctttggctttgctcaattcctacatcaataatttgcctgctgtctttgctccctggagaataaatttaagaaacacagtacgtttttagttagaatatgtagatatcatattcgcaaagaacaaaagatatatctacatatgcatatccatggcaacgttggtccctattttgaattttagtttactcttatttggaagactatattttgcagacttatatgaaaaaaaaactagttcaaatttctaattgatttgataattttttgcatctctatgtataacaaaattaaaatttgagattttacagcatcactattaattttgttaaggtccacgagaactctaatattgtgcacttagctacactcatccttacccgttaattttgaatttccacagtcaattttaccctagctaaatcgtataataatattattaaaatagcattcacccgttacagtttacgggcatttttctagtacttataaaaattgaggatgtttttgccggtattttgatacgtcatccgtgtttgagtcagtttttaagatcgttcacttttggaaatacagatccatgttttggttggattttaagcttgtttgcttttggaaatacaaaaggagtcctataagaaatctattttaaaaaaaacttcgcatgctaacttaagatgaaagtcagactcccaattgcggctcatgatttcttaaaaaaaattcaaacggatttccacagtaaattttatcctagctaaaccgtataatgataataagattaaaatagtattcatccgttgcaactcacgggtatttttctagtacttataaaagttgaggatgtttttgccggcattttgatacgtcgtccgtgtttgagtcggtttttaagttcgctcatttttagaaatacagatatgtttttgagttggattttaagctcatttgcttttggaaataaaaaagataagaaatctctttaaaaaactcacatgctaacttgagatgaaatatggactactaattgtagcttatgattttctaaaaaataaatatccaagcgaattcccacagtgaattttaccctagctaaaccgtataacaacaatagaattaaaataatatttacccgttgcaacgcacggatatttttttctagttaatacttatatacaagttatattatagttatagtatagttatagtgaaattatattataattatactatagttatagttatagttgaaagtttttcccttaaaaaacttgctgcggttttttaatagtctctaatttttttcaaaaaattacattgtgaattaagagaatttaagcatgattatatgaaggtaagcctatggctcaaacccaagttaccctaggcttgcctcctagagtctgagttttagcccatcctgtcttattggtgacggcgtctagttctccctctatggtaaagagagactttgatttgcagtttatttaatttttcgatgatatcttctgcttcggttgaagagcaatcgttagtggtgatatgtaggtgatcattcggttgaagaatcgagcatagatttcaatgagtctttgttgcttagagtttgaattcagaacttaggtggtgacgatgtgtatccgctttattgacattaggatcttgctacaaaggtttaagaggataagaactacatacatattatgcggattttcgccttccgcggagagaggtttagcattagaggtcgttatcattgtctttaggttggtgttgtagttagttttcttgttttgtatcaacatgcattttgtatttctgcaatcgttttggctgtagactttataataattggttataacttcttagaagcaaaggtcaaaatgaatttcccaaaaaaaaaaaacgccaggtggagggcgagagaatggtatacatggtgtacatgagatatacatgaactgtgtgtatcaaccaaattcacattaggtgtatataaaatactgattcagaggcattagccatgaacatttcacaaattaagagacaagctagcatgatgaatccatcatattaattggtttctttccttaacagactcagcttcttaatcgacgtagtctatcaaggccttgatcaatccatcaatttccctgtgccatcgttgctccctggagaacaaatttaacaacaaccgaatgctttagttacaatgtgtagatatcatattcgcaaatataaaaaaaaagatatctaggtatgcaaacgcttctcaatggtggtccctattttgaattttttttttaatttattctcgctcttttttaaaaacaacttttgattggaagactacattttgcagattttttgtgaataaaaaaatagttcagttttctcttaaaattggtaaattctcggatctataatgcataattttgtgaaaaaaaatcatatttcagttttctcttgaatttggtattttctcacacttataaaaaaattatgagattttacagcatcagtattaattttctgaaggtcgactagaacacaagaatgcacactgatcagctggcatactataaagaacacactcatccttacctcatttgctgctttgttttttcctcttgacaaagccacaagcagggcgctgcaatacaaaaatatattcttagaacaatttataaaaatgcatttgcttatacataatttgctccctcctgatttattactcccacttcgatctcccacagtcaaattaaatatatgtcagaaaaaagtaactaattctccctctatttcatattataaaatattttaagcttttttaatcaaattttattaagtttgacaaagattataaaaaaaataaagcaacatttagaaaactaatttgatatcgtaaatatttgctaagtttctaaaacaaaattttgacttcaaaaaagttaaaacatattacaatataaaaacggagatatcgaaattaactacgagctgatcagcttaagtataattacctgccggttacgagcgaaaagaacaagattacgggcagcttcatcgacggcggctgaggccgagagaagcagcggccgtagctgctacccgaggcggcggcgccgccgctcccgcggctcgtgggcggcgaggtggcggtgcgagggaggtggtcgtaggcggcgcgggtggcgtcgctgtggaggacggtgtaggcgtcgtacacccggcggaagcggccgccggcggcggcgcgggcggcggcgtcggaggccgcgtggcggtcggggtggtgcagcggcgcgaggcggtagaacgcggccttcacctcggccttgctggcgccgcgctcgatccccagcgtccggtagtagtcgccgtcgccgccgggcgccattgatcgatgtcgacgacgaagacgaagctgcaagaggtgtcgggctagctagcttctcttcgcgcgcgatgcagtaatttaggatccaaaaaactgtatacgaagcgattcaatttagatcacaattaatagggcgcttgtagccttttgatttcgcctgcgagtccgaatagaaactgagtctgagttcgagtaatacatttcgatagaattcgatcggatttgtgtttataggtcagtcaaatccgactctcttttgccggaagaagcccctatttttacacgcgcgtaattcaaacgttcgatcaacttcttgatcgactctaattaggaggtgtttcgctctatcaactccttcaccagttattaatctattcatttcccagccgtttttttcacattttgatcagcttctttaacaactgattttttacaatttgtccctttctaaaagcttatttacaaatacacctaaaaacttatttgtgcctacgtctaaaccccacgttggcgtacggcctggatttctctgtcgcgtgtgagattcacgagagttcatatagtggaatccaatttctggatttgaatttttttttacttaggtcaaatctattaccgagtttgaattttaattaattaaactcttactgtttgctgacaattaattgaacatgctctcggccttgatcagtattcgttacggtagatacagatctgatcaaacttcaaaagtcgcaaacaaagttgaaaaggaaacaaacactttggaagtaataatctcaaaccattacccccaactattacagtaaatcactcgcaataatcaaatctgatttccagttctgcattaccaccaaatactccaaattcaacggatgcagttcaagtatgtttcccatttgcaagtagtattctgattttgggggtgcataacagcataagcaaacgatagaatacctctatgtacaggcaactacaacacaagtcagcacaacctttgcattgccagaaaaccggctagctgacttcagatggattaataatcagatctgtatacagcaaacccgttacagtggttagggaacaacacaattttctctcgcaagtgtaggaaagtttcatccgcaatcttatactatactctaaagacccacgagtttccggtgcacgtgttcatggagagagtgttcgtcgccgtcatggtgatggaatacgtatgtcaaaaccccaacgaggcacaggaccgagccgacaaggatcttgtcgtaacgttccacccagtggaacttaatctggctagcaccgtagaatgagagggccaccaaggatgtcatcactgtgatggtactgcaagtggggaaaatacaatcaaacagaagaattggtaaagattttgataaatatctgatctattcacatgccaattaacacaaagcacacaagggaaatcttgaatcacaaaaacactcaattcagctattctagtattcagcaatcttactgatcatacattgcactgcacaaggtatttttataacgttcaatccagctattcttgtgttcaagatgactgaccggaatgcccaatagagtgcacaacatagagatggacctatagttcacaactgaggtgttgctaagacccacccttgaaggttcataacagtggcagggacgcagggtctcaggagattcaaagggttataatgtaagtggttcttaagaatctattaatcttgtcaggcacaccgttgaagactaaatatttatcaaataccaccatttgtttccatacatgtaaagcagtcagtttgtgggaacatttcacatcaactaaagggtaaattgagacataacttatcttaagatattacacctcatataggttacagaatgccatattgagcaaattcattgtgaattaaatattaaaacatttgtagaatccatagttataaacacaacattagctagttggtaaacgaggaaaaagaaacatcccaaaaggaaaggtggcacatggaagtataggagtatttatctttctactttaccacaacatacagtctactaagaaggatatatttcgatgttcattttgtcccaactcaatgtgcttttgtatatctatggtagcctggtaggtgataccttgatgatttgacccaatgaaaaaaagggttttcaatacaaggagattcctataagcctagagtgtgatactcctaagtcctaacaagagcttagaaaaacttctcaacaagacaatcccattattttagtggaaggataaactattattgttccctctttcataatgtgttgcggctataaaaaaaagtatagcaatttattgttcggtagaaaacaagcaatgcaactgaaaacagtggaaaggggtacccacctaaagaggagcacaatgatcgcaaggatcatcatggaggatgaattgccaacagcaagaaacactggaagagttgttgcacagggtgataatgcaggtacaagtacaagacctgcaactgccatcttctccattggatgattatgagcatggccatggccaccttttcccagtgcaaacagcaggatataacttccaccaagaacaatcagcaacagtgatgcaagtttatgcactgtttcctcgcctgctatagtatttgccatagtaacagcagttatcccaagaagagcagtggaaacaacatgaaggacgcctccaaatgcagctgcggaagttaggatattttattagtagtgatatatagaataagaacatggaaaagtaatatgagtattcatcactaatttatgtagaaaatactagggggtagggtacagtatgaaattacaaaatacaagtaactttctaaacgcgtatcatagctgaggctaacagcacaatagtaacacatgaacaaggaatcaaacagaaataaaaggtttattttataagatttagaaattagaacttttttaataaaaaattatacagtaagctttggaggtttgcagacaataaatacaacataggatggaaaaataactacaaagttaggagtctggtcattcaaatgcactttttgttatccaagtgataatgcacagttgaacagaaaaaagaagtgattgtgcgtagtttactgaaatcacaacaatcgtgcaagattaagggataacaggttggtaagctgcaaatattattacaagattaattagaaaagtaagcctgataaaggaacaccaatgccaatgatcaatctacacaaatataaacagcaatagacctcaatcaaaaattttctgtgtgttctgatttaaaaaaatatccccatacttgcgatgaaatacacatatccctgtaattatgacaaaataacatattcacagcataacaaaacagaaagatgcaatattgattcagtttgcattattgttcccaggaattaatcattgatcaacatcccaactaggatattgtgtaactccaagttggatcaatcaaatagttgcaggcttgcagtctataaatcgaactccatgcactcacatacggtacacatcttgcaatcatataataatagcgaagcagcaccgaacttagatgtattcaacccatgtagtcacacaaagtgaaagttgtattgcctgaactaccgttatgtacgaaacaaaaggcgcatggccctgaagttggaaaacatgataactacacattgttgacagaaatacatcccatggaacagagatccccactgaaaagatcacagtagaggactcagaagtttacctatcaaactatgagcagactactcgattgtccaccaattcgtcagtaacagctcaagattttcgggcgaaacttactaatcggtgcatgaaacccacagcatcaagcagttagccacaatccaaatactataacttcagttttgcgatagaacattgggttttttttagaatgcaacaaattcgtcagcacgagcacaccaaactagagtatcgccattgcaagaaatgtggcgcgtgccccctcaccactgaccccgaagatctttggggggggggggggggggcggccccaccgtaaagcggcacagcagaaccgagattggggaaagggaagcgggggggaaatttgggggatactgactgacaaggagggtgcgggagagcggccaccgctgggcgcgggcgacgatggagaaggggagccagtgcgtggggatgaaggagtgcagcagcgacaccgtcgcgatgcccccgatcgtcgacgcctcctccgccgtccactggaggccgcccagtccgaacccgcctcctcctccgccgccgccgccgtccatggcctgatcccgcctcgcgtcgctggcggcggtggggtgtgggagagagatctgggaggagaagcagaagaggagaggagagagaaggcgagcaagtgggagagggcgaagcgggctgcggtggggcccacctcacctcggcttatggcaaattaatcccagttaattacccgtttgctgtggaagtggaactgtggaaacctgtcgatcgtctccatggaaaagaaaatttttgatatttctgactttttatttataggcccgtgctttacaacggatctgtgaaaggactttagaggttcatcctaactctcctctcataaactacatcatattttgctagaaacacggtacaaatacatgcgctcacaatacgcacacataagcactttcagaagactaggctagtaatcttgagattcaaaagaagtcgccacaagcatctattgctggaaagataattagccataaatactagcactcatgtcaaatctaaagaataattagttataaatacgaacacccatgtcaaatctagaacttgaacccggataaactggttcaaccacatagaatctaatcacttgagctacgctcacttcatcaccttaattgtttgtagtatctggatcatttatcgatggcgtgggataccatccggtttaaacatattaggttgattagttttttataatgggcctgttcggctgttatgtttagcagttgtgctgttgcacaaagaaaacaatgtggctgttggctacaacacaatgaaaatgagtgcagccgaacagagccgatataataggttttttaaaatcaatttttataggaaggaagtggcttttaggaggaagtgggggagagaaagaaaaggagcatgactatctcttttaaacagtagaggccagttaaaatttaaattcaaacagaaaaaaatatggtgtttggagttatgttgcttggaaggtaaattttgagtcacggagaactaatttgatgagtagatagatctttgaaaaagttcttcatcattaatactttagtctttgatcctttatttcagttgagctgatcctttttttaaaatgaattaattgattttagaaccatcaaaataagattaaaaataactcttttcaaaggctgtttagatgatatggggaactacactttttatttgcactatagatggcctgataattaatttagagaagcaaaatgttatgtacatcattctttattttatattagacttttaaatagaaattgagatgtcactccatgagcattattacattaaccttttaaaacatttttgaattatgtttttatagtatctctgaagttagtggagagcgtgaattttctggaatgcttctggaaagaagctatccatctagcaaagccgctaattccacaagtgattagtataattaaaaagaattaaggtcaacaaacttgaaaggacacgccacctatttgcctgctcctatgcagttcttttttattttcaccgcttcagaatgtcaattgagaaagaattgacaatgaaagaaaggacaaactaataaacacatcaacttagcttcttccatttaaaagtatgcatgacagtaactcatcaaaatatgttaatgatatcaagttggctcaatgtattttcgtttctattctttgctgtccttttccccattagatcaacaaaatctaagaagaccaattgtttctttggaaaaagaaaataaagataacacttccggtgaatattggttacgtaccaggaaaacagttctaaagttttgcacaatattagtattgggtgaaagctcagatgaactcactatgtataagcaaaaaagaaaagggtgagagattgataactctagtaatatttttcatgccttggatagttatcaggggcggatctacagtagtatgagcggtgtcaggcgacaccgacgactttcagcaaaatctatagcgaaactgtttatccacatgttataacactatgatctaagcataactaacatactatgacaccgatagacacgttatgacactaacgaatcgattttctgaatccaccactgatagttataggtctaggtgaacaatcatgtcattttggtccattcagacagtcacataacaacaatgataagtggacgagtgaaatagatggtggtactcaccgccgaagcattcgtgcgtgcacaggcaaccgcacccttcaagtaactgcacttagtctaaaaagtcaaataaaattaactactaatacattttagcctgtcatgaataaatattagaagttcaataattcatctgtccaatacatactagaacttttcttataaaagcatctcgaatgtataagtaaaattgaaccatatattaaaaaaaaacacaacacgctatgacaaccaactgttgcctataaaaaaaatctaccacaaagaaagagtcaattagttgaacttagcgatgaaaaaaatggtctgccgtagttggctggccgcgcaaggaaggatgtgggcatgtgattagagatttttttttacatggttccacaattaatgtcaaacgttacggtcaacgaaagaaacaaacttttgttcaatcttagggcatgtttagttccaaacaaaattttttcgctgtcacatcgaatgtttggacacatgcatagagtattaaatatttaaatgtagaaaaaaaaccaattacacagttcgccagcaaattgcgagatgaatcttttaagcctaattacaccatgatttgacaatgtggtgctacattaaatatttgctaatgatggattaattatgcttaataatttcatctcgcagtttcctagcggaatctgtaatttgttttgttattagactacgtttaatactttaaatgtgtatccgtatattcgatgtgacatgaagggacgaaattttttgccaactaaacagacccttagtaatcaaataagaagcgcagatgctctaatgtataaaaaatactagttatttacttttcttaatcgtatcacaattagggtttaatgttttggtttgctgatttgtatcaagggtggccaaaatttctgaaattttggtccgaaattttacgattttttgaataaaatttgaataaaatattatcaaattcatgaaaaaatgaaaagaaaatggccgaaactatatcgtatcgccgggggagggggggtccgatagaaccaaaattttggaaatttcaatctgaaattatgacccctgatcacaatcaccctttcacttcctaccatccccatttaaggggagatatctaagccattttgcttccctgctaattcatgttttgaatactgtacaattgcattcttttctcagatggtgggagtatataacaagttgtatcgtgtttgatatacggcttcacaacaaacctctcatatgtgttgttcctgtggaggcagccgaagaggtttacgggtttgtcaagcgaagtgcacatcaatagagtccctcggatgcagtcgtcgcggcattgccgcagtaccctgtcgatttgctccttcattgctgcttagtttcattaggaagtttgcttcccttttttcagttaacctctctcttattatggttcaactcttatgtttatcatgggcgaagtattcgggatttcaattccctaaatgctgtcatttaataaagtgttatgtgttttctttttttaaaaaaaaacccacggtgtatgatgaaaatgtttcctcccttttgaccatgccactgagaattcccctaaaaaagacccgcattattccagacgaggaaaaactgaagattcttgcaacccaaactggatatgccgatttggtagagccagccgtcattagagccgtccaccaactcacgcagcatcaggtagtcaatcaggttcagtttttttcccgtcggaaatctctgaaatccaatcacaaaacggaacagcaaacggctgagcagtagggggacgggaagaatggtcgctttttttttttcgcatagtggacctcctgcaagaacctattatttccgtgcgttggtagagacattgacataatggctatataatcatgttcttcgtgttgaaaattttggaaggcaaatagtttaatgagttgattttgtgattgggactacctatatttattccgtcgtatttttcataaaatatagttaacacgtacatacatcgtaagtccctaagttatatatgtaattttaatgtatttacaatgtaagttaagttgacgtaaatagatgtaaatagaaaatgctagtgcaaatttaatggaaaacttataactagccattagatcttgactataatcagtcataaaatgtgatgataacattttagcaaacactttgtgatttatatttgtttaaaattttattatatgacatgcagatggtagacttcagccggctattatagagagaacaaagagtgatatgtattattgaacttaccttgtaggacgctgatttcttattgttgttataggaatttgaattttttgaaactcgtggatatttccatgtaatttggagatatgttctttttcgcaaatttttcgtcttttacagagtataaaaccaatattttcaggagcaccgatgccctcgtacggagttgctacgaaaatcaatgtgacgtcgctggcatagaaaactcgacactagtaggacttaactgcaaaacgtaaataaaaaaaaacatagctaaggtaagcaaataattccgtttactactacttccctcctaaggcaccgttttccaatacatgaaaatttcatcctgagatatctaaattaattcattcacttacttttctctaaaaaaacatgacctaaattttcgaacggcgattgtaattggtagggcctattcagaatcatgttattttataccataccattatttagtaaaattgataaatatatgatattatttagtttgttactaaatatttatcatacctagagaattgatcatcatatttaaccagtccttaaaaccttgatagcgttagcaacttaccaaatatttttggtaataccaaattctggaaaaattaaaaatgaatataaagtgaacaggtccgttgttcgtaaaagccacacgaattcaaaagacagtagtcttccatcggctgaccaaacttcgcagtaaaccccctgtactctccagaaatcacaatccaacccctaacccctttcctctcctctcctctcctctgcttcgcttcttcttcttcttccccaaaaaattccaaaccgaaacctctcgattcttcctctccaagctgcctcgccgtcgccggcgacctcccgcccaaatccgacgccaccgcgcgccgccatgcctccggtggtggcccactagccctgctcgctccggcttccccgactccatggcttccgggcgcccgctgctcgacgcctcgccgcggccgacgcagcagccgccggcgtcatcgctgctcccgccgccgcagccggagccgcccctccgagccgaccgcctcgcgttctccctcgaggtgcccgaccccttccgccgggagcccgacccgtcgtcggccgcgtcgcagcggggggaggaggaggggggcggcgaggaggagtcccgcgcggttgttgtcggggagccctcgtcttcggaggcggcggcggggttcgccgggaacggcgtacggacggcgaagtactcggtgctgacgttcctgccgcggaacctgttcgagcagttccggcggctgtcgtacgtctacttcctcgccatcaccgtgctcaaccagctcccccaggtcgccgtcttcggccgcggcgcctccgtgctcccgctcgccttcgtcctcttcgtcaccgccgtcaaggacgcctacgaggacctccgccgccaccgctccgaccgccaggagaacaaccgcctcgccagggtcctcctggcgccgcccgccgcgggggagttcgcgcccaagaaatggaagcacatccgcgtcggggacgtcgtccgcgtcgcctccagcgagacgctccctgccgacatggtgctcctcgccaccagcgacccctccggcgtcgcgcacgtccagaccgtcaatcttgacggggagaccaacctcaagacgaggtatgctaagcaggagacgcaactgaggttctcgcaggacggtggaatcggcggtgtccttcattgtgagcggccaaacaggaacatctatggatttcaggcgaatttggagattgatggcaagcgtgtctcgctagggccatcgaacattgtgctccgtggatgtgagctcaagaataccacctgggcgataggggttgttgtgtatgctggaaaggagaccaaggtcatgcttaatagctccggggcgccgtcgaaacggagccggttggagacacagttgaaccgggagactgtcatactgtccattatgctcattgggatgtgcacgaccgcaagtgtgctcgcggggatttggatactgaatcaccgtggggatttggaattcacccagttctttagggagaaggattacacgacagggaagaactacaattactatggcatggggatgcagatattcattacattcctcatggcggtgattgtatatcaggtcatcattccgatctctttgtatatatcaatggagttggtacggcttgggcaggcatatttcatgggtgctgacagagatttgtatgatgagtcatcaaggtcaaagttccaatgcagggccctgaatataaacgaggatctaggacagattaaatatgtattttctgataagacagggacgctgacagagaacaagatggagttccagtgtgcatcaattcggggggttgattactgttctggcaaagattcatgcggatactcagttgtaggtacgatgtctttaatgtatatttctggttttcatgttgaactttcctagtatggctgcttattttctggttttggacagtcgatgatctcctatggacacccaagatggcagtcaagattgatcatcggcttttgaagttactgaggggtggtggcacagatgaggaaacaaagcttgtcctcgaattcttccttgctcttgctgcatgtaataccattgtgccacttgtcctagatactcgtgattctaagcaaaagttgattgattatcagggtgagtcccctgatgagcaggcactagtgtatgctgcggcatcttatggcattgtgcttgttgagcgaacatctggttatgtggtgattgatgtccttggtgacagacagaggtaaggtagtctttcatcatttgctttatggacatgctaattttcaactctgcatgagtgtgttttcaataataattagtggcattatgcaatttagctaataccaattttggtgtatcaacatcattatgtgactaggagtggatgtctgctacagtgctagtgtgctacctgatccatgatgtttacatcttctggaaaattatacctacaaaactttattcaactgcaatgtcatatagtcatcaacagttggtagcataacttattcaataacgattttcacaagtgttttatgcactttgctttatggtgtttagtgacgtcattcttttgtcttatcttattggtttgctggtgtgaatgctaactttgagttgtatcttgctagttatcttcctattcctattcttagcatacagttaatatttattcaaaataaaaataataatttggaatattttgggatgcaacgtgccaactccaaatgatttgtggcattaccccacatgagcgaaatttcagtacttagtttatcaggcttacctcttggagatatgttacaactctccaagtgcatgtcttgacttttccttgtgtttatagacatgcttgcatatcctattatagtaagctagtttgtggagccaatactgtaatatattggttgaatatatttgatgaatggagctctttttattggttaatcaccaactgtagagagttaaatgtgtttgctgtaagtccatgtcaaacacctgggctataggcaaaaccaagttaattatcactttgaacccagttattgtgatgagcacatatctgcactagggccataaatttgtaaggagctgcattgaacaggctggcatttataaacaaagcaaatttaggatgtgcatatggatttgcagctgaatttctggataatttggataaaaccatatcatttttcaccaaaccaaatgtttatctaacatttttaataacactattccaaaaggcattcttagttacctcatatgtacgaagtacgctagctttgtttataaatgcccgctttgttactacattgactactctgctccattctttcagttcgttgttctttatgtgtaaattttattttcaatatcttgtttacaagaatggcttatagttccaatttatcttctggtatgggatgtgcagatttgatatattaggacttcatgagtttgatagtgatcgtaagaggatgtctgtcatagttggctgccccgataagactgttaagctatatgtgaaaggtgcggacagttcattgtttggagttaccaaaaattcattagatctggacattgttcgtgctacagaggcacacctccacaaatattcatcgtttggtctaagaactctcgttattggcatgcgtgaattgagtcaacctgagtttgaggagtggcaattggcatatgaaaatgctagcacgtcagtacttggaaggggaaatttactccgatcagttgcggccaatatagagaacaatatccgcatattgggggctactgggatagaagataagcttcaagatggggttccagaaacaatagaatctcttcgacaagcagacataaaggtttggattttaacaggagataagcaggagacagcaatttctattggctactcttgtaaactgctgaccaatgacatgacacaaattgtgataaacaacaactcaaaggagtcttgtaagaggagtctcgaggaagcacatgcaacgattaagaagctcagaattgcttcaactggcacacagagtccagaattagcatcagaatctgctggtgtaactcttgcgttaattgtagatggtaacagcctggtttacatacttgagacagagttgcaagaagaggtactcatctaaatatgattcttttttttcatttcctttcatccttggtataaaatcatagttgatgcatggactttcttcttttgtttgtgtagcttttcaaagtggcaagagaatgtagtgttgtattgtgttgtcgggtggccccgttacaaaaggcagggatagttgcacttatcaaaaaccgaacagatgacatgaccttagcaattggtgatggtattattccctcctggttctgctattatggcatataatattctgtgagaaccaatttatgtacatgtgatatatgctaattaatcttttgttgttcaggtgcaaatgatgtttcaatgattcaaatggctgatgttggtgttggcatcagtggtcaagaaggacggcaggctgtaatggcatcagattttgcgatgggccaattcagattcttggtccctcttctattagttcatggccattggaattatcaaagaatgtcatatatgatcctctacaacttttacaagaatgcgacatttgtcttggttcttttctggtaagagcccttttgcattgaagttttcacactttgaaaaaaaaaactgtttttatgtagaaaattatctaaacgttactgtggaaacccccatgttagtaagacctagtgaaaagaagtggactctatttatgttcagttgaattaccaaagttgttgctttcttaatttttgcaatattcagagacattgtctccaaaatataacacttaattttgtgatctcaggtatgtactttatacagcattcactctgacaactgctatcacagaatggagtagccttttgtatactgtgctatatacatcccttccaacaattgttgttggtattcttgacaaggatcttagtaaggaaacactactagcttatccaaagctatatggatctggccaaagggatgagaagtataatgtaaatttgtttgtcctcaatatgctcgaagcgctatggcaaagtctggttgttttctacatgccatattttgcatatagacaaagtacgatagatatgtctagtctgggagatctatgggcacttgcccctgtcattgttgtaaatat

SEQ ID NO: 16029 - DNA, 5111 bp, Oryza sativa
ggataaaagttgtcctgatacatagttagattaaatgcctctttctttgcaagcatgtttgtgctacatccatcatgtaatgcgagcaccatgatcatgttttcttgaatggatctcctaaagtgaaataggagttctttttgcaatttcttgattgattgcatactgactcaatataactatttcagggccatctttcatataatggggacaggtttgttttggttactgctgcttatcattgttgttgcagcaatggtaccacattttgtaatcaaggcctttacagagtattttacccccagtgatattcaagttgcccgagagatagaaaaattcgagaatgtaaatcaggtgaaccgttcagaagttccaatgacacgtctgcatgacccaaggagatagctatagaaaattctcctttatagaaatttctttttttttctgttgtttttcgcctctttggtgtgtatacgagtaaattcatttagcactaaggtgataggtttagcctccaagatgtatgtatgtaggcatgtgttcatctaacatttactgaaaaggaaatataaattgtttgatgtatgcaagtttctcatccttgtgtcgaccagcacaactgtaaggtgaagagtgttatatacctatattacctcttactctatcactacgatgatcctgtcctattgcataagctgatttatctttgtatttttagtttcttagcttcagtttattcatgctatctgtcacctccacacaagtgcacaacatagggtttttacaccctttgattcagtgaggtaaatgaattttgataatttagaaatgggtgttcattttgacccaatggtattgacagatatggtgttagtttggggtaaatttcaatgctgcaaatgagataactaggctgatttgcttatgtccaaacggagttgatccccatccagttacaaaattatgcattttctgcaggttaacatagaagccattacatgaattttgagaagctatatacaaacgtcagaatgccagtctaaaaattcaaagaaagtaagaaaaaagagacttcacagttatccttttcacctccatcacagcgacagctattgactaatgatttcagatggagcatgttttgagctccggatcacaagctcacaattctctccttggggagaagcagagatttttgatcaacataaacattaccacagaaccaagttcatcactggcaactctgccagatttgagttgctagatttgatctggctctagcaacatatgagctcaagatcacactggatagaaacattgtgaccattcctgtggaggtagcagtatgatccttatgtcagaaaacaaacagaaaagctcctcaagtcgtctcttgaaacgattgagaacgcgaaaatgctgctggattggcctgcagagcctgaggcgattctggtgccgtgccatttttcgcaacatttggctggaaagacttgaatatgcctttatcgtcaggcttgatgccaagggtcgcccagattgaactctttgcagcctcagctggatcatcaatcctaagagttttaggtacccataagtaatttctcgtcttctcttcttcctgcaagctttcttctcttgaatgctttcccaacaccagagaactgcttcctgaacaagaaattttgtttggagcggttgacggcagcacagtagtattacctccagggcattgtgcattccacattccattaggccagccagggaagcagctccacagaggtggcacaagagggattggaacaacaggagtacagattcctggggccggcaccatcagttgcggtggccatgaaggcgggcagggtatcccatcttttaacccaagaacgggctgcatcgagcactgggtagctggcatgagagcaacactgttccatccaagactccaggggagcaccaaagcaggtccagtagggaaaggcaatgccacaccattacaacatcctgacctgttgtttggctctttcataattgcattatctggcatcagattctctgaacagctggatactaccacagaagatgcacatgatttttcttccttgttatcaccagaggccaagggaacaaggtcagtatcattcggctctccaatatcaaggattgaagctgaagacttacatggtggtacttctgatatgaattctgtaggtgtttcattttccttcagtgttgctggaaggagagaagatccatgtgtaataacctgatggtgaaccacatcagaaacatctccaggagctacagtattattgcacgtcatcatcgcctgacagtattttgacacatgcttatttctgcgtcttccagcaccaactgggacattcctcatagctccaccagcggtccaatatctttggcagttcctgcagaagtgcctgggctggtgaacattgtagttgttgaagtagcagaactttgtttccatgctattgcagcgtggacatggcagaatcttatctggcttcttgagtatcttctcagggacagatccatcaggctcagtcttaacatcctcagtcatggaatcgatttctattcttccatccggtctgctgatgccttgtaaatcatttttcttactattgttgggacaaaaaggaatacctttgacaatcaaaagcttgtctgagactaaaggtaagtcattattggtttttacaccatttcctaaattaggcatgacctgaaatggattatacataagaggtaagaaaataataaaatatcaagcagagattttggatcatttagctaaaagtatagcaaaatgttaaaactgtgatagtgtgatagtgtcaagtattcaattattatgaggcatataagccatgttatattcaaaatgatgcaggtgctactggcctaaattttcatgaaagtctttcttcagcttcagctgaatcatgtggggtcacggaaactacctgatggcacaactgatacatcgccattacaatgttctgttgcagtttcaatgtccttcagttaaatataaatcattttatgttatccctgaataatcagagtcgccatgtttgtgcgataagttattgcctaatgttactaagaatttctccccgttgggatcttttctctattatactcagtattcacttgcacttgtaaaactctagttcatacttggggttgctaaaaataccatatgttaacatttcaagttatcactgtgtggctatgcaactgttttctggcgcacttgagtttaagcataaagcagcacttcgagcaaaacattacttcagtttcatagctcaatacttcacatgttagtaccagagctactcagtatcaaacctgttacatagcaacaatacaatgtgcatatgtaaataagtaatgagtgggcattttatttttaaggctggtagtaaaatcatctttggagtcagtttgacatgcaaaattgtttgatgtatggcaaatttgctctgtagcaaatagcaatcgacatgtacgatatatgacacattttcagttccttcttgcagagagctgatcagagtcccttctccagtgttttgaaaccaaattgcaaaccaatacggttttcagaggtacgtacaactactgtttgaaaactaaggctcagttccactatcatagtacatagtataacactacttttccagactccaatttagcatttagagtctgttttttttttctttttttccagaattgcttgctggaataactcatatactagtacgtaaaaagtacctttggcaacaaaagttaacccatactagagtgcaagtgcactgaaatcaagtcctgataagcaatttggttcaaaggcacggactatccagtctatcaggtttcaggacaaacagacttagtaccatctattctaggttctgcatatggttatcgaaagatggttctttgcacaaagaaagctaagataagccaatcaaactcccagaatcttaccccaaatgttgccaagaaatcaagaaaggatagaacagaattttctagaacagaattttcctaccaacaaatatgaggttggggattagcatgggtcactaatataccgttgacccactctatttgttcaaataaatgagctaaaactgaaaaaaaaatgttcttttctctagttatattagtatatttaggccctgtttagttcctccaaaatagtactccatccgtcccaaaataagtgcagtcatggttttccgcgcccaactttaacaactcgtcttatttgaaaattttttgaaaagaattaaaaacataattcacgagtaaattagtatttatgttttatcatcttataactacaaaattgctaattataaaaaaatttaaaataagacggatgatcaaagtagggcgctgaaactcatggctgcacttattttgggacgggggtagtaaaagttttgctgttttggagtactttttacaaaatggatctaagcaaaagttgtcaatttagtatttgccaaaaagtgtattgagagccgtgcatcgaacaccatggcggtatttgaattctttggagagagaaaaaacaagaagaatgtgcttgagaatttgcatcgaacaccatggcggcaaagaattaatcccttttttaaactcatttctcaatctcctaattagccgacacgaactagaagagcaaacccaaagcatcgataccccaaaaagcagccaggaaaagagagaaagagagagagaaagcgaggcgcgtcgcatctcgtccaaagcggggagggagttagataaagattcctctctccgactacttccctattggcattggatgaaatcgatggctcacctcgtcggcggcggcggcggcggcggcgggggggtcgaggaggagggggatggtgcggccgaagagcttgatggcggggtcgtcgccctgcctaagcgcggccatagcggcgccccgatctcgtccgcgctgccaccaccggcaccggcaccggcaccggctcctcctcctcctcctcgggcgcagcacgacgacggcgacgagcggggatgatgccagcggc

SEQ ID NO: 16030 - DNA, 10552 bp, Oryza sativa
ccctaatgacacctcgatcccgatctggcgtggccgattcccgatccatccccttctctcgttctcatcctccccgccgccagccaccaccaccacccgccagccgccagctcgctgcccgccaccgccaagcgccgccgccgccagccagccaccaccgccaagcgccgccgccacgccaccgaaggagcggcgccgccgccgcatccggccactcctcagccaccgtccaccgaaggaactcaacgccgccaaccccatggccatcggtgccgccgggctacgaatcctcaactatctcaatctgtcccacaacgcgccggaatgcagagcctaacggccgtcgatttctccgacaacaatctctccggcgaggtcccagcgaccggccagttcgcctacttcaacgccacgtcattcgccggtaacccaggcctctgcagcgccttcctctccccatgccgctcccacggcgtcgccacgacgtcgaccttcggctccctctcgtcggcgtcgaagctgctcctcgtgctcggcctcctcctttgatattttcatgtaacaatttatcgtactatcattatgcatgcttgctgttggctgttgctgagggctagaggcagtttttgtatggtttggctcgcgagcttaacgagctagctagagcttttaaacgagccgagccgggtttttagctcgttaggataacgagccggtcctaacgagccgagccaactcgttatcctaacgagctttaccgagccgagctggctcactatccaccctaagagcaagtttagtagtacagcccactacttattataagttaatgttaaagctaacatatataatgttagctgtaaggttagctttatttttttcatcctctctctttatctctctataaatttaatgtatatttcttggagcttgtgtgtagctaactcttgcgtaagagtcaacactctccacttttatttatctctctcttccacataagcatttagctagtttatagctcaccattatccttgctctaagtagtactagctgagtcgcgctttctgattgattgctgctgcagcctgcagggtatgggagggagaccggctgcaccggtcaactctaaaaagattttttttctcttttgagaaaatacaaataatgtcattgacaaacacccgatttcacaaaatatcatcgataagcgtgaattttataaaatattatcgtacaaggtaatttgtcatagaaatgccatcacctaacagatttcgttagcggctttccgttaagttctttaggaagagtgataggagagctgacatgtgggcccatgagaatttttgacgtttcacgtgattactctctcttcctcacctgaaaattattgttttaatggatacggtgttcaccagcaaatatctaactttaaagattacctttctttaaaaatcactttgcgcggatctaaaaccgcgcagccacaatatcttgttacaaaatttacctaaattttaaccactgagacgagtaaagaaatattttcccttaaccttaatatatactaaacaacctataaaatacattttctgacagatgaatagtaaaacagatttcgctttagtctaatttagaagtttgaatactactagtggatagaattataggatgccttgcattcaaatcataaggtttaatgtgtgtgtgatgtaggcgcgtgattatgtgtatgcatgagggtcttttccaggtaatagggaaatgttactccctcagtactcactgcacagctaaaagcgtttatatttttaaatggagacaataaatcttaaccattaggtgttatattagagcaggtatagtagcagattataagctagctataaacatattttaaagagataaatgaatagagagaagagcagtgggttacagatttataatcagctgtagcacggactccaagacgtaatacatgtatgataggtgtgaccagttattaatagtgtagtaagcatctactccctccagttttattttaattgacgctttggacaatgacacgttctataagatataactttgaccttatttttctattataatatatacaataaataaatgcatgtttatttttattatagtgttttgaaagacaaatctatatatgtttttctagtttctttaaactaaatatttttaaagttattgatggtcaaagttataaaagtttaacctcaatcttgtccaaaacgtcaattaatatagaaccagagggagtattgtatgaattagctattgcattggttataaatgatttagagctagaagttggctaaactgttaaacttgctctaagtatatgaaatcataagggatctgacacgtaattataggtgtcgtgaacttacaattttacaataccaatttgttataaattataaaatcatattataaatttatgaactcgaattttcccgaattttgtgttgtcctttcgaaaaccaggcccgaattgacaacgggcagcgacctgctgcagccggtcacgtgagccgctggcggatccacgtcacggggatgcttttgacgaggcaatttcagagcatgaactttttggcaggtaggtgggccctactcgaactaattgcgtttgcgtttttaattttttgagaacacttgcgtttgcgttgctcctcgacttgcccttccagcctctctagcaattaaaaaaaattgtgctactttcaaaattcaatggggttccatttttcaattcatattgcactttaaattatgatactctaaggttgttcagattatagctaaaataaatcttaccaaattttggcaatgttaaaattttgacaagttgataatattatcaaaattttggcagaatttcttatatatttctcaaagcctgacaataaactaaatgtagttaattttttgataattttacaataaatggtacggttgaaaatgacatcaatctgaacagcccctaaatacttcatgtcatcgaaaactgttggataaagaattttaataaacaatgttcattggattaaacggtaaggctaaacatatgggaattacatgatacgggcaaagactatgagggaaaaaacacaggaggcttctagtgaatcctttttttaaaagaaatatagcataatttagctaaatctatagttgattagaccaatcaatattttgtaaatacattaactcatatcaaaaccttcttaaaagctaagctaactaacaaatcatatacaaaagttcttaaactagatcaaaagtcctgcaaaaggagagactacatgactagttttacttaagccctgtttagttctccaaaaacttttcgtaaaaacatcacatcgaatctttagacacatgtatggagcattaaatatagataaaaagaaaaaactaattgcacagtttacatgtaaatcgcgagacgaatattatgagcctaattagtccatgattagccataagtgctacagtaacctacatgtgctaatgatggtttaattaggctcaaaagattcgtctcgtggtttccagacaagttatgaaattagttttttcattcgtgtccgaagacccctttcgacatctggtcaaacatccgacgtgacacccaaaaattttcatttcaccaactaaataagcccttaattttctaagagtagcatatattagtatgtatacaatctgagcgcttgtggtaaagcgatgcccaactttgaaatgcagtgcaaatggataatatagtagtagtagcgacaaacataaaaatacaccaatacggaaaattgccgtatgcgactgcgacatattttcccgtgtccatggtttacattaccggttgaccactaaattttgagctccatcggtatcacggtttttgatgaattttgactaaatctactgtttaaccttcgaaatcgaaacttgattccgagccgtgtcgaaacgtcaaaattttgcggaattcgatcggttttcgttggtactgtgaaccttgcccgtgtcttccaatttctgcatatactcctcacctatatttggagtattctttttctttttatgctacacctaatatttggagcaagagcctaatatcgggagcggagctatatgtatctaggggatgtcgaacaacccaagctaattttatttatttatttattttcaccatatgtgcacttcaagcatagtaatacctatatttcgttttagctccgccactactatgcttagagttgtgtccccccctctttttgacaaattggttatttttaaaaaaaacttactgtgaaactagattgtgcaaaaaaaaaacttcaaccgaaaaatagtatttaatgaagcttttcttacaatctagtttcgtaataagtttttgaaaaaaccaacctttcaaaaaaaattttaaaaaaagagcaggagatttgtgtaagggttacgtgtggccgtggcatattttggcgttgcccacatctgatctgcgcgtccatttcacgttcagcgagtggggcccacacccaaaagcgaggataaagcgacagcgacggccaacggagagcccgggaaagtcgcctcgccgccgtcagcttttcggccccaccaccaccaccacaccagcacgcccacgtgccacccccgggcccccacccgtgggccccacctttatccgggcccacccgcagtcgctggcggagtgggccccacgccggcatggcatggcgaggcatccgcacgtgggtgtgcctttgtcctggattggattcgccgtcgctcgatcgcgggggagaacgaaaggaaaaaataagaattacccacttgaactatcgtgcgatcgaattaacccctaaatcacaaaatcggacattttacactctcaactagttttaccggacaaataaccttctaaattaatccgaagtgattttacgcctacgtggcagtctagtcagcaatactttttattaaaaaagtcagtggggcccacctgccagattctatctcctctctatctctttcctctcccaccgctctctatctctctcacgccgaaggccgacgaggaatcccacgcgccgacggaggccgaggacgagcggcgcgccggcggctgcgagcctcctggcggcagaggccgagtatgaggcgcgcgccggtggacgctggccagtcaagctcacgagctgggcctcagcgccggacttgtgcaagaagatggcgatggtcgatgagcggcagccggcgccggacttgcgcgagaaaatggcgagcgcggcggccggactcatcgtcttggaacgacacccacaagaagatggcgagtctgcatgtagttttcctatttatgttgataacaaaccagaaaagtagcagcagcagtacgcggcaccaaaatctcgtcttcctccgtgtactgatttgatccaatcttctgagtgtttgttggcagctagaagtaggttgttaggattttccgggcgtggctgacaaagtgtgagaaagcacgacagcggcagcgggctcgtcactgcctgcgcgcgagctccggctccgccgtcgttgcatcctctttcgcccgagttccaccgttggccgccaggcgagcgcatgcaggagtgcttcggccgacaacgtgctgctgtgccgacgaggaggaggacgcccggccggcgagcttgacgggcttgccgccgccgcccgagctccgccgtgcgggagtacttccgctaccgcgtagcgacttgctgcgatgttatgccgacaaggaggtggaggcccggctggcgagctcgacgggctggccgccgccgcgtgcttcagcagcatcccctgagctccaccgatggccgacgggcgagcgcatgtaggagttcttcggcacaacgcggcgagatagagagaggggaaagagatagagaggagagagaatctggcaggtggtccccaccgacttttttaataaataattactgactagactgactgacacgtaggcgtaaaactactccggattgattcagggggttatttgctcggtaaaaatagttgaaggtgtaaaatgttcggttttgtggttcagggggtaattcgtactttttccgaaaacgaaaaggagaaataatttcgtggtggtattttttttttttggttttcgagggaggaggggaggagcaacgcaattatgcgaggcccggggacagcataatgctgttttcttttaatggtgagacaagatgatgttatggatgctagtaaagtacgatttccgtactaaaataaatttattttttaatccatcacacacacacacacacacacacacacacacacacacacacacacacacacacacacacacacacacacacacacacacacacacacacacacacacatatatatatatatatatatatatatatatatatatatatatatcaatacaaaaatatattaggatacccttatgtatttatcttgtatttttataagctccggtataatggttacttaaaaattaacttattttagaataaatgtgatgtgccaaaaaataaatttattctaatacggatggagtacttgacagtgctaaggcaactgtcaagagtcatgtggttttaatccaaggtctagtgcatcaattcttaatatactcatgatttgttttaattatttgacaatcagcttatgtaagctcttaatttattcaacaagtaaaagctcatatgggaagatggaggagatggagaaagggcaacctcttggaggagtttactgttgcgccgtttggaacaaaggaattcgtgaatagtattcctaaggtttatatttattttctcttcttttcctaccatttcatcgaaaacgaagctacatcaaaacttcatggaaattttcccgtatggacaagagagaaaacaagtggtgattctgtacttctccaatcaaatgcacagagcaaatccctttcttccaaacaactactctaaaaccgaaataaatgatttgtagtgattcaataactacaaatgagaaaaaaagattactattagtagtagcattaaagaggtatagtggaccactctaaaaccacacatttttaaggacgaattctaagactaaaactacaattaaaagatggagggtgtagtgcataatccttctatcccaaaatgtctatttctaggtttttcgagggagtaaggaataaaggtaaaaataccacaatgccttctttaaaacacaaaagacatgaaggaatatgtaggttagtgggtgcgaggtggttcatagggtgggtctaatgggcgagcgtgttcgcaagccgtaggcacgttccgacagcccagcccccttagcccccctccaccccttaaccctaacctattgttgttatacaggcaggaagtgttcgctagcaattgtgtgcacgttcgcgaataaggctttttggattcataggattataattgacataatagcattgacctaggaatagctatatttttttagacatgtttaaattttagaaatagctacattttaaaatgggtggagtattacagatcaagaaaaatagaaaatgccccaggaaatttattaacgagaagtgttcaatgctcagcataaataagccaaagcgataagtttatctcttaaatgtcacgtcattaataggagaacttcacatcagtaaccagtacacatccgcatcgatctacagctcttcaccaccacaagccaaagccgatcgaaatgatcctccaacaaatgggccacctagatccagaaaaagacacaaagctggttgcacctttcatccacaagaaaaacaattctattttccatgatctgaaacttagtttaaaaagaaaatagccattcggtcatgcatgaatgaaattagagcgaattgaagaacctctcagaagtcacggctgaataacgagcatgcctatcctatgatgctccttcattttaattactccgtccgtttcgaattacttattgttttagttttatcctaagtttaacaaccatttttttaaatttgtgtggtttaacaggatgtttttatgtttaacaacatattaattaatccctccatcctagaatatactaacttttggtgataatctagacatacttttatctagatttgtacttgaaagttgttatattttgggatgtatgtagtatatattacgaaattacttttcatggtgaatataaaaatataaatcttatgacgttaaattatatgaatttctataaattgatgatacatataaatctagaatgacataattttaaatggggggagtagatcggcagaattaataaacacactggattagaagttctctcaagtgcatctattgatctatatagtgttgtacagaattacacagcagatgctctgagtaatttgtacaggaaatggtctgagtaattagtacagaatgatcatgtgatgtgtggccctacccaaccctggcctttttctctttgctaagccgggtcctttactttacataggtcattggtgcatgcatggatctgcatttaagctctgtactttggccttgagattttgcaagatgtggccttttctcaagaagctttgcagctcagctaagtaaagttgatgcaggggaaattaaaggttgtgcaagcctttactcaacttggcacagtgaaaaaataagtacaatttcaggatggctaccattagatgatttgataaatttccatctctgaggttctggtactgacgtatgataaagatttgtggtgtttatatggatttgagtttttaagtgtaacctgtctgtcaagtgtctgaaactgtggtggagtagaccaagatttcagatttttcaggtgagtaatctagttgctctgtgccttggcggcgactctgaatttatgtttgatttgcatctggtttgcaatgcccattcaagaggctgaatctttgagcccttcacctgctgtccacatgccctactagaccatagtagttaccaaagcattcataattaaccatgggttcagtggctaagctagtccagttcttatcctaatggaagcattcagtaggccatgggaatttgaatgactgggaagatgaggattgaaagcaccgtctgaaaaatgttatgttgccatgtgaagcatttacttgtgcagagagaatcttgatgcaagggcagaacttctcaatcacctgttgaacatgttaggccgccatgttaacttccttctcagctagatcataaagaaattttgtcagaaccatcacagttcacagaagaaaagaattttcagcatgtgaccactcagctagatattcagaggctgcattgcttttgtttttaacatgttagcaaaccagacaataatcctaaataatgcaaaatcaggagacagactgtctctgagaaccaaaagaacgcgtagagacagcatgttttcataacccacaattcatcctggcaattgatagatgcatcgtccggaaacagggcaagagaagccaagatttagctccaactagatgctagtaaaacttctgaaatatctgaaggcataaacagtttaagcaatgaatcccatcaatgaacacctgcagggtgtagttctgaacttgtccatcagattcaggcattcagacccttgactgacaaaacaagtaggatgagctttcaggaactaagtacatattagcagattttctttggacaattgacatgatgaatactttatcaatgtactagtgattttctattatgaaaatggagaggagcagccattttatcctactctgacgaagcaagttctgaaacctgaacgagcctcggcaacccacatttttggcttttcctttaatgccaacaagacgagatttctctattatcttccagtgttttcacgaagaacgagtcttgtagcagttgacttaattgatgcatcatccggatagaggagaagatgatggacagaactcataattactccaacttccactagaaaaaagaaacaacagtgtacacttgtcagttctgaagttgtcgtcagattcaggaattcagaattctttgtaacccaaactaacataaatacataatgatacttcaaaaagaacaaaaaaaaaacagaaagagaaaatgactgacatgataagttgcatagaactgcatatgagcagaattttctctggacaacataaatctttgctgaaagcctgaaattaataagaagtgaataaatatgtacgaatttttcttttggtataagcttgatgtaacaaatgcaccaagttgaccaaatgaagggttttaggggaagcccccacgggtatttttggttcttatttgctgatttgcactgcccattattcaagatattttttatgcgacaatttgctcaaatactaaatgagttagtccatcgagagatgatgatgaattcggtgcctatagttttctgtacttgtata

SEQ ID NO: 16031 - DNA, 3127 bp, Oryza sativa
atattttttatgattggcttcagggagttgtaaacaaaaagagcaaactaatacttgttggagcttctgccttgtgttgggctctgtggctgagtaggaatgatagggtttttgacaaatcacctactgttacttatatgcaggtcattttcaaggcaacatattggcttcgtctgtgggcacagttacaaaagtgtgataaagatgcagatttcttaattgttgcatgtcgtaagcttgaagtgacggttatgcaactgtttgccaatcatggatggagatttaccaatagactggaataatgttattttgtctagtttggttggtgtgtttgcttctatttggacttcactcttacagagtgctagtttgtaataattggctgtagctcttttgattaaaagccgggatgctatttcattccattatctaaaaaaatggatttgtggccatcaatttgattccatcaatttgatctgtcattgtatgatgtggatgcagcgtacgcaccgattattcattgtataataactttggtccagaaatttggtctggaccaaatgaggccttaatggtgccacataatttaattagcaatataaattggcctggatttatttccaaccaaaatgctgcataagttatttccaacctgaaagtctcttcggaattaaaaagctctgcaagcatttgggcccaacatagcccaatgcgtaagggaaagagggaggatatgtggaggaagtgattttacggttcaggcaacagtatttagtttgttgttaatttatcatccaaataatatttattagtttgctgttcatttttaatatatcatccagcgtttaaaagtaaatagttagctataaatttaagcatctgaattaaaagcttaagctgaaatcagttgtggggttgcttcttactccaacaccaccttacgtcttcttcctcatcattctctctttctgccgcacccacactgaatctacccttgaccaagatagattggttccagcctaaaaaactaaccaactgtactataatcaattgcaacaataccttaatctgacgtctattaacattgttgtaaataatgaaatactctctccgtcctaaataaactactccatccgtttcacaatgtaagtcattctagtattttccacattcatattagcaatatgaatgtggaaaatgctagattgacttacattgtgaaacggatgaagtaatttctaaagattgaactttgtcctaaaataaaccaacttctatattattatctgctattggtctgtaaattaaaaaaaaattctatctcttatataaccctcacgtacacatcattgattataactttattgctaccttcgtccaaaatataagaacatagtattggataagatatttcctagtactctaaatctgaacaggtactagtaaatgttccattcaataggagtattttgatcatttatctttctccttatatatctcaacctcgagaagttagtgttagagtttctgagcaacagagggagtatgtgtgatccatcattgatatggtccaacaaacctggaagcttcctctcatcctcacttcacaatctcacacatatatgaccccatgcacctctggctctgtgcatcaccaaaacccactagctagctagtacatggaatatttcggtcactaacaaacatgcatgtgtactggtagagtagtagtacacactcataattaagagagcattttccctgtgtgaccgaaaaaataggcactgttaagagcagctacaacagtggactataaaccagctataaagatatttcaaagagataaaaaataagagaaaagaacagcgggctacagatttgtaaccagctatagcatggactctaaaatacatgtgtgtatgataggtgggaccagatattaattgtgtagtactctattggttattaaattggtaactattgtataaattggttattaaattgactatactattaaacttgctctaattgtttggtaagagcataaacagattgaagccacagcatttaattttgtggcgacacctgtgagatgcacatcagctaggttgtagccacatttcattgtgcccaacacatacaatagagtgcatgtagggaggaatatacatgaatactgatgatgacatcatggtacaaaagaaaccactaccggggttttgaggttgatctcacataagcccccatttatttgcattttcccttggctggtatgcatggtttgttcgattaggtcatgtggggctagtttgtttgtttcgctaccatactaaaatatttagtaatataaaaaataagtgctaaattaaacgtaatttattaactatcgcagtatatatttttaagaaaactgataaaatctagtctttgcatttaacagaagctatacagtcacttaatgttgaaatactagtctatgagattatatttgaccccaatctacatgtttatctcacggtaacataattttgaaattagaaagatgactgaatcgcgacggcccgagctttccaacaaatcttacatggagctctaggaattctaaattgttgtttgaatatatacagagttgcatacccatatgcttcatactaatattttggcattattgagggattattgagggcctaatagatcaaaatttgcaggtcattgcaaggtgtgcgtaactcaactggtttggttccaagtggtagaaccagcctactcgggtgttcatatttatagctaattatttttacagtgctaagcgatgtacctgttgataacgaggcgtctgaggtgacttcatgaatctcaacatatgctcatcccgtcttctagaggtgttcataggggtagggtatgcgtgtgtgcgttcataaagatgagtgtgctgtactgtgttttaaaaaaaaagttgtaggtaattaaaccaacccccgatttgccaatcaaaaccatttgatccgaatttgcgtgctacatcaaccacaccagccttttttatgggacgtgactccggattgagcgtccaatttgtagctaagaatcggacgcccgcctgagtctccatcactccgtcaga

SEQ ID NO: 16032 - DNA, 34478 bp, Oryza sativa
  unsure (1)..(34478): unsure at all n locations
atgaaataagatatctgatctttaacagaagctatatatagtgtctcgtattacaagtaagggtcttgggcactaacgaaaagttaagtttggaacacacactaaaataaaagaaaagagatgcatcttattcgatcagtaatcaatctagcaatctaattaaatataatctgtcgtttaagtgatgcatgatgcatgtatataacagaagaaagttctttttaaataaaaatcgtatctttaaaagtgtgttgcagaataattaatccggttgcaacttaccacttcctccgtttcaggttataagatgttttaaattttgttaaagtcaaactactctaagtttaactaattttatagaaaaaaatagtaatatttacaatagcagcactactttcttttataaaattagttaaatttataatagtttaacttttactaaagttaaaatgttttataatctgaagcggaagggagtactaattaattctagattggatacatatatatcgtcgccgtctcttcgatcgatcatctcaatctgaacatgatatatgtactgtgtcgatctagctttatcgtcttttctttccatgctgactttttgcaagtggtttgactctcaagtgagagattaatttaaccatctcgatctcgatcatgcctgatctgtattaaaggtagatctgtgtttggtagtaacggttctagctagtactactccagctagctatacagctaattgccacacgtgtttagcagtatgaacggcttggataaattccgtggccgaaagaaattaggtcatgtccaattaatgatgtgatataccacctccgtatcgtaatataagggatattcactatttcttgtgacgtttaatcacttgtcttattcaaaaaatttgtacaaatataaaaaataaaaagttgtacttaaagtactttggataataagtcacaaataaaataaataataattctattttttaataaggcaaatggtcaaacaataccagtaaaatgtcaaaatcccttagggggtaaagggagtttttttttcttttgaagactgatatatatgatgtgatataccgaccgacacttcacacacggcaggggtgcgtctccttgaattttcatggagctagcccggatatatcgacgaaacagccgtcagaaaactttctttgcagctgcgagacgatatctttcagacaagatcgaagagacgatatctttcagagatttcttcaaaagaaaaaaaaaactcactctgaagttgtacagtccgtaccaaaatataatattcttctgttttgtatttgtaagggaatgtctagatacatatatagtcagaagttgctatttctaccacttaaactttgttttgaaatgaagctatttctctagttatcgtctcatctcaatcaattataattattctttatttaatttctttagctaatttatcttctcaactaatcgtgatttcctacgatcatttttatgtagtttcttattaatactcatgcgttcagctctaaaaatacttacggtttacgatgaagagaactaaaattatgtatgccaaattgttgcgaggtgagtatagctcaactgattaggtttggtgaaatctcagcccacatggattcaagttttagacttgacacgagtgatcgtatttatgtctaattatttttttaatgatataaacgatgtatctttgggcgacgaggcgttcgtgtttcttaaagaaaatgtatgccaaattgccaaacagctagatcttggtcgtaaattacttataaggttttccctttttctgtacttgcccgtcaatcaatccagcataaagctaagggtgatcatgtgcaggtcaatgcttatgtctgtgtcatcagatcaccatgctttatctctcatggagatctcaacatgcctaatgtatcacacacaaacatacagatccactgccaccaatacatcatacatgcatgtcagatcgatcgagatggttcgacgttgaaaacgtgtgatcatccactggataattaaccattaattattttctgactaattccattatttctgatcgatctccatggccaaactaattaaagctcgttggcttttcgatcgatgaaattccagccaagattagatagattgatagataatcacggcgcaattaaacagttggatcgtagtggatgccagtgaaacgcaacgacgcatgtatgtgcatggtcgtatatacgtggccgtaatcccgcccatttctagtgcgcgtgatcgacccttgtgtgtgttagtggagtgcacgcccacgaccccaccttttcgcgccaaaaagaccaatgattctacacctaagcctaacctagctagtagtctactaccagctatagtactctctctaactaaaaatatcctagctaatactccctccgccaaaaataaaaaaccaacctcatactatgatataacatatatagtataacgaatattcagattcgttgtcacatcctatatccctaaatacggaattggttttttttagaatggatgaagtatatgatagaactatgattctcgatatgtcccatattcgtactagatagacaatagcggaaaactctttattcattaaggagatttcgctctcatttttaaggtaaatccaattgtcataaataattttttattttaaacataacatggtagatcaatataaatgagaaatatcaacttttttttgtccaagttgaatttacatgtgtcgacgtttgatgtcacgactacggtatttgcatagtatggggatcgttggtattaggatatatgcaagattgaggtaaatgagatgggaacgaggatttttatacaggttcgggcccctgaattgtcaggtaataaccctactcctgttggccgaagccggtcgttgcttttattcaccataatcacaccagtacaatatttggggtagcctatctaactgttgtcgacttggcggtatgaagtgctgactcgtagtcgacgccagggtagccttcctcctcgaatccgcatccagcgagatcaaagacagcgctatgtctctcctgacagtatccgtagacatcgtaggggactagccatgcttatctctgaagtcgatatccggcgtcttgtcttggtgcatgttagcttatatgttgatcttgtgtcttgatctattgtttcgtcccccctctcctcctagggggtcttgtatttatacccatacgtgttcccttttccaagtagaactagggaaaccaatatggatacaatccgagtaatccttgtcgtttctatgtagaactctatttatctttccttatccggaactccttctatacccgaaggttgtttccgtataaaacatggtatgtggtgagtcctgtcgagatttagccaactactattaggtatgtggtatccatagccctgataacatgtttgtacaataaatatattacatattgatttattctatcttctttttttagaaaaaattctggataacgcggcatacatagaacatggagatatcctctctctcaaggaatgaaaatccacatccctacgtagagattgaaaatccgcatccctacatattgcttgctggtaataaaccctaaacaattactctaagtacacattggtagtgtcagtgggatctagtgattgtgtgctcgtttgacctccatttgatgtgacccttcttctacctcgcgacctctcatctatcgatctttgcatacatatatatctacctcacccatggctgcttcctggccacagcaacccacacattccttgtacttcttccgctatataaaggggcgagcaaccaatctgaattaatctgtgtagctcgtcgtcactgcccatagtactctggcttagctagctagcttcttcttcttcctctagcttggattggattggattggtggctggccggcgatgaggacggcggcggcgaaggcgcggtgctcggtgcctttcatcctggcggcgctggccgccctctcctgcgtcttcctcgtccacggtttgtacggcttgatcgagctcttcggctcgccggaactctcgccggaggccatgctcctcatctttgccctgtgttttctcctccttgcagcggcggcggcggcggcggcggcggcggtgaccacaaccaccaccagcgtcgtcggctaccggagggcgctgcttcccagggaggcggcggcggtggtgatgccgacgacgtcgacggcggaggacgcggcggtggtggggatggccggagtagagggagagctgccggtcgtcgccgacgaggcggcggcggcggcggcgaggcggatggacatgcagacgacgcaggactacccgagctccggcgccaacagccgccacgatccgaggaacccgcattgagattcgtgcagggaagctatctatctaccgttgattcatggggtggagatgcatacgcctacttgtacaatactacacatgcagcaaacgcgtgtgttgagtttatcacacaattaattaattttgcacacagtattagtagtaccgcatgtataactagtagtattacatgtaacactcgtatacatatcaaattaaacattatcttaatgtgatcctgctcaaaaattgtcaagggcatgcaaagggatgctatttaacttttttttcaacaaaaaaatacaccctccatttcatctcaaagtaagtctacttttatatatgaatctcaatatgactgcgttcctcagcaggtgaaagattgaagatttatctcgtttttcatgcgcacgcttcccgaactattaaacggtgtttttcttaaaaaaatataggaaaattgctttaaaaaatcatataaatatttttttaaaatttaaaattgttaatactaatttaatcatgcactaatgactcaccttattttgtatacctctccattcttctcttttcccttttcctcaaacacaaagatgtccggatccattggttggttgtttttaagcataagcgaaacaacatatttgcaaatgaaaacaaaatcttaaaatcaactttgaatttaagtttaaaattttaaattttggctgataagaataagcgaaaagataggccagtcaaaaccaggggtacttaggggttgtttggatgctatactaagtttgccaccattcaccatattttttatgccacacttgcctaaattgtggcttacaaaaagtgagccacaacttagctagcaaaattggattgtgccacgctttggtgagttgatgacatgtgggacccaaacagatgagaaggaatcttgccacaagtgtggctatgaactaaacaatagactaacttggtcaaacttgactaacatgaggtgtggcaagttggcaatctttggtaaactttgggagcaaaccaaacatccttttacacagtgaccttgttcctaactgcaccgatgggctgatgatgcatattgaaggcccagccaactactgggctcatcatggatttggggaaggcccacctaaatggcatatgccctacgtgggtttacgggtggagaaagttcaaatttggttcctcattataggttgagtttaaatcatatctctcaaccgcaaaactggatacaattagcatgttcggtaagactttgctgtagcgttttaagttgtgttgtacaacgtagccgttcggctacacaaacacatagttacaggaagttgttgcttgctgctggatagttataactcctgtagctactggctggttggctgcagcgtagccacaatgctgctgtagctaagccgtccgaacaaagccaatataggagtatcttttatctttcaaaaccagtacaaatatagttccaagatgctttagacggtgatttttagctgacgtgacatccacgtgatgtttgatttggttttcatttgacatgacgtctacgtgacgcctacttgacataataagtaggaaaaaaaagtaggacctgcatgtcagttacagtaaatataatcatttttttcattcctctctatcctctctccctcatccttttagtccatatgccgtctatatctttttgtcatggcagcaggaaagattgccaactatggagctcgcttgtccccccccccctcgtgcatccgccttggacactactcgtggcgctcctgctctgtcccttagatagatcaacttaagacttttttttttgaaaactataaagtgaatccagcacataagtataatttgagtgaatctaaataagttccaaatagccaatcgcctactttacagaaacaaataaatctcaatttcagtaataaaatgtgatgatcgagaaaacctagatatcctgcatgtataagagggataatctcgcgccataccaaccataaaacaatcgaataagctataatcgtataatccaatgcttatatttcgggacggaaggattacagtacaatctcatgctctgtaaactgcaatcaatcagccattaaaatctcatgctctgtaaactgcatatcaagaaatttcagcaaccccgtgttgaattgaagacggggcaccactgctcctctcgccctcccctgctacacttcccgtttccctgggaggcggaggaggaggggagagacacacgcacgccgacgccgtcgcccaccaccccctgccgccgcgccgcgcggccatggggctccacgcgatcctcctcctcctcctcctccggatctccgcctccgcagccgcctccaggccgccgctcgacaccctcggcatcccgccgcaaggttccatcttgttctttttctccccccccggatctgcctgtatctctctttcttggtgcttgatgcggttcttgatttggtgcctgtgggggcgggggtggctggctgcactgcactgcagacgaggcgtacttcaggggcggcgtgatcaggtgcagggacggatcggggaggttcgccagggacaagctcaacgacgacttctgcgactgccccgacggcaccgacgagccaggttgcttccttgctctcgcctgaaaaagattatccctttttttttgccttagctttttgcggaggtgttctggttttaggttctcgtgtttgtgctagtagctcgaatctacttactgtaggcaatctaagagagctgtttaatcgaattgtgtttactttttgccttggcgcagggacatcggcgtgcccggaggggaagttctactgccagaatgctgggcattctcccatcacgatcttctcgtcgcgagtgaatgatggtatctgtggtaagaggattataatcggtggccattctctgtatcattcaaatgtaaacacagtaaatgtacacaaaatcaattgtaaggctagagattagggtgcttttgttccgtaaacatagtgcttgagggaattcccgctatatttttttctaattacccatatgtgtttgtcgctgcctcttagattgctgcgacgggagtgatgagtatgatagcaatgtcacttgcaagaatacgtgctgggaggctggtaaagcggcaagggataaattgaagaaaaaagtagctacatataaaagcggagttgttattcgaaatcaggaaattcaaaaggcaaaagtggcatttgctaaagacgaggcagagctagcgaaactgaagggtgaagagaaaatactacaaggccttgttgacaagctcacaggtgtgctcttcgtggcggtttgtcttgagtcatttaccaaagaatgttatgttgggaaatgctgttggcgctgctaattttcaatggatagtttattttgtgttaaactatgacttctcatgttgtgcagaacaaaagaaattgatagagaaggcagaggaagaggaacgcttaagaaaagaaaaggaagaaaagaggatgaaggaagaagccgaaaagcaagctgctgatgaaaagaaagcgtcagatgcctctcaggaggtagattctcaggaaaatcatgaaactgtgcaagaagatgagagcaaggttagcattctttctatatatctgttagattgccatatatacctttgtctgatgaactcttcatcctcaccattaatatcttgaatcgagttaagctggtgttagcatgttgacacgtctaatagggtgcagctatgtgttgtatactcatgaaattactatgctttgggagagaactaccatccttccaatggtttcagtgcatttttatcgcaaaatgattcacataagaagataaatcaatgttctacagagttttgtaacaatggtttatcgaaaagtacaggatttatgtcataattgtgcagaaccttaagtttcttggtggcacttaaagcctcaaattgttggcttcattttaggttttgggctagatgatctgaaccattaaactgccttcttaacagagataccatatgcatacatacatacatcaagaacggatagtccccatgtatcctagcaactggatgttccatcaatgctatttataacctttttccccacaatttaccagtaatggttagtcataaagaacataaaaatgatcatcactgtggtaacatatgatactatgctgtactaatcctcagttcctcacttatgaattgtaggaacttactgcacaactaggtagctcaatgccataaagagatatttatattattttgtttttgatgatgaatacaggtagctgaacatcatgatggacatgccacgagccatgacaatcacacaccagaaagcgagtcatctgttgagcaggtataatttaacttcgttattataaaatactaacaattctactggtacatactccctccttccaaaaatctgagtcctatttctttttgcaccaagaccaagaagcaattaattcattcaccatatgacaaaaccaatgaacatgcaaccaataagcattaaaatggcttcttgggttcctcaacaatttaatttagcacataatgactactaataggagttagacttttggaaaaaccaaagaatgaaataggtcttagacttttggaaggagggagtatcacattgagggatttttccatatatatattgggtttgtatgtcagcatgatcttgaaagccaagatgacattagcataaaagccgcacctgctgatgaatcaccaccagaggagacatctgcagcacctactaaagagcaggtgacttaataactgctttgcatttgagtcattctttgggcccttttgatatatgtttttccctgttctttggaggcaatagtagagataaatttgattatattaataatagcatattccttccagggattgaacctgtttcaaaaaagtattgtgcatttctctctattataactcaaaaactgatatcctgcataccctctttaaatatatataactctataccgtttagtgccctccttgtaaacatccctccaataggccaatctaacagccctcaaatctaatttgctgttgtgagttgagctacatgatggaatatgagccactcatatgcatattaatgatagttactgaaatctaaatttgtaatgttgtttacctaatctttggtatgtgactgttttggtgtcccaagaaccggtacttccgttgcaaatttgccatgttattgtgtttgaaacattcaagcaaaccatgtgtgtagtatgttgcgctctgaaaattaagtaaatatacaaaaatatcagtttcatactcgtcctcaatggcatcggtaaacaagaatgaaatttggatcttaatacaatggattttgaaattgaaattttgcaggtttagataattttatgtgcactgcattcatgtttgtttttggaacttttgaaacatcaaaatgtgctggatccatcgtattttcactaacagggatatgcaggttcccctgtttccctgtgcaccaagccatttcccttctaatagttcgttttggaggaaaaaacaaaggatttggattcctaaggattaattcctatgagtgtcattcagtttataggattgaagtaggaaaaccaaaggaaaattccctttcgtacaagttgtatagaggaaacatataggaatttttccatccactcaaacctcttggaaaaattcatatggattgatgtgtgcaaacattcctattccttcacctttcctattcctatggattcaaattcctccaaactgaataagccttatgaatttatggattcaaatccctttaaatgttttcaagtctgattatgtcataacaacccatttatgactctctctttggattagtccaactgatgatctctgcagtgtgtaataaaccaacattcgtagctagatgtctaatgccccataagccatgccaacaccagcacttgctacttgtacaacacttgcacatctttcctgcccttatgttcaattgtacttggttgaatacagttaaaactttttccaggggttgttacattacaaatatcagtacaagcagtaattttcatggttttcctaatgcactgcaagggttgaagcaatgtgaacttgtattgataaattttgtaggaatccactcctgctgactcagaaggtttatcaagagaggagttaggtcgtctggtagcttccagatggactggagaaaaggttgatgaggtcagtaaagatgataaaaatgagcatgaagctgagcatgatatgccagaacattcagaagaaacacatgaagatgaatcagatgtaccagaatctgctgaagacagctatgctggttaccattcagaagttgaggatgacagacataaatatgatgatgaagacttctcacatgaatcagatgatgaatatgtcgatgatcatgatgagcatgttgcgtcatacaagtctgatgatgatcagaaaggtgatgaccattcaggtatatggttcatgtaacctgcccactatctctcttctttgactcctttctgtatttggttatcgatttttcttttttcttttgttctgtcagatttcactgcctctgggcaagcatcatggctggataaaattcagcaaactgtacagaatgttttacgaacattcaactttttcaagacccctgtggatttatctggtaggttgtgtattctacctgctatgatccttcaaaaatcatgtgagatgctgtgtcacttattgatctcctttttagaggcttctcgtgttcggaaggagtatgatgatgcaagctcaaagctgtccaagattcagtctaggatatccactctgacagataagctaaaacacgactttggtaagtcagttgaaagtttgtttacttggtgattgaatgcacaagtcactcgtatattcttgttagctatataatggccttgcaagtttatatatggcagcgcttgccaccattgaattactgcctaagccatccagttttttttacttttaatattgatggttcttagcaaaaatcacccagttagcatgatttgacttgtcccagaatggtaacttgtgcattgaaaaacctgtcttcaaactggaaaataaatactcaagtcgtaggagcatttgcaggaatgtgcactttcaagtcacctctcatgcaggcaaggcatgttgagggtgttcttcctttctcctatttttctatcgttaccatatccaatttcagcagtaacgcctttgtggtggacactagacagcagtgtgtttcattaatagctgtaaagaaaagcttgattatatttttaccattgagcttcattactgtggaaaaatgcatttttaagaattatatgagttgataggtattctagatgttgacttcatcagagttatgtctagttcatatattatttgataggcctataatattgaaattaattgaaggaatacattcttattaggtaaggagaaggagttctattacttttatgatcagtgctttgagagcaaggagggcaagtacgtatattagtcatccaacctcacatgcgctctctctctctctctctcgtaaatatttccatggtttactttattaccattctatattttgttaattcctcgtttattgttattcttattgataggtatgtttacaaggtatgtccattcaagaaagcttcgcaggttgaaggacatagtaccaccagcctggggtatgtttgttagcctcctttcaggtgtactaagttttcattattattgctctgcagatgtctagttcagtttttcctaataatgggttataccactttgcaaagagtcgtagagttcagaataactctcctgctcagttttagctagcaggccacctagctttacatactgcaaaaggttgtatatgagctgattgaatgcaatgttttgttttcttgtttgctttatggctccaaaattccaactctgtgcatgcatcatacaagtacagaaccattatgttaagcaatactttattactctcagaatagtgattttgcagttgttttgtgcgataacataatttttttctgctgtcaggcgctgggacaaatttgaagaatcctacagagtaatgcaattttcaaatggagacagatgctggaatggccctgaccgaagtctaaaggtgcttctccttttcatgccttcgtgcccgttatcttaagatggattgtctgtttctgtttgcaggtcttgaaacttaataaaatatggcttgccttatgatacaggttaggcttcgatgcgggctgaacaatgaacttaatggtgtcgatgagcctagtagatgcgagtatgttgatttctctacatacaccttccaccttttcctgaaaatgcacattactctttaacttacatgcctacttcatgtgacaggtatgtggctgtattatcgactccagcgctttgcgatgaacaaaaactgaaggttctttctcaccctctggctaatttgttctgttctttctttttcccaatataggttgaagcttacggaattgtgctaatgtaacaggaattggaacagaagctcaaggcatcttcgaaccagcgtgaccatgatgaactctaaattatggggtgagacaataatgaacttgctacaaggaaaacaactctcaccatacagccatactcacaagagaggtttaacaggtttattatatgaatagaatagcatatgaaactggaattcttggagttcagcactcggattgccaccgaagcagcattagtttggcaagaaaaatttttgaacaaaagctgtaggatatcgcgaaattcctcaccctgatttgtcggtagattttcttttaccactcttccctgtaaacgtatttgctcaatttttctatgccaccccaaagatgctagactgttgtttgtaacaatctgagtgtttctgagttatgaatagtatatttatgaactacatcctggatattcatcactctggatgtagcatctgccggctgctgtttctgatcaaattcaagcctgtttttttttttttacactgctccagaatgtctagtaggtggagctagttagtttgtggttattgcactgcgctgttgtatgcttggctcgttgttgaattataaaattcaacgccgaatttaaatttagatttttaggtgctttttggtcgttttcatggttgctaataggacaaatggaaaaatctttgaaaagtgaaactgtgaaatttgataaaatcgctttggattactccaattagggatgaatataagggtttatttgtggaacttaaaattcttaaaaacagctggtaagaatctggacaagctaggaaacctaatctctggcttttagttagattttaggtgaaaaatctaaattgtctgacgagcttttgatagctggatattctaaaagaagttgaagctcattgtttcgtaaagagacggataccaatttggaccaagtgtactagtactagttcatttttatggcattttaactatttatcattttagatatttaccatatgtgtaagccatatgtaggttaggtgttaaattagtgaacgctgatggttaaatattttgtcttttctttttttatatatagttgttgggaatgttcgccagaacggatgcacgatacgcgtggcatatgtatagagccctgtttggaagattagctcagggctaattttgagagctaatgtttagttatgaattggtaggctaaacattagcctagggtggtatgtttggatccatggtataatttaaggctaaaaggtggagagagtagaaagagaggagagagaaggagagagagagctgctttttgatgttccccacacaaaattagccccattagcaccccttggaggggctaatgtttcgaggaggggctaatttacattagctcaaaattagcccacctgtttaaatccttgaggactaatttgagactaaaagatgagggttaaacattagcccatgtaaccaaacaggacttaagttgattcggtggaaagagcatagattaaagagagaatgctcgagaagagaatctgaacatatggtttagtttaatagaataagtactaattgatctcgaccagcaggtggggcgctattgctggctgtggggacatattatttattatattaactttaaacagctatacgtctataccactattaaacacgagagaaaacgaaatgctccaccgatttttttttttaaaaaagggctatttttatcgaactgacaactgaagcactatacatttgcaaaaatacaaaaacggttgtaacatcatggtgccaaacttgatatttgtacgatggagattgaaatcaaaagagttcttttaatcatatccgaaatgcataagccatttgcgattttgttctcccaccgaccttttttttttttttgggttcaaagacgttcaaagtttccaacaaaaaaagaggacgagaaattcccccgtgactccaactcttctagaacgagacgcatttaatttctgcgtgtgtgtcgtacgacgcgcccggtcaatttctgcgtgcgactcggcttcgctcccaaggcgcgcgtgcacggtttgcaggagacagccaacggaaaccagcagggcaaaccaccagatatgatagatgtactaccatttcagtggattttctttcctttccttgagaacaccatttctgtggatgggatatgttaaatgcccctaataaagatatatattttattttggcactcggtagtgtgctttttaaactgttaaacagtataatttacgtgaaaactttttatatataagttattgtaaaatatcatataaatatagtctcataagtttaaaatgattaaagtttaactaattatacacaaatggctttctcattttacgtgctcgaacggacataaaaggtattactccctctgttttaaaatatactactaacctacgtgattagaaacatcatatcctggttcattttaatattttgaaattaatgcaaaatatatttaaacattctatcaaacaaaataacacaaagccaagttttcttcaacttcaaactttaattttcttgtttttggtttgcacgcttttcaaactgttaaatgatattttttaaaaaaattatatatatatatatatatatatatatatatatatatatatatatatatatatatatatatatatatatatatatatatatattgctttaaaaaatttaaataaatactttttaaatttataattattaataattaattaattatatattaattatttttctcgttttacatgcgctgaaaatatctccaaaagaggagatcgaacggcagcaagttgtatccaaggttgtcagtatcccgattcgtatcccagtatcttacgatactacgatcctaccaagccgaaacgtacaatccctaggatactacaaaatattatttaaaataacatggtttgaaaataatgtaactaaatatgctcaaatttatatgaaaatcagttaaatatatcaaaaccaacatggtttctcttgataaatgtctctctatttgcatgacatatatcattactactttttttatatagaatggctatatatataattaatataaatgttaattaaacttaaaaaaagaaaatctcatagtatcccgatactacgatacgatattactttgagcaaaatgatacttcctatctcgatcctgagagacaaccttggttgtatccaccgccccccagcatcagcatggatggacaactgggcaaatatgccctccagtcaagaaacatcctattcctggagatctttttaccagcccccacccacacccggggtgggccccacctgtcagtcccccggcccacacctccccacagttttgaccgacattgtggaggcctttcccgttggacccaacccaacccaccgcaccgctgcatccgcatctccccacccattggttccctttccaatttcacctcgcccaaccctatttatttatttatttaacccttcccccatctcgcctccattcttggagaccaagaagaagaaagaggaaaccacacccacctccatctccgcctccgccgccgccgccgccgaccaagtcgagggggagatccagcgagagcgaggaggaggaggaggatggcggtgatggaggagcagcaggagggagccgcgggggtgatgcggcggaggcccaagacgaagatcgtgtgcacgctggggccggcgtcgaggtcggtggagatgatcgggcggctgctccgcgccgggatgtgcgtcgcgcgcttcaacttctcccacggatcccacgagtaccaccaggagacgctcgacaacctccgcgccgccatggagagcaccggcatcctctgcgccgtcatgctcgacaccaaggtcccattcgtgtctccaatcccctccctgcctccctcctcgatctctcggtttaatttttcctcttcttgatctattgttcttgatccgcaatttaaggttttcaaaaaagagagagaagtttcatctatgcgcttgggaacatcctttgaaatatgtagagggagattagggtagaaagagatttggtccatgttcgatccgatgattccggtgcattttagacgaacgatcgatcgatctatctatctatctgttcttgccaacttttcaggcgcgtgatttcgttcttggggtgttaattttggccaccttttattttcttcaagacttttgtgcggtcgttttcacagtaggccgttgctcgtccctgattcttgggttctcaccccctgactattctgctggtcaaaagacaatatcagtcatgttttgttggctcaaaatcaggtacgtttggctgtttgtggatgttggtagtagtacttttcgtactgtggatggattgatttgcccgccaccgacgcgttagaagcggcaagaaacgctgacgatggatgagcgatgcatacgagtttctgaagatctgggtattcgatttgtccgcgtttttggcttgtagtagattggatagttagttggattgcgtcattccgcgtgcggattctgtggattggatggaacattaacgttgaattagctcctgaactggtacgaattggtgctcgcttagcgtgttgtttgtccatttcctcccactgttggctgtggtcctctgttcttctcgtctttcttcatttggctggtccattgttagtgaagtttatttttgttttgatctgtattttcacctggtgctaagagcaggtaaaatagtaggctataagctagctataaacacatattgagaagataaaataggagagagaggagcaccgggctacagatatgtagccagctccaagacacaatgtgtgtatgataggtgggaccatgtattaatattgtagtatatgtttataggtaactattatatgaattggctattaaattggttatagatggtttagagccagtagttggctatactattaaacttgctctaagtggccagtttttcaattagcggagtttagcgctctggattaatttggactgtatgttataactctggaaaatggtcgtaaagggagaattagttatgttgttttgaggacttccaatctttagcttagacgatgataagatttgtgtggtacatgaccaattttctgaaagactttgttcaggatttctcaatggcattaaacctgtacgttattttccatattattcatatattcccgaacacgcagttgcgggccagtacacgcttcccaacttttccagagttggttcagtttatttaggagatgcaaattaagtgatttgatccctgctaatctgctgggaaaggaactgcttcttatgggcttgctgtcgttattatgtataaatatttctgttattatgctatatcaagttaggtttatcttcaaggccatatttggaaaagttggtcttctctcagtagctgatgaaaaatgacttcagcatctttgtagtatcagactatcagaggcttgaggtctcttagaatctagaagcttaaaaggttaaccctactccatggagagtttctgattttatgtattgtacgtatgtttggaaattcgaaatgatggcctccttttattaactcagggagtgccaaacctagcaagtgtcttgtgcttaggaatagagatgtgatattgtacactatctatatcacatagcacgtgatgtgatccacgcacctccagctcctcacccatccgacccacaccatttttcactgatatagatgatcatgagcttggcatttgagattggtagaagtagcttattgtttaaattagaagcatcagaactgattctgcattaccttgggtgaccaactgaagaacaacctcatatgctgtcttccatccaccaccaaacaagcttgtcccatggacctgcactgacaacgataatcgtatttgttcttggattcgaggaactcttgtaggttgtagctgtccagaactccagatctgcatgataacatatttttcccttgttcttgtctagttgaatttgtagttcttatttctgtccagagtttgagatgggacaagtttcctttcagttttatctgtatatataccaataataagagattctgtccaccctagtgaacaatagggtggagactagtgcttgtaaaatagacaggatgtcaattgtcaaatcatcttacattttttcttcatagatacttgtagggaaaattttcttttcatcctggtttctacgcagcgttaatatttgcgatggaaatgcatgttgcatttgagacagtcgctctcacaatgaaaaaagaaaagccgtgttaattgcgtttagtgaacagcatttattttgtggatattgggttatttcatttgagcatcttctcttctgtcagtatactgtcaattatgctgcatagtatagcccttaagaaattcttattccttcctgtaactaccctcaggaattccatttattttgactatgactactggcttgatttgtgctcccattctttttgcagcagcggtttcctgtcttcctgttatatgggtattagtctaaaaagaatgtaaagtaaaaatacaatgctaatggtataatcttcagttgatcgactctgaagagtatgaactattagttgaagttaaaacatgagtctgaatttatgggatgcattattagggcatatttcaatattttggttgttttgccattatctgcctttgctttggtttttttttctttaagatgtagtgttcttctatgaatacgtacatttggttatgtggacttgtacttgaggggttaagatgttgtaacaacgttagttggtgtttacaaataaataccttgaacacgctgtgctttgtgcagatactacaagtacacgcaaaatgtttttgtttctatctgcatgaatcgtagcatcccctgcctttaatatatataatttcacgagggtaacagcaattatttatttctccatgagtcctgtgactaatgaaattatgaaacaacattcaatctcctgaattccttttctagagaagtattgttgaaattgcttgtttaatgtataactattgttgtataaaaatgtgtacttatcagatattggatttgcttaaaatacaggggccagagatccgaactggatttctgaaagatggaaaacccgtacagttgaagaagggtcaagaaatcacagtttcaactgattatagcataaagggtgatgacaacatgatatcaatgagctacaagaagctagcggtggatctgaagccaggcagtgtaatattatgtgctgatggcaccatcactcttactgtccttcactgtgataaagagcaaggcttggttcgctgccgttgtgagaacactgctatgcttggtgagaggaagaatgttaaccttccaggagttattgttgatctcccgacacttactgagaaggacaaggaggatattcttaaatggggtgtcccaaacaagattgacatgattgctctgtcttttgttcgtaaaggctcagaccttgtagaggtcaggaaggtgcttgggaagcatgcaaagtcaataatgctgatgtcaaaggtataacattctcttttgagtattgcacttctaagctgcactttgcaaagattttaatctattgaattttcaggttgagaatcaagagggagtggctaactttgatgatatcctggcacaatctgatgcttttatggttgcaaggggtgatttgggaatggaaattccgatagagaagatcttttatgcacagaaggtgatgattttcaagtgcaatattcagggcaagccagttgtgactgcaacccagatgttggaatctatgatcaagtctccccgccctactagagcagaagcgactgatgttgccaatgcagttcttgatggcactgactgtgtcatgctcagtggtgagacagctgctggggcttacccggaactggctgtacggaccatggccaagatctgcctgcaagcggagtcatgcgtcgaccatgccgctgttttcaagtccattaccgcatcagctccaattcccatgagcccattggagagccttgcatcatcagctgtgcgtacagcgaactctgccaaggcggcgctcatcttggtcctgactaggggaggaacaactgctaggctggtggccaagtacaggccatccatgccgattctgtccgtcgtggttcctgagctgaaacagaccgactccttcgactggacctgcagcgacgaagctcctgcgcggcacagcctcatcgtcaggggagtgatcccgatgctgagtgcagccactgccaaggccttcgacaacgaagccactgaagaagctctcgggttcgccatcagcaacgccaaggcgatggggctctgcaactccggtgagtccgtcgtcgccctccaccggatcggaactgcatctgtcatcaagctcctgacagcgaactagtggcagacggcagttaatccacaccattttgctcggaggaaaatttttgctgggggattcttacttaccacgcatatctatagcttttgttgccatgatagtggcatttgcattcaggtgcaccttcggtgtttgctgttcatgggttaaccattgaaacagttaaattcgttattgctaccgcagcttatttcgctgcctctgctgctactagtattaaacttgacagccgttacgtaatttgttagttctattctgttctgttttcttggctgaaatgcatttcttgaattcgtttcgttatgatgaatatggttcggggttctgcgtaactggttactgctagggatatgaaatggagttgatagtttccgtccactacttgtagggatataaaatggagtggatagtttcatccgttcggagtagaaactgctccaaatggattgaacaatgttatttggatatctgttgaaggcgtgaaacatctcattttttacatgttggacttaattaggcattgtttataatttatgatcaaacttttttatataaaacaagcttattttgtgtttatgtgatggtatttgtttctattagaagtttaggtggttttcatgttttgagaaatttttgttttgatatttgtgtacgataaaaacgaatatggtataaacattatccatctgtattcatcctgtttttatcctcagctccatttttatccctagctactgcaatcagaatgaattggggagttaaaaatctccaaagaaaagtggggcaactgggaagctactgctccccgccaaaaaaaaaaactgggaagctactgcaatcagaatgaactggggagttaaagatctccaaagaaaagtgaggcaactgggaagttgaatgcatgcctcataggatgaattgcgttcttgacaaactgaaccagtatatggagttgaatacttaggccctctttctttcagtttaggattattataatttagattattgagttagattactataagctatattgttataatctgtagtagaataagcggttagttgtttttttctagattattagagcctagattattgggtttgcaagtctaaagagggagtgaggtggcatggtgggtattttttcacccaataatctaaaaaaagctcacctaaatgagcttatcggattataataagctgtgctctagattataataagctacttcaataagtctacttcaataagttgtctatttctttcagcttactcctaattatctggattataataatctcaatctgaaagaaacgtagccttatgctagcaagttgcttttagattactttagctgctaccactgatttgtctttttttttgtctgccatcctctgtatatggatgtagtcctgaaaaaaaaaatccaattccgaggatgaatttggatatctttagaattgaatttttatcggaacagaatgagtttgttgaagttagtaacattttcatatttctaactgaattactacagtatagcattgcacagcatcaaatgagcatttcaaacaacattcttactcgtaagctgaaacttgtactccctccgtcttattttaagtgtagccatccgtcctattttaagtgtagctatggttttccgcgtctgaccttaaccgtccatcttatttaaaaaaattttaaaaaaaattgaaaacataaaatactattcatgttttatcatctcataacaacaaaaatattaattataaaaaaatttcaaataagacggacgatcaaaatttagcgtggaaatttatagttgcacttagggcagtagcagtgcgtcgtcaaaatttgaggagcctcgcatgccacctgtgcaggagaacgcccaagaacaatactccacagtgcagatttttttaagtggggccaccaatctttattcccttttacttttcatctaccctctctctatcctctagtcttcgttcccaccaaagaaagtcactgaaccatgaactcctccccaccgacggaatcagcaaggcggcgaccggagcgacggctgggcggcccaagcagcgagctcgtcctcgcgcggagccgagcgaagcgctggagcggcgccgcgtcgacgagccccagccggcacagatcgaggggcagcgcggctggcgagccctggccggcacagatcgggggggcggtgcggccggagccgccgctcctttctcccggtcggccccgccctcccctcctcgctcctctctccctctctcctttggcacgtgtgggtcccgccggctgtgctccgcgttctcgaggattccacgcgaattgccgatgtggcaccgaatattcggttcttgggtgcgaggctgaacaccacctcggtgcgttgtaaacacccttaaaatagaatggagggagtactccaaataaaaaaggcaaatctcataatacgatgtgacatatggatatatgatgcatcacatctttaacacgaggttggtttgtttttttttttttgaacggtactagtatttgtgttcaggacaccggtgcaaccttgaacttgattagcatcatgcagagttcatatacacgccactaatatactccattttccgccgaacgcaaattgtatattaaaatcatgggatatatcacaagatgattgctaaagaaaggggagacgaggaaaaatgaagttccattggcaccaaagccagtcaccacagcgacgacgaaccccggattatgtacattgtcaaagttgcaaaaccatgagctcctccgccggtcgccggagcagcagcaccgccggtgaccggcgaccatcctgagtcgtcatcactcgtcgctgtgctgctgcgcgtgcgagctgctgccggaagtcgacgccggcgacggctgggagaggatgctcctgagctcctgcatcacggccggcaacctgcccaggcctcccccgtcgacccgcggcgccggctgggacaaccgccggccgccgccggagtgggcggcgccgccgcgtgcggacttggaggagtcgtcgtcgtcgtcggtggggagctggaagcggcagacggggcaggagctgtgcatcttgagccacggcacgatgcacttggcgtggaacctgtgccggcacggcatttccgtggcgcgctcgccggcggcgtagtcctcgaggcagacggcgcaggcggagtcgcagtcgcccccggcggccacctccaccgtcggcatggactccacggcctccttcttggccgggagcgtgccctgccgccccgcgtcgccgtcgcccacccgctgcatcagggcgtccaggccggggccgaggaagtagtcggccagcgccacgccctccgcgtctctcgaggtcccgacgacggcgccggcctcggccgcggcggcggagatcgtggcggtggcggactcgaggcgctggagctggcgctcccgaaactcctgcatgagcagcagcagcgcggcggtgcgccgccggctctcggagaagtcgaggagggccaggtcgcggtagtagccgtcgtccgcgccggcggcgtccgcgaggcgacggctgcggcggtggcggcggacggagtcgccgccgccgccgccaaccatgccgtcgatgatgggggcccagacggaggagatcgcgccgccgccgccggtggcgacgccgcgcgcggactcgatctcctcgacgaagccgctgtggcagtacgggcacttgatctccacctccccctccgccgccgccacggcgctcaccgtcgaagcgcacatgtggcagtagtacagcccgcctgccgccgcctcctccgccattgctcccgatctcctcgccgccgccgccgccgccgccgtcaatgcagcagcttggattcctctcttgggctgcgacgaaggattcaacaaaccgagagatcaaaacccaatgcacgatttctttttccttttcctttccatcatcgaaaggcactcagatccccaaatcaagaacaaagttccatcaacaagaaacaagaaccactcagatccaaccaggaacaaaaaaaaaacaagaacggcaaccacaaattaacaccaagaacagaagattctaacaacatgttcaacaaggccgcaaacgaaattaggatacgatcaagaaaccaaccgagcaaccacaaatctttgcaccaaacagaacaactgcaaccctaaattcctctgaacacgctcttgacagaaccgatcgaaggagaaagaacacaaaatcagaggaaatcatcaaccaaatcagtcaatcaatcaaaaaaaaaaagagatggtcaccttgggcagggcaagtgagagggggaggagatcagggccagagagggaggggctctccaccagcctcctctttattattacagtgatgacctcctaatccaacacattttttaggcagttattaaagagggcttttgcctgcttaattattgcctaggatgctctgtcatcctaattttaaactccccaacaatttcttgttgatttttctctatgctcttttctcccgtgaaaaaagtttcagtggtggtgccatttcgctttcatccaacccagaaatagatcatgaaaaggaacataaaagcgacgaaaagaaatatgcttttttttctaaaagattatttcccatttattctctaatagatttaatcatgtgctgatgacattattatgattccttaaaaaaagcaatgcgcgcgctccgagccggttcacctttttaattgaagtacagcgatatttaccaaatttcgatcaaacgtattatgaattcttaaaaaccattaaaattttcacttccaatttgctttcgtcccgctttgaacctaaaattttttcactgttttcgatcggttttcgtcaaaagcatactaccactagttgttgcattaatgtactataaataagacacatattttatctcgacttttggttaaaaaaaggcatatataacttactttaaaatataaataaatctattttcggtttattttaattaaaacttaattaatcatacgctaatagttccatctacgtacccaaccttaataacgggcctaaagcaggctaacgtgggccgtattacgggccggtttaggctgggcctgagttggtccagatatagtgggccggaatatcgcgaggtgacgctgacgcgtccatcgcgcacgacatcgcccccgtcaccctctctgcgctgctgctgctgcttccgatggcggcgcctccgcttccccgcgcccccgtctcctcctccgccgccgccgcgtcgccggggggccgcgctctcctcctcctccgcgtcggcggaggaggttccggaagatgcgctggcgtggcggcggcggcggcaccgggttggcggcggccgttcccggctgcctccgtcgcggcgcgctcggctggtaccacgccgggagaggtcgccgtcgatcctaaggttggtctctgcaccactatccctatcggttctcggcgagaggttgccggaagcgtttcagggtggatgtgcctctcctttggtgctctaaagacagacgagaatgacaaccgccacatgttcgtcggaattcctagatgagggttcacctctgtagtgctgtgtagcgtgaggcttttattgttgttcatgtagagatagaagagtatgctggatttcttgtgccgcagagttggggatttcttgctttgagctaagcttattttgttgctgcaaatctttgcagatggtagtacatcacgctagttattgatagaacgatgctgttagtataagacccgtgggcaagctgattagaggcacaatggcagttcatttttggagtgatgcgtagctacgttgatttatgcactaacaagtattcagccactgaagggcatgcaattcatcatcctgggcccgtttatcaacttgtagatatgaaacatcgaatggccctgtcatgtcacctactgtcctacccattctatcagaatctcaattaactgttttttagcagggattattctaaaatgcacaattatcagatgactacttcagtaccttctatgtgttaaatatacttttgtattttgggggaatatgatgacgtgtttcttagtttgcagtgcatgtttgttctgtattttaatattaatacaccctagtttcttaactatgttcttatacatatcttggttgctcttgatgggaggcatttactttagtaaagcaaatatttgccatggtctcatgaatttaaactagcttctaaatgaattgacatagatgcagtgttttccattccgtgactgtttgatgactattgggtattttagcagatttgccttccatagactttcgctgaactataactttcacagtgctatggagctagtttgttctaggttctagaggaactaagacagaatatgagactgccagtttttgcatggatctgaagaaacatttttcacaaataaactttcttaagatgcaatacaattttaatcatcatgtactgtatgtgactggtttgcttagttatatcatatcttacctaaattttattttcattctggacgaattttaggtcgaagcaatactagacagtgtgaagtgggacagtaaaggcttggctgttgctattgcccaaaatgtggatactggagccattctcatgcagggttttgccaacaaagaagcccttgcaacaactatatcaaccaggaaagctacattctatagccgttcacggtcttcattgtggacaaaaggggagacatcaatgaatttcatcaatgtgcatgacattttcttggactgtgaccgtgattctgtaagccttgcttgtcacgatgcttacttttgcttcagtggatactaactgctaattgggttgtttgtttttttttcctgaaacatagataatataccttgggaagccagatgggcctacttgccatacaggggcagagacttgttactatacttcagtctatgatgctctacaaggttcgaaggtatctgttcttgggttgccctttctgtaaatgaacctttacatataatttaactatgagactccttcacagcccaatcaagataggcaggttgtctcaactctgtactcacttgaagatacaattagtagacggaaggaagagatagttactgaaggaagtggcaagccatcatggacaaaaaaactaatacttgataaccggctgctttgctcaaaaataaggtatgtgatgttatatttcaaaattcgtctataaaactaatggtccaaacattaaataaataagcatattatgcatggctcaggacaaaacattgcattattccctgtcattaattctcatattctagttcagtcatcactattgggtatgccgattggttagttaattgatgtgctgttatgtatgcttgttcaatatccaagacagttcacagttattctttatccatggtttttgttaaacattatgagcttgcaggacattatgtgatactattaatattgtgtactccctctggtcttaacctcgtttttagcttcttgtcttttgagataaaaccatgtcagtttctgtgatatactttcaagttatcaacataaaacatactggaagtagtttctatggtgaacatagtacacatgtgatctttacttggtcacagatgttgaagaagacactgttagttctggagcaaaagttttgataccatgcgctacagtgacaaattgacaagcatttttatggtggtctactagaagaatctacctttttacaatagcacaacatgaaaatagaaccattcaaaatgttattgcaatgaaatcctgtttagggaaggtgtcattctacatcatatcgaacgggaaataattttaggacacaacttgctgggttagatttcttccttttctgcccttggtgaggtcttgcatattcttctggtcccttgtatattctccctattcacctgtcaagaaaaaaaaaaacataatcttgcaaacaactgaagttgataaaattattactggttgcaacattttttctcggactttttcatcagcatttggaaatggtcaaatgggagcctaatacacttaacttgttcttagggtatgactgttggatataaaattagatcctaatacctcagttttgaacttttgatatagccttaggcttgaacaccattcaggggataccattttaagatttcgttaatatggatcaacaaaggtttaaaaggcatcttgggggtgggctcgacggaaccgtatcctctaacattacacactaatgtcaccgtgtgacattcctttgatccacaccatccattctaaatcaaaggtcatagattttttggcatgcaattaatcaaactaattagtagattatgtagttaaacaaattcaggcaaattcaggcaagtaacaagcacatgtcgataattaggtttaacttagagcaggtacaatagcaggctataagccagctgcaaacatatttcaagaagataaatgaggagagagaagggtagtgggctacagatttgtagccagctatatcacggattccaagatgcagtgtgtgtatgacaggcgggaccaaatattaatagtgtagtatgtaactattgtataaatgagttattagattggctatagatgaattggagctagtagttggctatactattaaacttgctcttacctgttagacgcaatgattagcatatgaacctgttaaggaataaatctcgtgcatcaattttctttgtgttgccacatcttccatcagaaaaagacaattctcataatctacaagttggtgggctcatgttactgaacatgaagggactactttagtgctaaaaaaatttcctactcattaagtatggtaatgtttaactacataatctgctaattaatttgattacttgtatgccaattaatctatagccattgatttagtttggatggtctggattcaagaatgtcacaccgtgacattagtgtgtaatgtcagaggatacggttccgggctcgactagataataaaattcatcatcgtcaacctgtttgaagtattcagcatttgatcaaggtaaaggaatcctcttaatcatcatatagcaaaagaacatactcttatagccattaatgcgtctcatgcaccatatgttgttaatcatttggcctctctttcagagtttatctgttagcatgtacaatatgatgatcgatgtgcgttgtgaaagcaattgacatacatattgtgttccttgtattatattgccgtcgttctttcgccttttccctatccctctctcaatgtgaatgcccatatatttgacatacatactgatttggtttttcatattttccagcgaagaagctggagagctaaaccaaacactgcttgagaacgaggacgagagccgcacaatcagtgagatgggtgatttgctataccacgcgatggtgctgcttagggtcaagggcgtgaggatggaacaggtcttggaggtcctcaggaagcgattctcgcagtctggtattgaggagaaggccagtcgcaacaaatcttaggatattactcacagagtggatgggtttaccagtttgcttatgtcgtatcggcattggtgccaagtgtgtaccattgagtagtttggtcttcttaattagaccgaaggttgtgaattgtgattatgctttaattgttctccaataagacactgagcaaatacatgtctggaatttgcagtgctgttcttgctgtcgccaataaaataataaaatcagctcataagtaaagcatcttcctgatttgatgatctttttttagctatgttgtgaaaccgctgctcttatttcaacgccgtgcaaagttcaatctcaacaggaatctggggaaaatgctacacatacaagtcgttagtatactacacttttattaactgtattagttaagcagggttcacaaatttgttcgaattttgtcatccgaaatctgaagctctcctaagcagatcggtttgcgctgaatttcatttgaaattcaacgaatttgttacatcgcctctgagatgttcacagccaagtagtagcaaattaaaggaaaaggacaaaaataaaaaacagcgtgcaaacaaattccctgcaatagattaaaaaaaaaatcgagcagtcagttccataagaaagaaaatgcccgtaaatttgagaaatttcgcgcgaatttacacaaacgcgtgagccgcccgaaaataccccgagaactctgaccccggtcggactcccgactccgagacgagacagagaaatccccaaatccccacgtctcctcctcctccgccgccgccgccgcatggatcccgccgccggctcgccggatccggcgccggcgccgggggcgaccacctccacggcggcgaccgtcctcgacggcctcggcgcggaggtgctcgcggtgatgtcgccggtctccatctgcatggcgctggtcgtgctcctcatctccctcctcgcgccgccctccgctccggggtccgccgcggccgccgcgcagccgccgccgccggtcaccgccgcgacgctcgtctacctcgagagccccaccgacaccccggggcagaagctcgtcggcgcgctcctcgacgccgccgtcttcgtcgccctcgtcgccgtcgtcaccttcgtcctcgtcgcgctctactactaccgctgcacgggcttcctcaagaactacatgcgcttctccgccttcttcgtcctcttctccatgggcggcgccatcgccgccgccgtcctccgccgcctcggcgccccgctcgacgccgccaccgcgctcgtgctcctcttcaacgcctccgccgtcggcgtcctctccgtcttcgcctccgcggtccccatcgtcgtgcgccagggctacatggtcgccctcgccgtcatcgtcgccgcctggctctccaggctgcccgagtggaccacctgggtcatgctcatcgcgctcgccctgtatgacctcgtcgccgtgctcgcgccgcggggtcctctcaggatgcttgtggagctcgcctcatccagggacgatgagctccctgcgctcgtctacgagtcgagaccgacggttgggccggcctccggttcttcctcctacgcttcagccatgggatcagttgagatgcagccggtggccgatcccggtcgatcgggtggaaatcagtatgacagagtagagcaggaggatgattcgagccgcgccgtggtggaaatgagggatgttggtggtagccgatcaagcattcgtgagaggaacctcgaaagggaggcgccgatggcggtatcggtatcagggcattcatcgaatcagggtgggagttcacagcatgctgtgattcagattgagcagcacgaggaaggagagacagtgccattggtatcagcggcatctgccaacaatgcagcccctaatgaggagcacagagaaaactcttcttcagactctggtatggagttcgagatgttcgagtccaccaggggcatcaagctgggacttggtgattttatcttctacagcgtgcttgtggggagggctgcgatgtatgatctgatgacggtgtatgcgtgctaccttgccatcattgctgggcttggctgcacccttatcttgctgtcaatatgcaagcatgcattgcctgcactcccgatctccatcttgctgggtgtcacattctacttcttgactcggttgctgatggagccgttcgtcgttggctcttcaaccaacttggtgatgttctgattaatctgctattgccattttacatatgtgaaacaagaaagaggaaatgattggcattttttttcagtgactggtatttttgttggtcacttcgtagagcagtcatatgtatttatcattaggaaatgttgttacaagttcaagaccttaggctcttaaggtagtctcagggatcgactagttacatgccttgttgtatggttctatcaacatgacatgacatttgagaagaaagattttcgtttcatgttctcttgattactctttgactgatattttgggttgctctcactaagatcagaggtcaagtaatcacttattcatcatactttttaccaacctgaagtcaaattaatattcttattcctcccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16033 - DNA, 619 bp, Oryza sativa
agcaaatccttttctcgatgcttttatacccttgccgtcgctgggcctggctcctcgtttctcgcgcccactatctcgctccctcgtatctcgctatctcgctccctcgtttctcgtgcccacgtttccactaatcccattcgcccgcttacggcgcgtgaagtggatatgcggttgtggcaatcgaaatggattgtatcgtgcgcgcgttaattacgctcgccgaccgaagcggcgttaccgtatctccgggcgagacagatctgctcacccagattcgcgcgctgctcaagtggtgtggcagtcttgaatagaccgcccattatggacaaccaaagttatcaataccaatgtgcatggattgagaccgttgggtattttgcccagctacggaaaccggtcccacctgtcaccaggctttaggggtggcgtcacacctgaccgcttcccttgggaagggaaattgctctggcataacgccgggggctactgtcggtgatatgggaccgggagtatcatggccagaggcttgaggcagacgcaatcgcccacgtggcctggcaccttcggggacgtcgggcccgagggtgaggtgtccgccctcctcctgatctccccc

SEQ ID NO: 16034 - DNA, 458 bp, Oryza sativa
ggggaaaaaaaaggagaaccgtaagggaaaaaaaagatgcaaacttctacagaatattcaaatgaagtactagcacaaacataaacaatagacaagaaatttcaagtctggaatgaagttaagaatgcttcgacaagttcgaaggagatgcaatgtaatggtcctcggacaaagagatgctaaactaatacgcaccgcaaacttttgaagggacatttgagcgtctttctcttctctgctttgattgccaaaaaactgagatgatgaaattgcctttgcattagagaattttttccttgcttcgtcagtctcctgaatctgaaaggtattcacgtccagtgtcagtacttattaacataacaaaaatctacaagcggaaaactatttgatataataagaacatgctagcaataacaacagcttgcatagagagaactgacttttccaaagttcaaaag

SEQ ID NO: 16035 - DNA, 266 bp, Oryza sativa
ttcctgcagccccatcgagctgatgtttctctctggcccatgtttctacaccgtgctgtgcaaagttacatccccttggttgtggttaatattctcgagtcgcgtagtactctgaaatctacacccttgtctattatcatctaggttatgttcatgtagcataagagttgagttgagtcgtcagcaaagaaattttgttctttctgtttcatacttatttttttttggggggggggggggggtcatccggtttccccccttctatc

SEQ ID NO: 16036 - DNA, 649 bp, Oryza sativa
tcctgcagcccgttgatatcaccaatcgggactaaatatctctctcacatcctacctcgggatgctttcccacgtccgtatcggtctcgagaccgagagacccacgtctttatctctcgatctctatatgttcgctagttctccctcgatcctctttctcttcactcactcactctctctctctctctagcaaaggctggccaagagaagtggtagctgggcggggtcggtggtggctgggcgggagaagcggcggcggctgagcgggagaagaagcatcggccgggcaggggaggtggcggcctcgccctcccttcgccagatccggcaggagggaggcggcggcggccgggcgggggcggcggcagtgaagtgacagcgactcgaccagaggagaatttgttttttttaggatttgtggtgaatttgtttttgagaatttgtgatgctttttttgaatttgcgatgattttttaaaaatttatgatgtatttgatctatgatttggggatgtagtgaaatcaatatgcaagcagttaaaaacaatgaaaaaaagaaaaaaaaactttagttcaggttgctaacaccaaccgagactaaaaatttgtggtccccgattatataactgggactacaggggttacgaacc

SEQ ID NO: 16037 - DNA, 722 bp, Oryza sativa
tcctgcagcccatcgttttccgatgatataaagaatcttcagtggcgtccgggtgaccgaaaggctggataccaggatcgtcgccatgaacacgaatcgaccatgtcgctgtacggagtactatagtacacagctcgtggctgttagagctttggatggttggatggttgccacttgctcttgcaaatcaaacaatccagcgaccagtaagcttgcacggccacaaacggctctggaaaactgatgattagggcgaaatattctggttcacacgctgtgtcatgtcacctcttaaaaacgacccgctaaaatctagtaggatggaggaatgaaaaattacggcccccgagttaattaggaccaccagactgactcagcgcagacgtgtcatgcaattttgtgctcagaatttccaaggaaacgtcgttaatttcattaaatgttactggagtaccatgtttcagacaaaaatacacgtataagaataagaaatcaccatgctactaatatattcatgctgctactacatttttgcacgtgacgttcaagccgacaaggctgtagctttcttgcaccggtaggaggtagccgctgcagagacgctatcattccggaccgtcccctttgttcaacgaacaaattgtccggttttactaaataaaattcgtatagcaaacaccatgtggagccatgaaaacaatggcacgatagatgccatgcca

SEQ ID NO: 16038 - DNA, 1386 bp, Oryza sativa
ctgcagccatatttctgccgggcatgttaatctgaattatttgtttcacttgtgcttttgcagttgctagttcagacggtcatgcagatgacaaagcggcacgtggtgatgaacttatcgtgttaccaaaataggtaatatattggacgcagatcacttgtttcagtttgctttgatacttttatcttttcccagatgtgcattcatgtgacgttctcatgcggaaagtttgggaggagcttcaatatttatgcttacatattcaagtgtttgactttctctgtttgctcatgttttcaaaaccttgaatcattgaagatcaaatctatatctatactctggtgcaaagattatgttcaataatataatttatccaacagcagtgcttgggcttaccctgagcagaatatccctactttcaaatagtagtatgcgttggaagtttgagttacatttttctcgaacaccagttcaagttacatgacaccattgattgagaagatcatgtgcacagatgttgctaagcttacaaactgcctaattgaattgctcatgaattcttgtttgtacaatttcataaatgcataaggggaataaataaaaacattctctaaaaagaaatggctacgtgaagcaccatttgctagaactgaaacctgttgaccatagtatttgtactcttaggcttgtagcctgctaatttactcacggcttcagatctcgatattagctaatactccgtattacttaagtacttccttctatacgttttcatataaactttctttactctccatttgcaatcaacttagtgtgattttttttaaaacccgtacagctaaaaaaatgaagaaaaatagcacactgtatatttcttttcttcactagactactggagtacaacaatcggagtatccgatccacagtaattcaccaccgaaatggtagtgttttaggtgcaattttcttcgttggtgcaggttgcacaatggtattaactttagccaattgcggttgttatgcttgtggcctgatacttgacgaattggttaagttaaaaatatgttacttcttttattgtattgggcaccaggattattacatcttcatttttacttgtctgcagttgagacttctgattgatggctcctgagtcctgaggagaccaaggaggcgaggacgcaagtaactgcattatttatgttcaacagtccaatttccaggcttccagctacacccctgtaaatgtatcgttctagttctagatctgtttgtacaatgaagtcgtaggtacctccaagaaggtagtatcaatttaggcaattgactctgcatcaatgacttaatgtgtattatgctgctaagctaagttatcgggctgcagga

SEQ ID NO: 16039 - DNA, 12386 bp, Oryza sativa
tttaacgagtgggctagagtccttactggggctatttagatatgtgaccacataaggaaaaagtcaacttttcatcccaactcctaaaaccagggtaagtcacctgataattttaagatgggtttgtttgacgtggtacatacggggcttggtttgactaagtctttattttacgtgggccctatgcggcaatagggagcgaaatagaatttaacccatatatggggcccccttctaatgatgctgccgctggtatttgtcaggtccgctatcctcgctggccctaaagagagaaagggtatagagaggagccacatttcatgtgggcccattatattttattattattaataatgtgtgactgacatatggatccccttgatattttttattgtagttttggatagtattttttatcaaagttttcacataaagctaggtatgtttacctcttcagcactttggatcaccttctccatctctttcttctccacctccagctccaccctctcccactggagcttgattgataaggcaccggcaagctcctcttcccccacaccagtgaactcctcctcagttcggacgagattcaccgtctagttagaatgaagcaggggcaaaagaggtggaggtggtggtgatgggagagccggaggtggagaagagagagatgaaagggtggtccatagtgcaaaataggtacacatatctagtcttatgtgaaaactttggattgggggcaattcactctatttttttttcctctaatgccaagtacacaccaaggggcaaagactaatcaatacaccacatgtatgctatgtaggatgaaaacattgtttaaaccgtctagtgattctatatgtactgattttggtaattaggggatgccatatagcccgttttataattaagagacgcaaataaaacttgatctgtaggtgagggatataaagcacaccttttcctccacagaaagttccaaagacaactagactacattcaatccgatagtagtgctttctatacatcgtcaggttgtagtgagaaacataatcctagcttgcttaagggtttatcaaaagcttgactctacataaactagcaaacaattggagaatggagaatgcgcactattgctaaagagtgccatttttccttactaggagcctgtgacgacatttttcattttacaaacttcctaagagccaactgcaggctccaaatcatctatagctaatctaatagtccattcatacaatagttaactataaaaatataatacaccattaatacctggtcccacctctcatacacacataacgctttggagtctgtgttacagttggctataaatctacagctcggtttcttctctttcttctcttttcttctcgattagtgaaattttcaccattcccaacataatgagcttgagccgcacggtctatatataggtgcttttatcgtgctatttagaggacggtcggactatcttttttttagctaagttgaaagcaaattttaaattttattagaattagttatggaattaatttaagtattttctcgttttattcgttgcttatttttcctgcatagctaagtcgtccttagaaaaaacgaaagcatgcattactcttttctttttctttttcattgtttttcagtatttacttttacatctataagaacacgtatataaaagttttattcacaaattatttttcatttgcaaatatgccgtttggcttattccgcagataagccaaatgatggggctcataatacaccctacggcctatgtacctttttaataggcgatggccgatggggcggatggggagttcccatcttgctattctacccactaccgggatctcgtcccagactacgggcatgtttggaggtgcttctagctgctgcaacttctctcataatctctagctccccaaacaattcagattgtcacccagattataagaatatatagttatagaatccagaaaataaactagaatccagaaactgaaaaacccagcttctccaaattcgcagaagctgactcataatcttaagcttcttaagctcctccaaagagggcatacgccagtgccaggccaccgaacgaaatgatcccacgaccgtgccgagacaaccgctaattttcttccctggacccaccgcgtgcggcaacccacgctccaccaccacagcggggctctacccgagaggctgtgcccatcggcacgccaaccccgtcaccccgttgacacgcgcgcagcacacacatcccccttttccgcggccagccaagctagccccagcggcgcaagccaacacgtacgcctgcggcctgcctctgcctctgcctcgctcggcagggtcgctggcaccgggcagcgcagcgcagcgcacgccgcatagcgccaaccgcccgagcggcccaccccccacacccgcccggcgcgcggcacgcgcagaccagcagtgcatgcgcatgacgaaacgtttcaccgcagcgtcgccgaccgcaccgggcaagtacgctggaccatgcatgcacgcacaggcacggagtgagaataaattcaagggatatataaaaaaggcccagcgtgacagcgcccacgtccttcggtgagacagattgcagcttgaattttgccatggtagatcgatcgatcgaaaaaagaatttgcattacttaaaatggccagttaaattacctcccctctacccgaaaactgaaactttttatctggtacgtatttctcgatcttacacaaaaatactcctatgtatacgcttcccggaccaatacggcttcattcccatttcctctcccctccagccatgccctcctctttcgcgtgcgtgcgagcaggcgtcacgatcggtggatacaccaggctgctctgaggtgatcaacgtggacacggggcctgcaaccgagaagaatgttcttgtcaattgtcaaggagatatgattgagttgtactattgatatacagggactgcaaaaagaaaaaaaggtttgcttgcttcaagttttcaacacagcattataggataacacaagcactgaaataggccacacaagtacactgaggcagctctgaagttatactattactgatgaaacaaacacatgcacacggccaagaagttcaggccaattgcatgcatgcatgctgcaaattgcaaaaccgactaatgagtagataacctgcttacctacaggactacattcacattttaccattttaccgaggactcgtgtgtttgaattacaattaaagtataaattttgtctaaacacaatttacagatgaaaatgaatgtactacatctttgatcctttgtagattgtatgggagccagggtttcacttatcgcacgataatcgcgcgacaaaaatcatggatgtagttcttgatttgtaattgccaatggtgaagaatttttttgaaatagagtaagctaaattcaaatttgagggcacaggcaaaaatagtttacaaattggaaaaaagaagagaatattgggctacatattcttccaattattctcaatttatagttttgtacacatattcaaccgtattgttgattttttttccctatttattttacatttacatgattttagctacacagcccgcgataaccgtgcgaatatcgcggtaaaccgtgcgattatcgcggtgaaaccgtgataccggtgagttttgaattcgaatttttggatgtgatttttgtgcgattttaggtgattatcgcgctatcgcggggtggcgataaccccggcccaaacgataaggtaaacctgatgggagcacggattactgcctgagcaaagaaattacggagctagaaaactgttttcatgcatcaacaacaaaagcaatcacatgttgcatttattttaacataaacaaatatcttctctagcaagtactatcaaatacaaaaaaagtaaagacgaaatttgtagatctcaaaaaataaggggcgttttggtttgataccaaaatattgtcataccaattttttggtggtttaaatagcaaatgtgatgatttgatttgaagccaaatgtttggtaatgccaatactcaatttggcacaattctaaaatattcttcaccacaatttaaaatttggttctcaattggcataaatccaaatgcactcatttacaattttaccctaccaaagtattagtagtgccaaaacttggctagagtttggcactaccaacatattggtagagtactaaaccaaacaagccctaaatgcagacaaacatggcattctttttgttaatatcttatttataaatcacctggggctcttagcaaaagccaaaaattagaaaaagaaactaagggcaaaaattgattgcttataagaaagttggtgacacctgtacaaacatggaggcccataaatagagcatgcagatcacgtacacgaaaaaaaagtaaaaagacaattggttgacatcaggaccaaaagggtccacacaaacctgcaagtttgtactgctgtcatccaattcaatgctagatactacatccgtcccaaaataagtgcagttttacactgttcacgtccaacgtttgatcgctcgtcttattgaatttttctatgattagtatttttgttgttagtagatgataaaatataaatagtattttatgtgtaactaacttttttaaattttttcataattttttcaaataatacggatggtcaaaccttcgacacggattcctacggctgcacttattttgggagggaggtagtaccaaacaaaaatgatggacataagcaatggcagattggcatgttctggacttttgcattgagacatgcaaacaatttcagaattgttaacgaagtttgtagtttgtaccactgaaattaaatttataaagaacacatttgtgatgtggagagtggtttaatgggttctaaacataaccaatagaattgcaagagtatagagtgaccctataaactgatcagtgacagtgcccacatactttactccgcagtagaagtaatgggagttgatcatcaaaccagtgggccaaaagagaaaacaattactctatgttaaagctattcaaaactgtagcacttgtcttagaattgcatcaaattatgcaggcattcaggatcaaccacccaaaagcttaccttggcatgggacaataacattcattagcagacattactaatcaactgcttaagatgacctacagaacagtattcagttttcaaggataaaccagtcatctttaaataaaaatgaagcacctcttcagggcatattactgatgaaagccattatatagttattctagaatcacgacctaactctcccaagattcggcatctaatctaagacaattgtttaacaaagtaccgaagcttttctcatcttttgagagaaagaaaagtaacatgaagcatgatatctacttaaaaaatcatagccacgagatcagggcatcaggcacttatttgggcgcacaatgaacacgcagtagttatgggatggcaggcagctcacccataaaatctatgaagtactagtgccggcccaaccaaatctacgtccaccaaaccgcaactatgggattaccattggactattgaagcctgatcaaagatgataaatactaaatagtacgtagtcatcaccttaaaatatactactagctcacgttatgaaaaattactcacaaattaactggatctaagtatctagcagcctagtagccagatatatataactcttgtctaatgtagtatttcttaaaaccattctggaaaaggcaaatttggccctctgcatggccatgtagtagcaaaaacaccattcattttgcgtgcatatatcatatatgtaccacgagtccataactagcttagtagatttgttgtagaccagtgaccgtagcttaaagccttaaaccttgaaaacaagaacaatcgaccatgattttgtattgcctcctacacaacctgaaccttgaaagaaaaactatctagcaccatgcctttgcagaactcttactacctagctcttactacctctatctctcaaagaaaacttcttgttacctcacaccatgaacaactcaacaaactttaagaacagcaaaagagcaagaaaccgagtgcaatgcggtagcatgggaatcaatcaagcagctgctcaccttcccctccgagtccacctcgcgctccttaggaggccatggaggccttggggaagcctggccgaccccatccgcggccatttactcggttggccctcgacgtcctcccgcttgcttgagctgtgtgtgtgagctgagagaagctagggagcaagcaaggaaggaaggcctatgtgtctccgaaaggaaggggaagctgagagttaaaaccaagcaaagaaaagggcagtctactcttgtgctgggctcggagagagagagagagagagagagagagagagagagagagaagggagcgtgcagtgtgcagaggcagcaggggcaaaaggaaaggagggagcaaatgagcaatggctgtcagctattttttctgcttttttctcgagtccgcacagcgctcgctgctcatagtcactgccaccgcaacgcgtgcccccacacacatccgcatactagtctacagttcatctctcatctccattttcttttttttcctcaactcccttctctcactgcaagtgggccacggcacatgttaggacttcggaccacctgccagtcaccgagggttttctgttaagcacttaggccatgttcaacgctccacgctttagcgtggtctgaccgctcccgaggggaatcttcaatcgggaccgcaccctcgcctagcgccgcgactctctgcagagcgtcgggtgatttcggcagcttttcggcgaggaatgggcgaggagccgcgttgggggagaggtgtcgccccgcgccgttgctactcccgcgctaggaagaagatggagagagggtcgactggagagaagggaagaagatgcgtcaatcccagccgctgccgcgtcgatccgcggccgcgggcgtcgatctaccgcctttgcctccatccggtgccgtggcgcctcgatccgccaccaccgcggcttcatccgcacctgtcgctgctcgatccgccgtctccgccttcatccggcgccgccgcgcctcgatccaccgccgccacctccatccgttgccgccaccgcgcgatccgccacttccgcctcgatccggtgccaccgccgctcgatccgccgcctccgcctcgatccggcggtggggagagaggcgccgccgccagagaggggaggagatgcggcggtggcgaagggagagtcggagagggaggagacgccagggagagaggactcaggaggggttgatgtatatatatctttgtgatttttagtgggtatactgcaaatattggatgtatatgcaaataataataatctaagggtttaaatgtaaaatgtaacggactgataggtgctaaaacgcaaaaatactatgggggtatggcttgcactatgtgaggtatatccctaactggatgcttggtcacttttgctcatgtggatagtggaggtgcaccctgcattgggcatgctcttaagccccgtttggaaacggaaacaagctgattcacgtaaaaagatttgtacgaaaattccgtaatagttataacatttcaaacggtactcgcagtgactttttcatcctctggtaacagtagctaacaagggagtggatggtgagaattccatttcaccctggcatgggaattcctcgagctacgtgtgacctgatactgcatcgccgttcaaggctcgcagtgatcgacattttcctccccgtgcttttcagagttttaccgcggcaccgccggccttgccgaatatatgctctgctgctggcctgaagaaaggcttcatcatgcgcatgcatcgtctatcggctagctggctggccctgtggaagcgagtgatttctctccccgtctcggcctcgggtatgggttaatatcggcggcgtcgcgcgtgcgtgcgtgccgtgcatgcgatgcgatgcgacatcgtctttttattcgcggcgcggcgcgcggcttctctcacttctgtcgcgggcagcggcagcagggtttggctggcgcctctgctctcctgctcgttcgcctgctgcttttgctcgcttttatcgtgtgtctcaggaaacgggaaagtggcgggtcgggggactgggccgcggagggggaggaattcagagaggactgtgccggagcgaggtggcggcccgaatcccaagagattggcaaagatctggaggtgctttgtttaatgtacaaaaacgactctagtagcagcagtaatggctactactagctactagctaggttaccccttggggttccagtatccttccaggacaattaagccaaggctatctttagatctaaagtttggatccaaacttcagttcttttccatccatcaacctgtcatatacacataacttttcagtcacaccatctccaatttcaaccaaaatctaaattttacgctgaactaaacacagcccaaatcaatgttgttttgcagtgtgtctaggcaatgccacggttagagtaagaactaaggataattaatactcaaactatatggagtattacttatgtgaaagtgaatggggagcgtatcttatgtactcattcccttgcatgtacacaccatatacaccaactaaaaatcataaaaaaaatatagaaaaattcatatatatatatatatttttccaatagtattgcatctacgtgcaaagtcacatattcaaattcattctacgtagagagtaaaaaaaagataaaattctaacagaattacaaccttagaactgtcagattttttttcagctaaaatataataaatttgaggttaaaatttataccaaggtgtaatactattgaaagtacatgtatgattttttctagatctttttatgacatttattagttggtgtgcacgtgcgtacacgtgtgcgtaggatatgttgctaagaggaagataaagaaaaagattagtgttagctctcatgcaagagctagttcatgcttcaaaaatatgcattaaatttatagtgagatagagagaggaaaaaatatagagctaaattattatcctataatagatttatacttctttgtgtcctaaaatataagagattttgggtggatgtgatatatattatagtattacgaatctggttaataatcttgttagtattagaattgtcacattcacctaaaatcttttagattttgggacggtaggagttgtaagtagtaagctttactaataaaagcttagtcttagggctttgccttttccgctgttgtttacagaggactgggcaccgatagaggagttgggtttgtttttgttaggttgtgggctggctctatttcctgctgggccgtactgatatactagttgctgggacttggagaatccattcaaatcacgactcgatcttactcaagtgaagtcattttcgtttcagcaatgattcccggggtatcaaaagcctatccaaactccaaaggcttgaaaacaaaacttagatctgacaaaagctgaagactcgatcaaactgtataccccacattcagttccgtttacactaatatatattacagtatttagtttagttggaatcagtatggtaatgtacatatgggatagtttaagagcaggtacgatgagtacaacatctacttctggagataagagcaagtatagtaagacctagtcagtaggctgaaccatttcccacgtcatcaaaatcctatatggcggagtgagaagagaagagagagaacggagcgggcggtcccgctatcgctcggctgaagcgtagtatacgagagaaaaacgcccgcttccagcccgatgagagcaggtataatagcaggctataagccagctataaatatattttaaagagataaaggaagagagggaagagcagcgggctacagatctgtagtcagctgcggcacggactccaagacgtaatgtgtgtatgacaggtaggaccaggtattaatagtatagtaagcaactattatataaattggctattacattggctatagatgatttggagctagtagttggctatactattaaacttgctctgagagcgctaagccgccgcttcgttcctctccctccgatcccgtgcatctctgccgccgcccccaacctcacttcctccgcgcgccaaatccccccacctcctactaaaatcgagtcctcccgctcaaatctgcaataaaaccctcccaaatccactcccatgccaccaaattcgtccccaaatcgcctactctcaaaccctagaccctaaatttgtcctcaaacctcatcaagatgaggcagcaatacaaaaggacgcttgcgccggcgtctctggaggtccctccgccagcgactttgcctgtcacgccggtggcgactcagcccttgacaccaccgccacctcagttcgtccttgccgccgtcctttttttccacctacatacctgatggctggttccccgcagtaacaccgcaatccattgtgacctcctcctcaccatgcttgctcgctgggttacgacaaccaggcatagtgagttcgtcggctcaaggccctgcattagtgcctctgcatatcctgccccaagtgctgagaatgccgagaatcccaatgttcaagcacgatatgatctagcccttaccgtctttatttttcttagtttgttaatcctgctcgaagtgtatgtatgattttgttgtgatatgtcctattgatctgttcaaggcttcacgtccatacatgtcaaactcaattcactgaatagctcctgttgtgtcatttatttagggggtatatggatcagattagctcccaaatccatcggatcatgctgacaatgctgcttgaaaacaatggtacctgggtataaagatgaacatgttgcttgaacatatgtggtatgcatgttactcgaaattaattaattatatgtttctatgtttgttatcaatatgatatcaatatgattgttatttcaagtgtgatatcaatatgattgttatttcataaatcttgatatattttcctgttataatcaccatgaaatgaatattttgtacccgtgttgtttcattcttttggtgactgtacgtatggctgagcatacttgtattttgtttgatgaaatagccacaaagatatagccacagcatatcatgtgcacatgcaggcacatgttaactaatagccaaacatacagccagtctattatataagtgaacttttaagtggaggttttagatgacatggtataagagcaggtacaatagcacactattagctagctgtaaatatattttaatgagataaaaggtgagagagaagaacagcaggctacagcgcggactccaagacgcaatgtgtgtattaatatctggtcccacctgtcatacacactttgtgttttggagtccgtgccgtagccggctacaaatctgtagcacactactcttctctctcctattttatccgcttaaaatatgtttatagctggtttatagtctgctattgtacctgctctcatacgccttcgtacgtcggttacagcgggatgagatccatgagagagagagcagcgtgggaggagtaggttcagtacggtatcgaggaatacccatattcatagagatcgagtgtcgtgattacatcatcagcaagttccgcgaggactttcccaccacctcaccttaaccgaggtccgcaaaggcgcttgttgatgaagtcacgctccttcagagcaagtataatagtaggctataagccggctaaatgctgatatggaggagagagaggagaagcgggctgtaaatttataaccggcttggacataagaaccaagaaactctatgagagagataagtgggtcatgtattaattataaagagctaactattattatatgggtagactaagagaagactataaagaaccttatagccaacagattggctgtattattagccttgctctcaaaaattgttcgccttcctcgactcatccggcctcagcaacttcttcgctccagcggcaaacgaaggcagaggacatcatggaggtgcatccgtgcatatagggctattgatgccgtgggtgtgggaatcatacccatgaatgagaggaaagcttatgggcctgttcactctgatgtcattttcaatcttactaaattttggggctgcagga

SEQ ID NO: 16040 - DNA, 1111 bp, Oryza sativa
tactggcgtggtaccaatagtatcagatatggtactcagctgatatatcatacctccaaaacgagacaccgtgcaatatagcaacccgtaagttttatgagtataaagtttctataaaaaggaaagcagtgacactgtgtgcgtacaaaatgaaacgcgaaagggcgttcggttgatcaccgtgcgcgtgcacgtatgtgtgcatgcatctcaacacgtacacagtgcacacacgttaatatctactcctcgttcaggtgtacatgccggaaggttttccaaacctcaacatatcccatactacctgtctgacctgtcagcccagttaatgcacagagcaggcggtggaatacgtcgagcagccatgggccttgctgatcacttgaccggacccaatgcggcgggctccgtccacggggcgccggtggagcagacggcctgcgcccgcctacaaccccagctgggccaccactacagggcgccggcttctgctgatgctgaggcgggtaacgcccctgcggcgacggcggcgtgcgcgccggccggcgcaacgccgcgtccggcggcgatccttgggcagcttcgtcgtcctcaccgtcactactgcttccgtttaggtccaagtagtccaccataacctgcgtggtttcctctactgtgactgtggtaagtacagggagattttcataatcttgatcacctagagaacgggaaaccaaactgtcagtcttgtgagaaagtatagtagtgctatatgtagtgtcgaaataagacggccagagaagtgtaagtaccactagcaagtggtcgagcttcgaggagtaatggaatggccagaacgaacacgagagcaagattgaaagcaaccggtaaacacttcatggcctaagaggctaagaatatactattctctgcagcggctagaacgatctagtaaggcagctcgactcaaactctctgtgcccagctcgatcagaagcacgcttatatataactggcctctgacgcctctccccgaagggcaaaagtcccgatcgccgattcccactcaagatgccatcaacaaccctgtgaaacgaagcagagaagaagcgcattttgtgcatgcgcg

SEQ ID NO: 16041 - DNA, 3220 bp, Oryza sativa
caaaatttgggcttttaatagtttttcttaaggcgttctgctcaggcgacaacagaagtgggcgactacctgccggggagtacgaagtagtacagtgtagtagagcctggccttatggccatgtgtccacatgcatgcttgctttgtaggagtattaatcaaaccaccgcgtggttgtggttgtcttcatgcactgtgtacgtcagacaaaaggaataatcgaaacacccccattgtctcgcttgggaaccttcttttcccttttctgactattgactccacacaaaaaaaaaaccatttctgcatgcatatcacgcacgattgagatgcgcgtagctaaacggcgattgctgggtagttactacattttttctaagacaatggaattgaatattccggttttttttcagcgagctacagtcaattattacaatgtaacaaacaagtgaaactcataaaaataaaaaaagacaccaatcatgaaaaaaaagcaaactaaagactaccaatccaagataaggagtatacaattattgaattttatttgtgaatctccatccaaaattggtaaacagttgtataaccgttgtctcgagattacgacatgcaacttttaaaaactcgccctcttcatcacccttttgtagctgtgcggttctaagccaatatgttgtctaaaaaatacctgcatatataaaataatggtgatttgtcaaacatcatgtcattcatactcaaccaatagaacctaacataaacagatatttctataagaataagttttctatttttcttttccggtagttcctacatgccccctccgttccatattattaaatgttttgggtgtgtcatgtgtatttttcttaattaagcttagacaatcgtcgtagcaatatctatagcaccaacttagcttatttgaatcaaccgacgaatttatttttatagtacatttgttttatgttaaaaaccatattacatttttctataatgtaatcaaacttcttaacatacacggagatagctgtatggtgcttacgctttactttattgaagaaaaaaagagtcatgctgtgcgttatatagattgtacaacccacgtacaatcataccgtatccaccaatcatcggttaggcttatctgcaggtgggctcgggcaagcagcaactgtgtttgtgcatgtagtactgatcggatgtaagtactccagtacatatggatcaaatgtatagctatttctaaaaataaaatctacgcagttataaatcacttaccagataattactgacaaggatcaatctttttttttcttaccaaaccactgaaaaaatcccccgcagtaaaaaaactttattaatgaaaggaaaaaaaatacaataaaattatccaagtttataatacatcattttctacattatttcatctatgaagaaaaaagagtatatccttttttaaaaagagttctcaaagaacggaggggccagtcttaaacaccccccccccccacccaaaaacaacatatgtttcaaggtttgaattatttatttgtttgtttgacttaaaaatatgtgttttataaaagtatagaagtatactcctcctgcctttaagaggatggtttttaaaaattaccctactaaaggaaagggaagggctcatatttaatttttaatttggatttagttcctcaccgccggttttcattgctagaaaaacttgtaatgcttacttgaggttttcattggaggtcatttgaaatatagatatgtatgagattctattttaaaaaattgatttgagattttctaacgaatatttagcccctagataatcttaaatgaaaaggttgtcaactttaaggtacagaactcgtcgagatctacaagttttatataagtttgatttcaaatgaagtctacaaattgtaaaagtacggagatgataaacaatacgggaaaaattgcttttactaccttcccatcctcagaggaggatgggaaataagcttaaagggaaatatcacatagtaaagtgggaagacatggcatttcctaaagattttagtggcctgggtttcacagaaacaaggaaaatgaacattgctctcctggccaaatggatcataaagattgaatcagatgataagagcttgtgtattgagttgttaaggaggaaatatctagtccatggaggtttctttcaacacaagggtggaaatgtgtcccaattttggagaggtcttcttaatatcaagaggtggatgagttttggctctgaatgggttttgggtaatggtgagagtatcagcttctggcaggatgtctggtggggcacctgtcctttaaaaactcttttccctgctatctttaggatctgtaatcagcaagagctgttactcagccatctcaatcaggagggtcctgactgccttacattcaggagatcctttggcccggaagaaatcctagagtggggagacctgaaagaaattatcgaacaaattgaggtttctgattcacatgataagttggtgtgggacgaggaaggtgaggcaggagagcaacgggccgggaaagttcaagttggtcctcggcgtcgacacggatgccgacggccgccacccctaccgctgccagtcggatgcctcaaggtgcgcacgacacctgggctcgctgtcggtgccgctgctgagttggttgctgatatgtggggcccgtgtggttccaacgttgacttagcatagctgaccgagtacacgtcaaacaaaactaggaaacatattgtcttgggataaaagttgacacggttttgtgagttaagagatgagctatacctggtatcgtggtttaggaacaaatttcagactaagcaacaacttaatggacctaaagtgaacttagaaaacagcgtggaatacaatgaggccacatgcggcctattgggccactggctacaaggcaggcttaagcatactgtctgttcaggcttggaaaaagtacacccaaggtccctcaacttgtaatcgagttacaaaattgtcccccaccacaaaaccaaatttctggcgtcccttaactaatcaattggttctttagtggttttcaccccggttttatccccacatgtcagcctgccacgtcatctctctttcccttccctcctctctctctcactcttctcttcctcctcggttcctcctcctctctctctctctct

SEQ ID NO: 16042 - DNA, 1122 bp, Oryza sativa
ggcccgcgacgccggtgggggaagtgacagggggcggcgcggcgaacgtgccggaagtcgttgttgcaaccgcgagcctctcctggtgcgcgcgccaccaccgcaagtcgttgttgcaaccgcgagcctcgctcggatcctcctcctcctcctcgacatggtcagcgagcaaacgccggtggcgaccgccgaggcggagctggtgagcagcgccgcggtgcccgtcaaacccgaggaggccgcggcgaaggcgcagccggaggacgatgctcccatcgtcgaggacgccaaggatgatgacgacggcgatgaagacgacgatgacgatggggatgaggatgaacacggtaacactcttcctccttcgcggtttcgtcttcgttaatattgcgatctgtccatgtgaaaggcagcgtgcagtagttttactgattagaaacgtgtcagtgcatcgtggtgtttggatttcgttaacggttttaccttcggttcttgtagcaattactaatagctagatttatagcctgatttgccgtttttgatgaccttgaattgaaggtgagcacggtgcagttgtaaacaagggctccaagcagagcaggagcgagaagaagagccgcaaggccatgatgaagctcggaatgaaacccgtcacgggagtcagcaggattaccatcgagagagccaagaatgtaagaaactgtacagctgctgcaaacaatttattcattcgaatggaagacagagttaatgtttctctgaatcccgtgtgtttcagatactgttcgtggtgtccaaacctcatgacgtcttcaagagcccgacgtcggagtcgtacgtcatattcggggaggccaagatcgaggacctgagctcccagctgcaggcgcaggcagcgcagcagttcaggatgcaagatctgagcaaggtgatgtccaagccggacgcggcggcagcagcgccggccgacgaggagcaagaggtggacgagacagggatagagccccgcgacatcgacgtcgtcatgacgcaggcctcgtcgtcgtcgccgccgccgtatcgtcgccatcgccgtcaccgtgtcatccgccgtcgtgtcgttgtcgcgtgtccttccgtgtc

SEQ ID NO: 16043 - DNA, 12359 bp, Oryza sativa
aatttcggagttgctagaaatatagcgctatatgctacagtcgattttttttagccacttacacagtagttacacctcatttacaccccacttacatatgtatagtatgtaattttcgaatttatatatgtaattttagtacttacatatgtaattttgagacttacattgtaaatacactaaaattacatatgtaatttaggaacttacaatgtaaatacatgccgattattttttgatgaaaaatatggcaccgtaaatatagctacacccacaattttgtaactccataacaagttgagggaccttcggtgtactttttcctccaggcttcagatgcacatagactagttgggctactagacgattacaagtctctcaagcccaagttttaatcatcccaaaaaagggtccaagctttcacagtggcgctggatccacatatccatcaggctaagggactagctatccatcacacgacagatttttgggtccaaatcacacagattttagattagttggattaggctcatttgatcacttgattagaagagtctatacatgtatcaacatatattaattatatatattgcatatattttatttgttagatctttacattgaaaaaaatatatcaccaacccatctactaaaagttacagtgtaattacactatagttacagtgtaatttcactatagttacagtgtaactatagtgtaattacagtgcacttacatgtcatatcaactaaacttacaaatataattttagttatataggattgtaattttatattttaaaggaaataacaagtacatatttacttacacaacatttttaccaaaattatagtgcacttacatgtcatatcaactgaatttacgaatgtaattttagttatataggactgtaactttatattttatttcttcaatctcttcacctagctgcaacgacgtgcaatgtatgtactcatcaattatgtgccaagctagatgttgctggcctcatgcgtgcgtgggaaggaaacgcatcacagccgctaattaaatcatgcacagactaatccacaagggaagtaaatccgagtgatttcgtgccaaaaatttgtcgccagatttttagcaaaatcgtcaggctaatagcccgtaatatgataggcttttccgctagcgtttgttttctctgagtgtccagtgtagtttgctttggactctgaccatctcttttcagggcattgggattctttgagttgcataattggaagcttgcttttacttaagcaccacccagttccccaatctttcaacagaacaagtagcattttggaggttatcagtgtcatcaagtaaactgaagtcccttttctaccacaagtttcagaaaagctataatgcctgctggaaaggaaggaacataagattacatgttgactctacacatttggtgattatctatgtgagaggcttcaactactactaatccctagctgataactccaaatctttcctcgcctcacagggaataagaacaccgtatcaggatcaggccggcactagctgcactgcttttgattttgaacgctcgaaaggagaacagtgagccactggcagaacggcgtagcctcaccgtctgtaggcagcaactagttgccgcggtctagttgtagccttgtaggccacaagcgagctcgttgcggccgacaccggacagtgacttgactcaggaggcaataactccttcagctcaaccaaaggtggctggctgatgaactgcccgattttgaagggttcagttcaagttcctcctacttcccagccaagctgccttatccaattagccggcaggtgatgactgtcaagccagttgcattaagttatagcagacgtcctggagtgtgatggagttaggtcgaggcgatatttctattgcaagtagctcacaaggacgaatgaacgaacgaaaactaatgaaccataactgatagctccaagtctccaagttgtcaattcttgttttcaagacataaaattaagtagcttgacatcggccaccgccggtcgatacatgtcaatatccattagtatttatattcaggcattgactaagttaatgttatcttttcctttgtctctttttcttctttattattacacgttgacttccgctttacattaagtaatttacagccattggcggtgtcaacgcctcgctgatgatttagggaagctcaaggccatctttgcgtcttgcaggatacgaaaatatattttttgcaaagaggagacgctgtgcgtttccttttctttcgacctgactcgaaagcaaagtgttcgagttgcctttagcaaggttcagtataagaaagcaaaagaataattcgtaatcgatcctgcggtcaaaacgaaactggggctttcccccttttttatattacttgcaaaccttgaatgtaacctggcttatgttgattatgaaaaggagaaaccctatggggatttctcaaactgattaaaacgcttgctcgcagtacaaaccgaagtcttgtatcattttgtatttaacaattagtttcttgtgagataaacattgacacagtgcatttgtcttgtatgtaagctttgttttgtctctttacagctgctgggaacgattgctagatggtgggtgcaacgtcattccacacaggccggattctttattgtgatactttgatagcgtgggaatacttgggagttatgcctctggagtcgactccagctccctcttatctcacaggttcagagcacctgtggcatctgtgtactacatcacttccgtttattttccaatttgatcagatctaagacatacaactgacctcgtgcattgtttgtcaacctcctaacattcatgttgatggatattgatagccaaaaagcaaaaactcataaattcttccttgtaaatatagataagaccaagtaagagatagtataacaatggttgacctacttcatatttgggagctggttcaaccagaaggagctgttcttacttttttggcagactccagtagaatactgtagctagctagaatcggagctctggaagaacgggttattgtaatcatgcccagttaatgtaatcatagggtggtgaggctactcaattactagtagtacctcaagtgtagtccgtaccaaacatttgacttgctcgcattgctggtatgtgttgacttgggccgtggaccattgaatcgaacgtcgagttcggcgtcgcagcaaagcgatcgagcccctctgtctctctctctctctctctcgcagatctccagacgttcggtagttcggttcatgtgcacattgcacaagccgccttgaaaaacgcagctccctgcctcccttcaacgcgtttgcaacgtgcaggcaggcaggatctacgacgttgtgccgcaccgacgggtgtggtttggggccaacccgagatcggctcatgcagtcgcgcgctcgccgaatcaaacccggcgtccggctcgaccgggttcgcgttcgtcggcgagcttttagcttctgttgttgtctctcgtctggctcctgtgcgttcgcgaccgcgcatcaatcataccgagcaggcgcgcgtgccgcccgccggtttggcggcgaggcgggatgcgtgacgagtttttgccagttcgagcggcgctgggacgcacgcgcgcgcgggcgcggcgtgctgcgctctccgacgacgaggaggcccaccaggccaccaccaccttgtatgttgggggggcacgagaccgcaagagggaatgaaccgtgaacgtacgatgcaaaagcgagcggacaaggcggcattgcggccaggcatctcgtgctcgctgtgcggaatggaagcggaatggaaggggatgatgcatccgatctgacgcataccccaactgctagtgcactgcagtgcagggcagtgcagcgcagcgcagcgcgttgctgcatgccaggtcggtctggccctctggcccatttggccgccgacctctcccaaaaaatatgcaggcatccacctgcacgaaactgcgaggtccgattcctttattggtcggagacaagagagtgttgccagttccccccaccgattaatcccaagagcaatccggatgaacaagcaagccacagcaggtaactaggtaagctgtggcgtctaagttctaactgtaacactcagatagctggctgcttgctagtaggtgaatgcaccaactcctgaacggaattggtcacattcggaggaagagggacctgaatggccgaatacctgatctataatctgaacttgacccaaatttgatcccaccaaagtcgttacaggatttttctcaggatgttgttgggccaaagtacaaccgtagaagtcatgtactaccttacctgctcgtccgggtgggtttggtggagcaaactgccgcttaccccgaactaccataattctgttgcagactcacaaagccacaatgtcaaaccatcaggcagcagccatttatgtcccttcccccacaaaaaagacccctttaggcgcatgcgttgacccccccccccccccccgggacctggcatgtttatattgcgttgagctatagtgccttccaatgtcagccgaatcaccaaacacttggcccgctagactttgctttcgctgcgctctctctctctctcaccgtgtacgaccgacgacgggggaagaggttgttcggcaaagccgttgtacgtccaatcttgactggtgccgcggcaccgctgattaattgggcacaaccgatgaactaaaaacgggatcgcacaatcttggcccgtgctgcaaaggcgattagattagcgagcaccgcacacccgaacgccaaattttgatagctaagctcgtgtttcataccgtgatacggcacggagtactgctattttggctcttaactaatgctagctctacgcacgacctatacgactctgcagaaattaacatcttgaccgttttctaatttctaatcgtcaatttggataacacactagcacagtagcaacatctcgtgtttctcgttcacaggcacctgagaaacgcataaatgcagcgttttcccactgcaaaggcaaggaggccgtccgttgatgagccggtcgttaattagccgcgcgttcccacccacacacacacgcgaacacgcgcagtccagtagccgcgcgtgcccacgacgcaccacccacacacactttctgcccccgcccatcgccaagttgagcatccacgcacaccaaacaccttgcacatttcctaatcttaacacccccacccaattaacgccaagtcgtcttctccttcgccttcccctctccaccctttgtatataaacgcacacaagcgctcggaaagccaactcagaccgaacaaaaggatcaccagctcagagctcaccaccaccaccaccaacaacaacaacaacgcattgcaaagcaaggagaaatccgaagtccaacaacacccacaagaaaagagaagaagcggggaatggcgatcgccgtgagcgggcgctggacgcggctgcggacgctgggccgtggcgcgtcgggcgccgtggtgtcgctggcggaggacggcgcgtcgggggagctgttcgcggtcaagaccgcggccgcggcggaggcggcgatgctgaggagggagcgggggatgatgtctgggctgtcctcgccacacgtcgtgccctgcatcggcggcggcgatggccccgacgggtcatacaatctcttccttgagttcgcccccgggggatcgctcgccaacgaggttgccagggatgggggacgcctcgaggagcgcgcgatcagggtgtacgcggcggatgtcctgcgcgggctgacgtacctccacgggatgtcgctcgtacacggggatgtcaaggcggacaacatagtgatcggtgtcgacgggctcgccaagctcgccgacttcgggtgtgcgaaaaccatggattcggagcggccggtcagcggcacacctgcgttcatggcgccggaggttgcccgcggggaggagcaggggccagcggcagacgtttgggctcttggctgcacggtcatcgagatggccaccgggcgcgcgccgtggagcgacatggacgacgtcctcgccgccgtccaccggattgggtacacggacgccgtgccggaggtgccggtttggctgtccgcagaggcgaaggacttcttggccatgtgttttgcgagaaacgccggcgaccggagcaccgcggcacagctcttggagcatccgttcgtggcattcgcctgccacgaagtcaaggccgcgcagccgaagcccaggtgggtctctccgaagagcacactggacgccgcattctgggagtcggagaccgacgacgaggaggaggtcgacgagataacagagagcctctgcgataggatcaagtcattggcgtgccctgtttcggccttgccggattgggactccgacgaaggctggatcgatctgctcggcgagcagtgcgaggcttgcgattcggaagcggccagggaatcgattgatgtggcgcgtagcgcgccaagcaaagtgtccagcgcggcgacggtgccagctgctgaagtggtgcttgtcggcggcggctgctgtccaagcaatgaagcggacgctttcgatcagtcaattggtggcgatatccaagccgctgatcgttcaatcgagcgtcggaataaagtctgcgctggttcagacaatgatgtacttccatttcgattagtatgtaacggaatttgtgcaatggaattctttcagtttttcacaaatcttgctgtgctgttatgtttgattccctccgttcccactatgttttcgtcaaattgtgagctacgcccatgcctagagcaaaagctcagtccatacgcaccacgaaatatttctattcaactttattacgtaagtaaccacgcaataataaacaactaaaaaaacaactcaagaagcatagcataacctgcctgtgacaccacggcattagatcatccgttcccttccacggcatagtaaagaatcgataacacctggggtttattccgttctggaatcccaaatcccaaccaacggcttctccttctcgaccacgaaacaggcggagccgcggaggattccggtccccgaatcgacacgggggacggggagcgtcagccttcacgtacccacgtacgtcgcgtagcagtacagacgcactagtccacttgattaatctcgtggccaaaccaaaacctccgcactggggaaaaaaaccagcgaccacgagcggcgacggcgcggccgtcggctcaggctaaaaagaaaagccgtacctgcccctttcgcgcgcgaccctcccgatagcgattggccctcctgggccctagccggcccagcaccgcccatatccgcaaaccgccccccaacccccgcggccgctcagcgctgacggcttcagcttctatctcctcgccgcgacggtgcgtgcagtgcgtgcgttgacgtcaagcgtggggtctgcgtggcgccgcggccgcaccggctgacgtaacccctcgatcatcctcgccatcagcccgcattaccgcgcccccgtctagccaagcgcccgcaggcatacgtgcgcccggtcaaagcgtgggcgccataatttggcccgcgcgccggcgggtgcggctggctggctggctgccggccttgccgccccggcgattatccggccgtcacgtaccgtttgctcgcgacgcgtgtcgaggcgggagggtgggcgcgcgcgggcgcggaggcgtgcgtgactgcatggccggtgagcacgcatctatcgtgccgtgtaccaggtgtagcgtgtaaaaattttgcgcgtggtgggggcacgaaggccgcgtatcggattgggccacaggggatgaggaggaagacgcgagagctctggatggagtccacgggggaaagggcatttggggcgtacggtacggttgccaactcgtgccgcggaagagtccacggctttcggttcgcctctcccgggtggccgacttcttgccactttgtgccttctgttgctttcgagtcagctcggtttgggagagcgtacacttgagagatactggttctagatacgtccagaagatttagtttggtcaccttatggattataatggcttcttgattctagagagattcagaacattgaggctattcgactcattgattgcgaaatggagagtttggtgaagtcagcgcgcggtttgggttgtgcgagggcacaactagatactgtttgatcggtcattaggtggccctgttatcacgtggacatgtaatctctgcatctagaggatgtctggaagtgtgcaagaactccaagtctcttatggtcagctcaatgtcaaagcctgcattgctggcaccaaaatgagctataccgggtagcacgaccggtgatttggacgaactggctccagacgtaagtgtgcatgcagtgctgtccaccgaattaccacttggcttggtgatcaagcccaggctgcacactactactttgtaccaatccgtatcgatcagaggtgttctcgtagggatccagatcctctgcattggagaagctaatgcagagggtggaattagctccaatcctatccgtccatcatcatccaacagctgcagcttctttttcccttcgatactggtaccagaaacaaacaagtcctcctcaccggtgaccatagcaacgcaagcgcaatggcaatgagtccgctttggcgatctaaaccgctgcgcctcttcccttgacctatattatcaccaccatgagaagctgagagtagcaccgagctcatgattatcgaaagaaaatgaagcaacagcgcatgcaatgttcggtctctcggtgcttatccgtagtgcggttcgtgccgcaggccaaccctttaatatccagcacaacgccatgattttcgttcatccatagcttctgcagcgccggcgatgcaacatacttcacgagccagcgattcgaggaaatcgatactccctccatccataaatatttgatgccgtttactttttaaaatatatttgatcattcgtcttatttaaaaaaatttatgaaatatgcaaaactatatgtatatataaaagtatatatgtatatataaaagtacatttaacaatgaatcaaacgatagaaaaaaataataattacttaattttttttaataagacgaacggtcaaacatattagaaaaagtcaacagcgtcaaatatttagggacggagggagtaaaatggaatcaataagaaaaagcaatcgcagccattccctctcagatggatggccaggatttgacagaggatttgtggtcaccggtgaggacttttgtttctggtaccagtatcgaaaagaaaaagaagctgccgccgttggatgatgatggacggataggattggagctaatgccaccatctgcattagcttctccaatgcagaggatctggatccgttctcgtagcaatctctcttgtgccagccaaatggatgaactaggaggtgcaggtcgtgtgtttattcggtactcctacagatgacaaaaccactatacgggaattcgggaaataaacaagactccgtataagcacatcaaagctgccagctctctagttcaggctcggttcaggttcccatcctctgcctttgggggagaatggcagagacacacagtgaggggagctacagtgccgtaccgttgctacagtgaaaatactgtaactaaggtaaaaaaattcaattattttttgttgttactgtagcatttaatattgtgcatccaacggcatggcgatgtagctctctgccgttccagttggaactgcagaggatgcagagccgttcaggctacacagcggcagcggttcttcagcggcgcccggaaaatcctttttctttatctcgagtagtacaactgcatgcatgtctctctacgcctacagttccgtacacttgtattttttttgttttgttcattcattatgggccgtagctctctgtccactgctttcttaaaaagaaaaaaaaaacaaggacaacaaaattctaaaagttggagatatagacagtataacgccgtccactaggataaagcaacgtgttgcacgcctccaccagggacaaaacgccaggtattctcccgttctagagctagacgcgcgaaaagaaaacggaagcagaggctatcagagcagcgctgtggccctgacacttgtcgatgcaacaactgcgacaggtaatcggcgccgagcacgtaccaaaggcagccgccaacgaatagcacaggtggcagaaggcgagctaacggatactaccactactagtcggtagtaatccctctgttactaaatatttagcgtagttaagttttttaaatatatttagttattcgtcttatttaaaaaaattaaataattattaatttttttcctattatttgatttattgttaaatatatttttatgtatacatatagttttacatattttataaaatttttaaaaaggacaaatggtcaaacatgtttagaaaagtcaacgatgttaaatatttagagacgaagggagtagcagttactactattgcggatgagtttggatatgtactactcactccgtcttaaaatgtaagtatttttagctatgaatctggatacatatagctaaaaatatttatattttaggacggagagagtattctgtatttgtatcagccggaattttaagggctgggaatgattgtattgatgcgatcgagggcacaatcacttcgctggcacgatgaggccagggaggatatgcttatcatcaggactgggttcactgattggaatgacgacttttgcttttgattgctacgcggtgctgttttttggactgatttctgtcatcagaacatgcgaatcgatcacatcggccgccttaaatcaaggcccctccagcgatgtgaatcatgtggttcttaattacagttgcttgattgcttcagataatcctgaacatctaaaaagatgcacgaccatagcacgggatactgtgccacgcggagcagcagcaaattaaaacatatcgatccttcctggccaggtcaacctaatccaatcgcatcaaaccgagcaacactaatgcttgccgccgcctgccaatctgccatagaaatgtgcaacgagccggcgcacgaactaactacttcctcagtttcaaaatgaagctattttttaagattggcacggatattaagaaagtaggtgagaataattagagtaagtgtgtgattggttgaaaagagaaagtagatgaagaagaatggttgtggttggttgagatgagaaggtaggtgaagaaatagctttattttaagacaagacactgtgctaaaaatagttatattttaatacgaagggagtacaagctgacatatgttcttcatcgcaccgaacgaccgaaccgcgcactgggcgtatcctctggctccccgcgtcctcgatgagtcgctaggcaggagcagggcttctgccgatccgatcaatctcgcgacggatacgtgtacttctctgttctgctctaccgcgccacgcgcatggtttgcatggatcgcgtccgcagcgtttggcctgcatgcatattactacctccgtcccataataaatatagccgtagatatccgtgtctaacatttaactatccgtcttatttaaaaaatttataaaaaaatttaaaaaatttagtcatacataaatcactattcatgttttatcatctaatatcaataaaaatactaattataaaaaaattcaaataagacaaatggtcaaacgttgaacgttaatagtaaatagtgtaaaactatgagccggagagagtactactacatgcatgggccaggcggtagcaagcagtggcatcggcggcgcagcttggagaggccctctctgcttgacttcacatctgttcccttcctttgggcgcgcgcccggccaggtgcctacgaatcctcgtctcccgtacttctggagtacgactcgtggcacggtttcccgcgctactaacagtgccctcttgggattttatggcaggcgtacgtggaccaataagaaggttacagtgccttgggactttcagaatagggcgtggctaatggttttcacccgcccatcccctatacgcccctttcctccttcctcctcccctttttctctcctactacaccataaatttaaaaaaaataaaaaaaacaagttagaaaaatttatgtatagaaaaactatatgggtg

SEQ ID NO: 16044 - DNA, 1517 bp, Oryza sativa
atgtggaggaggggggtgattgctaggggcgatcgatcgcccgttagcctattcgttcagaatatattaagggagatgctgtttatatgaggaaaaaattagaaaaagaaacggaatcgctataaaactttgcaacatatctttcttttaaaaaatatcgattatttagtcgctggattcattccatgattcatacacgagatggaagaaatcgcactagctagtggccgcacaagaaaatgtcgtcatcgcgtgcggtctcttaagtggaccgcatacgatgtgtttgcactattgtgtgcggtctattaataggaccacacgcgataatacgtctacgcatgtgacatggttacggaaagggcataacttctattctacgacttatggaatactccctctgtcccataaaaaccaacctagtatcggatgtgacacatcctagtactacgaatttggacatatatatgtccgaattcatcgtactagaatatgtcacatccggtcctagattcgtttttttatgggacggagggagtatatagatacatcatacctttgtatgtgtgatagacttccatatacgataaggaaattgacaagagattgtggaaataatcctcacgagcaagtacgtaacagagttctactcggagaggttatgattatactatatcgtgcagggtccggggtctccgagttctactaggagactaagggattcattgtataaatatatatccccctgaggggtttagggtatcgaatcacagcactagccaacccgccaccacagaagcgatccggaggacttgaagcctactcgcccgtagatctcgttgagactctctcgacaaggatctcgtcggtaattttggaatcagttgttctctattgtactatgtggatttccatatcaatctcatataaactagattagggctattacctcgcgaggggcctgaaccaatataatcctttttgtttgcttgatgtcgaatcgtatagatccttgtaccaacgtaccccaatacccatactgtgcggtatacggtatcccccgtcgatagcatgcggtccgtcaaacaacccctggggaccggtttttccatgtgcagctacttatgccctgcctaaaacctatgccccccgtgtacaggaaaatcgtctttttagtagtgtgagaggcattgataccacaccctctactttgctagtcactaagccaacgctgactttggtgtaaaatataaatttacatgctactgtcgcccatgtaaaaaaaatcactcctgggtattatgcatctaagtatggagtatatttgtactctattgtaagattactgacaacgaccgtcggtgctggatgtaaggttcaacaataagaagtcttggactctcaaaactgtcgaatgtaatataaccctatagatattcccaaataaaattatgcagctttcttcacctttatgcacctatttgatttgaaaccctactaaaatatgggctgcagga

SEQ ID NO: 16045 - DNA, 3715 bp, Oryza sativa
ttatactccttccggtatcaaaatagttgatgttttatatgtggaagcaaaatatgctaattcttgatgttttatcttgcctgtacatcttggacctgcttgccctcctgattaaggcctgtttctttcagcttgagattattataatctagattattgagtcagattactataagctagattgttataatttgtagtagaataagcggttagttgtttctttcctagattattggagcctagattattaggtttgcaagtctaaagagggagtggggtggtatggtgggtaatttttcacccaataatctggaaaaagctcacctaaatgagcttatcagattataataagctgggctccagattataataagctacttcaataagttatctgtttctttcagcttactcccaatgatctagattataataatcccaagctaaaaaaaacagggcctaactgctcgttggcttctttggttctttctacgcgttgcttgttggtcgtcagccttttacatgctctttgctcgctgccaagtactgctttcatccatggataacatactagtgatgagatggccgagcatagaggaggccgtgcttttagcaacttcttcctcgccgactgtagggttggacaaaaagctcgaaactcgtaagcttgtctcggatcgattcgaactcgtagtattaatgagtcgagtcgagctagccttttagctcgcgagctgctcgttagtataaaatatcaccatatcttcatgaacttagtatttcttgattggtgcttagtcttttaattacagcaaaactattcatatttagtgactactatattagttagtgtttattattatgttaatacataataaaatcttaaatttaaaattattaatatgatattattgagatatagctcgttaacgagcctaacgagctagctcgcgagccaagccgagctggctcgttaagacaacgagctcaaacgagccaatctggctcgttatccacctctagccgacaggtgtgatagcagcgatgatgtagcagccgttgtgtgctagagcacgcgtgagcgagccaaaaatgaccaatacaacgcaatgtaattttttttaatgctttcagcgactgcttcctcgctgacaacgagtgtgatagcggcgatgatgtagcagccgttgtatgctagagcacgcgcgagcgagccaaaaatgactaatacaacgccatgtaattttttcaccgacaacgagtgtgatagcagcgatgatgtagcagttgttgtgtgcgttgtaaattttttttatgctttcagcgactgcttcctcgccgacaacgagtgtgatagcggcgatgatgtagcagccgttgtatgctagagcacgcacgagcgagccaaaaatgactaatacaacgccatgtaatttttttaccgacagcgagtgtgatagcagcgttgatgtagcagttgttgtgtgctagagcacgcgcgagcgagccaaaaatgaccaatacaatgccatgtaatttttttttaaaaaaaatgttgccttagtaggacgccatgtaattttttttaaaaaaaatgtttccttagtaggactcgaagccggcacgtacagacgctaccaataggcccaaaccacctggaatagtgcaagtttctgattcctatttgcacaagaccgtacttaatatgagtaaaacaggaattagataccctaataaattactcttggtatgtgagattatgtctaaaacgtcaagaattttgaaactagagagagtatcaactctattgattttggaaaaattgactacaatacaaatggcttgtagtatgcaatattatcaaagtttctaaataattaaatggacgaaatttaataatagctttttcgtttccttttttcttgtatctcttggtggcttatagttgttttgctctaactgataatctctcagcactaaatattccctaagtattcactaccatatatggaatttcatgattgtctagtgtcctataaattctatcttttagattctaaactatattaaacattaattagttcaaacatattcgcttatggatttgaatatttgaaagattaatcatttagtatatttaacatgatctatataatataaaaacacaattattattattatttgttgaggagggtattactgatccaattgcgtggtataggaaaatgatgttatttttttctttctttgttttggattttttttcttaataattttgggtttaccatgtattcagttctagagtactacagcgtagacatagacgtagtatatttaaagaagataaatggatgagagtttatataatttgtaaggggaaaatagttttggaagcctctagaatctatatgtgatattctgctctagatttttttcccactaatgattcttaagcatttattttatgtggtatgaattaatgatttttcttccaaggaaggggcgctacgtggaccaatcaaaagccagcaaaagagccagctttagattagtaaattaaccatgtcctcaaatcccctgtcttatgggttgagcgagcctcttgcatttgcctatctagaaattgaccagcgttgctaggtgagaatggtttacaaggaggacctttctgccatgatattagggataatacgatatttagctcgtggttagtggtcattggtcatcctttctcttctcagatctcaacaactcgtttttgatccaatagctcaaaacaacggctgagcctgcgagatcgatcccttgtctgtagctgaccgtaagctattaatagcacttaaccaagcaacctgaacgacggattcagatcacgatcgcagaactatattgcccctcgtactatcgcatgcatgctgcattgctgcctacggataatacagttttctcacaggataaaatgtccccgagatgcggggcttcaccagaacaccgcccggagtacactcgtacgacgtacagcacgtacggcagagaagctgcgacgatgctagtgagccttcttgccccggtagaggcgggagacgcgactgctcccggcctcatcctcaatttcacctcgtgttccaattccactccgctcactcgatcgcctgctccgctacgaatagccatgttgcgaccccctctggccccccaaaccgttggtcccacatgccagagtcccgttctccccctcgcatcgcagcgtcgcacgcttttcacgccatgccgtcacggtgccttctcctcgctcctctgcttataaatagtggaagcgctccacttggagcacggccgacgagagcgcagcggcaaatatcactaaatatcacacgaaaaccaaaccaaatcgaagaaagagagatactgctgtacttggagccaagcgagagagaagactgagacgcgacacgcgagcaatggaggctgcggtcgacggcaggtggacacgcgtccgcacgctcggccgcggcgcgtccggcgccgtggtgtccctcgccgcagacgaccgctcgggcgcgctcttcgcggtcaagtcggcggcggcggcggcggcggccgagcagctcgtgcgcgaggggcgcatcctttccgggctgcgctcgccgcacgtcctcccctgccttggcttccgcgccgaagccggcggcgagtgccagctattcctcgagttcgc

SEQ ID NO: 16046 - DNA, 9281 bp, Oryza sativa
gacgagggctggatccaagtgctcaacgagtccagcgaagcttgcgacacggcagtggccaaggtggaggccgaagggaaggggcgcgttctgatcgaagcgttggaaacgatcaacgaatcttccggtggcgatgcagagtgtgttgatcccgagggcactgtacgattgattactgttgcttccattgggcagcaggaagtgttctgcttgggtctcattaatgacccacttgtattttctgttaataaaagtgaattaacaaagtctttgtttccccaaattgtctcattttaattcttgcttctactcattttcttccactagtatatgcaatttgcaccatctgaccaagttcgcaactgctgaaccgatgtgccatgatgattccagaaacatggttctagactcaagaacagcaaatgcaagaatctgtgatcaggaatgaccggcagtatatcctccatggggccattgtaaaggcagcgactagatcataccagcaaaggctagagaaaacaccacatctgagaaatctgggtccttttttgccttggtctgaagtctgaactgctcacattcatcgcatattcctcactactatctactctactactgttgttgagataaggatgcacatgtagaataacatctcccaatccaaattgcctctgaagagtcgggagtgaaacagcgatcgggtcaactgggggtctcgtgacactggatagttagcaaagctactgcaattaggagcggcgcgattggtccggagtcggacgtgttgcgatgcgaactgatcgtctcagagtgaattccaagtggcaatgtttgatcttctctcaagcagagtagaccaagttgacgtacacgtttgatatttggcacacgtggtaggggagatggggagaggtgtccaggagcttgtctaaatccacaatattagctcaccgcgacacgtgtcctggtaggctcttccgtgaaacttcagtgcgcgtttctagatgtttactgtacacttgctgccctgccagtcatccggagttctgaaattcgctagaagtagtcgagaacatattctcagaagtagtaacttatgttccagaaaaaagaaagaagtttggaaaggtgacttacggggatacagtagtttcttaatctcttctactctgcattaagtgccggataataccgtgctgcatttctgaattatgaattccttgccgtttacggaatgaaaatagctgttaattgtgcagttagctgctgttagagtggattgaagtcatcatatacagcagtgaaagaatttggtcgccaacacgacatctgaaaaccgccagcaaccttgccgtgcgtcaaccaccttcacatttcaattccctcgcgaccgcttcatcgccgctggttcttgaggagcaagaggggaaaagtgtgggggggcgtagactagttctgttaattatcttaggagggtttgttccaaaaagaaaagaaaaataaaatcttaggagggcaggggcaccaaactgtgtaggtaggtggcgtccaggtcaacttttcaatgcagagaagccatctttgtgcttaacgaagattttgggcaataattagctagtcatcaagaaggaagttgggcaacaagaatctcgtgcatatgtaacccgtggtgatggccacatcacgttgcttgcgtcatctctggatttcagttgggggctctggatcaatagtgttttaggatatcctgtactggctgtaacaactaacaagtgtgcatactgaattgagagtgggatataccccgcaaaaaaaagagaaagaattgagagtgtatatactagtatggctgtgattatacagtggtgtctgcaagtgccaatgtgccatgctgggttggtacatgttggttttttttttttcatgaacctgggtctctttaacaatctgagacaagttggtgtgagttaataatattctcatgttgtgagttaataatattctctgtgtgcgatgagatgatatagggctgtccttgagacaagttggtgtgattctgactgctattgtagttgtgttcagtgggcatatccagcaagggggtgaatggttcaaaaaaaaaagagcaagggggtgaaaaaaaatggtgtgtttctgagtagtacaactgtagttgagttcagtgccataccctgcagcaagaggggagggaaggggaaaaaaaatctaggcacgagatcattggacgatggcgacgcgcaacagtgaaacgtgccagtagggcatatggtgcgtgcgcggcgtgaaccgtgatgcgtcggcccgtcggtgacgcgcgcacctggtccagcgccggcgccaagataagtctcgagatcaagaattccgagagaacctttccttcctgatcagcagccagccgcccggccacttccgggcgaattcatgcacagcccggagataattacagatgcgcggcgttgcacgcaatactactactccactaccaatcatgcgtgcgaaacagtataggtgcatgcaccgtgcgtgcgcgatactattcagaaggtaggggataaacttggcagccgggggtgggtgaacagagtggtagaaatctattgtcagccaggcaaaaacaaacgccggggccactgtcgctttggcgtgccgaattgctgcatactccggtcaccctctgcaagcagcacaccacgttagtgcttacgcctctcctctgcaagctgcgaagcaaaagaaagacaaacaaagtgaaagtaatggaaaagaagccggtgcggttaatctttctctgaaacggatcatgacgacgattcagagtttagattattccccatgggacgtttgccttgtcccggtggtgcaccaaccacaagtccgcaagcaagatagatagatagaccatagatatgccgttcgcccgttcctgtaccggataagtcttcttgtgttgtgtaatgtgtctgtgttaggtcagtactaatttctactcaggtatgaaacgtgaccacggtttggtgcaggtaaattcggtcacgaggccagtatatatttggatttttcagtgaagccatccgagaatgactttcgctgcatggagttcaacaattcaaccaacatgtgttagttgacagtattttttttacaccattggaagatttcacggtcagtgccaatgatacccattacccaagaggcttataatagtcaagcagagcatatgctactctattctgagctcgctggaccaaacggtaggtgagggccaggcacgtttgatttgttcagaaagtcaaaacatgtgccggaatcgcatttgcatcgttgcatggccgaactgttcgggctggagagagagagagagagaggagcagttcagcctaactacacatgccgcgcaaaacatggtgcgaaccgagccacacctacagggagatctagcgaagggtacccaatcgaaccaaagagatccgagcgaaacaaactcattttctaatcgtggtggcctaacaagtcgggcagatttgctgttggtgctactcagatatgtgcagtatcgatctcacatagtcacatcccgtgaacagcctggctgtctcttgttggtgtttgtacgtctgatcagtcgatcgaatcacatgccgctgataagcacatgcgactggatcatcagggagaggagggataggttgatctcatggctcgtgatgagctggtagctagcgcctaactgtgaagcgggcacgcgtgatgtaatgcattgtgagacaattgcatctccacacgacgcgagatcgcgtgctcttccctctcttttgtggctgtggctagatcacgcgagcaaattccacgtttatttcccgtgtttgcgcgatgtgctacggactgctcgttgggtttcaagagaacttttaggcgagatccatcagtagtcgtacgagtagcacgtacataacctaatcgcaatgcactgcctaacttgcaggaccgcacctacatgttgatatatgttgaaggacatcttgatagcgatcaatcagcatgtggttgccaattgaacaccaatatctagatcacttccaaaggttcgatcaatccagctcgaatgtggcaatcttgagctcagattccactggtgtttttgcaatgctgtgagccggtgggcatcaagcccctaaaagaacagaggaagatgaacagggcctgttcacagtgcctcgctatccatccaaaaaggtaaacagcagagttagctttgacctctcctctcctaaagtggatcatcgatatctttttattaaaaaagaaattccacacaaaaaggagagaggaagtacgatatgacgtcctcgtgggcctaaagtgacgtcatagtgacgcgcagtaaaacggcatgcttttctccgtacggctcaacaacgggtttagtgaaatcgccgggtgtaatcacacgtgattaagtcgcaatccagtattccgtacgcaaaactgcttgcagaacagacctgccaactttactagaaggggatggattgccgttcgctaacgactccgatcctgatcgctggaaacatgagctaattttgacatattcataattcatgtctcgctcgaactaattttggtctcgaactgtcacgtgattgatttgcaaagtagtaaaggagacgtaatgaaaagttaaatgcaccaactggttggtcacaacgagaggaaatttgagcggaatttaattttattactctgttcctgttacaaacacaatcgaatctcactgattcagtcccgtcagtatcgaacgggtgaaaaatttcatttttaccactgccaagatgtacgtgcaggtaactgccctgcctaatggaggattcgatcgcttctgcttcattgcgcgggacatggttgacgccatccgcggcgacggcgaactgctccatctctgggtcagacagttctgcccagacgaagtagtccgcgtcgctggccggcggcgtgacggcggcgaaggagacctcgtcgtgcacctcgatccatccttcgtcggagtcccagtccggcaaggccgaggcggcgcacgccaatgcaccgatcctctccgccgcgccggttggcatctcgtcgtcctcgtcgtcggtgtctgagtcccagaacgcgtcatgcagcgtgctcttgggggatgcacgttcttgcttcgccggctccggccagcggtcgagggccgcggcggaggcaacgaatgggtgttccaggagctgcgccgccgttgacctgtcggacgcgttcctctcgaagcagccatccaggaagtccttggcctccgctgacagccacccgggaacctccggcacggcgttcgtgtacccgatccggtggactgcggcaaggatgtcgtccatgtcgctccacggcgcgcggccggtggccatctcgatgatggtgcagccgagggcccagacatcggccgccggcccctgctcctccccgcgcgccacctccggcgccatgaacgccggcgtgccgccgatcggccccgccgagtccatgaccctcgcgcacccgaagtccgtgagcctcgcccggccgtcgctcccgatcacgacgttcctcgccttgacgtcgccgtgcaccagcgaattcccgtggaggtacgccagccccctcgccacgtcagcggcgtacgcccggatggccggctccgggaggcagcccccgttcctggcggcctcgtcggcgagcgacccgccgggcgcgaactcgaggaacagctggtactcgccgcccgcggcggcgcgcgatccgaggcaggggacgatgtgcggcgagcagagcccggacaggacacgcccctctcgccgcagctgcgccgcggcgccgccggcggaggccgacttgacggccatgagctcccctgagtcgtcgtcggacgcgagccacaccacggcgccggacgccccgcggcccagcgtgcgcacccgcctgagctgcttagccattgcctcgatttcttggtccttggaattcttctctctttgtttcttctttttttcttgccttgtgcgtatggagtcagtgtgtggcgtgcggtgaggagggggagaggtgtatttgtatggcccagcggagcgtgtgcaacacgtgcggaaacggctttgtgctgcgagaggagagagaaaaatagcttaggcagcgtgcgtttttggtagcctcccgcaccgcaccaccatatgccccacgcacccacactctccctcccctgcatctgcatgtctgcaaaggaaggtggaacgaagttgtagctccggttgtggtcgtgcgttttttggccttttttcgccggcgttttgtcctgcgattctccgtttgacggatcggcgtcactgccgccggccaggtgcatcggcacctgtggcccgggggcctgtgtgggtatccagccgatacgcgcagccgcacatgccctttatcgcgtgacacttgtccccgcacgtggtctgcgatctgctcgggcaaccggtaagagcaaatttaagccatcaaccagctacaattcatttataaccaatttaataactaatttataaatagttacatataaatatatagcaatggttagagacgggatgccgtccccaacaggatgctcctcctccacaacgcgattctcacccacgcgacgcggccgaaaccctaaacacgcaccaagcctcctttgcagcgccgcgtccaccccccgccgctgccgtcgcgcctgcgctgcccatccttcaccctcaacgtgcaccaggcctcctctgcggcgccgtcggctcgggcttggcctaccgtgagggcagaggtcccggcatttgtggagttactcgcaggtggagctccgagccgccacaggcaggttcgctgcggcgaacatcatgtcagagtgcggcgagaaggcgcccaaccttgtctacaggggacggtgcaggaggccagccgcgccgtcgggatgctcctcccctaataggatatctagtagaaatcacctgatacctggtaggtatcattcgatacctcgcaaatatcatgcgattcatggtagaaatcgtttgatacctgataggtatcacatgatacctcgcgagtatcaagcgatacgtggtagaaattgtctgatacctaacaggtatcacatgatacctcgcgagtatcacacgatacgtggtagaaatcgcatgatacctgataagtatcacctgaaacatgtgtagaatcgtctgatacctgataggtatcacacctgatacctactcggtatcatcccaatcgaaaacaagatctcgttatatagcagctaaatagttacacatagatatatactacactattaatatgtggtctcatatcttatactcacacaacgttttacaatccgtgttactgctgactataaatctgtagtctgttttacttctctcttctcttatcatctccatatatacttataattgatttgcagcctgctattggacttgctctaatctcgacgtctccttttgcctcgccaacggataaggcctgcaaaaaatgattgaatcatcgtgttaccatctctctctttgctactgtttgttcgttctttcctctcatcgctcctgctagcctttatgggtgatgtccagtctaaggtactcccttcggtctgataatattagttgttttggacaatgataaagtcaaattttaaaatctttgactacaaataatttctaaaatatttatcttaaaaatatgaaaaccatatgtttagattagtcttaaaaagtactccaataaaatcatatatttattaatatttttatatatattataatagaaaatagttgttaaagttattttttgaagactgtgtctttgttcaaaatgacaagtattatcaacccggagagagtagtacatttcaacacctgaaaccgaacatataaaataaaatgaccgttttggggggataagtctggctgatctctcaacgtccttgtgcttggggtttggccggatgatcagtttagacctcttgcatctggcgtaacacttttggctggcacatgtgctgtatgatagctgtctgtcatctttgatgtgtgctctggtcgatttaagcctgaaagctcttccatcgaacccctaaacttggttttgcgaattttgtgtccctttcgccctaatgagagtacgagcaacaaggagcaatgctattccatatttccagggcgtcatccacattagatgattcaggtgatcgacacgtgtgatactctatctgtacagtttgtgctgtaccaagagccagtgtatttactgttgggttacccagactcccagagctgtaccgctgcccactttttcatgctggttattgtcttctttttcgcatgcaccccctctgtattaaaaaaaatatcttagttatctaaaaatattattttggcttaaaattttgtcaaaaaaaactgtctttttaaagttgagggtctactgacgtctttaatatgctcctctgtagtacttgatttctttttcttatcttacctatttttttagaacattatcttacatattgaaccaatagtaccacttcttcctctgtcatatccatgttataagttatatgccaaatccgttatattttagaaccgttggattatttgtttattaccctctctttgcaggctacactaaattaattacacatgcatatgcgtattttacagttgagaaagatagtggcacatgtctccttctaatctctagaggtttcagcctctcctctccttgccaatcattcaagcttttggggaaggcctccatctcggttttaatatcagtaaccggctgtttgcgcctgcggttattagctctaacacaaaacttggctactccaggtttccaataccaaccatttcttgccacgaagattccttgggtcttctttctctacctgagatctttttatgcgtgtgcgtataaactttgcctctgctctacaactacaatagcccacggcgcccaaagacttcctctgggagatgaacctctccccgtgtacgggctgcttggacgtgggaaatttatgtggtggggtataatatttatgcgctatattcgccatcaagggccaattttaaaaatcgcttggctccctctctttatttttaacctccaaactcctatgttgccaagtgttttccattcacttgttgaaactactaacttttgttccttaaaaa

SEQ ID NO: 16047 - DNA, 6356 bp, Oryza sativa
gtgggcatgatgcatcatcaggcggggctttgtcattgcttggggctgtctatgagtctggagatgaggatgaaggcatgcttccgcctagtccaaaaagcacgggtcctggaaaaaacgtggttgtgcatgagcaaggtcatgaaagctctgtatttgctatacattgcaacgaaaaaacacgggatggtcagaaagcaacggcagcaggtactgttgcagctaaagattaatctattttgactaagaagaacccaatgattactggcagcagccttcttgctgcttgcctagagaaggccaaagatgccatgatggcatcaagtacgtcagatgtttctgacacaaaagttgtgattctggaaccaccatctttcttgaagcgtacaatggagaaaatagttgaatttattatcaggaatgggaaagagtttgaaggaaaactcattgagcaagacagaacaacaggaaggtttccatttcttctgccatctaatccatatcacccgtattatctgaagcttctcgaggaaactcaagaggtaatgtgaaccacgcttgtttatactttcagattgcaatatttcctttattatccccctttctgtttgctgtttggtacactaagttttattatcccttatgatatatgcattgtttcaatgtatatattcattatctttacaagtttacccagtgttttatgactgaacttctctcaaaatttcacgcgctcaatcctttcaattgattgttcatcaataatgttttggtgaaaccgcactaggcatcaactgctagatatgttcatataaaacctcttgtgatgatgggctgatagaaatccaaattttcttcattcgttggttcatttgattgttctttttggacaagcatgtgttgatctaccttatgtttcttttttttttttgctctttttaattcttcagcactttttttgtgctagtgcctgaaatgctaatggcttttctataccaagctttcctcctgtttgtttctttagtgcacatgatgtcttacacttgatctctgaacttcaggtaagttcatatgtggacatatttcattgctgatgcactacctacctttccccccttatttttttgttgataattccagtcactaataaaatatttggtttcattttctagcattggtaaacagcagattaatttaaagtttttcttgttgttttggagagtcttgtgttaccatttccatacttgatttacttcccagtatgtttgtttgtaaattcctagttgctttgttctactttttttctcagtactgattttattggctaattgaaatgcataccatctatgttgatgtacttgcattctgcgtattcttgctttttgagaataaatctcgaacttccagagcgtgtttggttgctattttttatttgcgtggagaatattattatatgtatatgcaatgtttctgaacttgtctgtttgaggtgttttgtaggcctccccataccaataaacaaatggaaaattgtaaatgcacttaactgtgatttaaattctgaatgattttgcagtccaagtcccgtggtggttcttcagagcccaaagacagaaaaagctcttcagagcacaaagaccgaagaagctcttcagagcagaaagacagaagaagcccttcagagcgcaaaggtagtaatcatggtaagggagaaagtaaaagcaagaaacggtcaagtactagcaaggatgccagttctcctgatagaagctctgctgagccgtcagagaagcagctctatgacaaacacaaacaagggaagggaaagttccacatgatcattagtggggccaagaaggaacctcctcggaatgtcactgcagatgaagctgctgctattgttatggcagctactcgtggatttggccctgccaatattcaaacaaacacactgaaggacactagtggaattggtcagacccgtggagataatggacatacttcaagctttggaagtttctcctctttacaggacccagatgtaccatccaaacctgtttcaaatagtgaggcatgtacctcactcacaagtagtggtcagcctaaaaatgaaggcactggaataattgatgatgattggattgcaaacactatcgcaaaagctgctgctgttgcagcctctaaagaagctgattcttctgaagcatccatgacaaaagagcagaagctgaaggctgagaggcttagacgtgcaaagatgtttacctctattattaagagtggtggcagcaagatggctgatttgtcaacttcagctgatcaaactaatgaagctggaagggcctctcctggtgatttgaacttatctgagtctgatccacaaccatcagctaaggaacgtgaaggtagctctgtgccatttgaacgtgaaggctctaatctggccaagcaggagaaagactctgatgacgaacggaacagggcaaggaagtataggaaaaaacatcacccagaatctgacgaggagaactatgattcagaggagagctataaacactctaggaagaagcaccgttcagaggattcaagagctcatactagtgatgttcacaaacataagctcaagagacactccaaggatctggaacccaggcatcataggcaccgtgatagctcttcagaagatgagcatgagcacaggagctccaagtcaaggcatcgtcacagggatgactatcactatcacgaggatgatgagcataggagttcacatagacaccagagggaccaccgttccagttcaaaaaggaaaaaggacgatgaccgagataagagcaaacaaactatagttctcccagaagtctcccagaaccaggaaaagccccctggtgacactgctcaatcctcccaggcaacaactgaagtgccgagtgagttgagagcaaaaatcagagcaatgttgctagaaacactgtaaatctgtaataccctgtggggattatgctgtacaatgggataatgtagccaactctccttgttcagcaccgactcagggtatcaagaagtgtacttgttcggttatctctctcatttgaaatatgtgtactgtgtacaggatagcgactgcgttccgcaatggccatattggttcactactcggtaccaaggccatccaacatggggccttggatgagttggatcctattcgtatggtattgtgtattcgctgtttttcctcgcctccccgtttgcatgagccgagcgccgaacttgggctaatgggcaccgttcgatcgaagttcgaacaaatatatgcaaagcacaggtttcaaaaaaaacgaagagcaaacgtaaagcacgtaatatcacacagattaagtaaacaggcatgtactcctactctcctagtacactaaaattctcctaaaaacgcaattacgcctaattaattagcactatcaagcaaacatgccaatgtaatcgagttcgacggagcccaaccacagcttgcccttctgctccgccacctcgctgagcgtgacgcccttggcagccgtcaactcctccacctccacgccgtcggggttgagccgtacgccgaccaggtgcttggctgcgggcgccgcgcccagccgcatcctctcctggttgagcgccacccagtagcctccctaggtgtcgcgcctcacgttgtcggggtagcccgggaggtcggcgaagagctcgtactcgccggctttggtgccccgcagccagtaccggaacgcctggcacggcacggtgtgcgccacgacgaggtgcgtcctgtctcggctgacggcgacgccgttcgggtacggcaggtcggtcttcagcacggtgacccgccgcgtccgcgcgtcgtacttgagcagccgccctgtcgcgtcggcgttcatcgtgatctccccgttgaacctgcgggtgtacgtgctgctgctgtcggtgaagtaggcatcacccgtagcttggtcgacgtcaaggccattgaggaagtggaaggggacgccgtccgcctcggtcgcgaccacctgggcctcgccgccgtcgggcccgactttaatcagccccttgtacgcgtcggcgatgtagagctcgccggtcttcctgaacaaccggatccccagcgggcgcccgcagatgctctccctctcctccggtggcacctcggacgacgagcagagagggattttccggtagttcgcattgtacgcgaacgtggtccagccggcggcgctgcctccccacttgagcacgcggccgtccgagacgccggtgtagaggccgtccttgccgtcgaaggcgaggctctcggcgccgctgacgccgtcgggaagcgggaggtggtagctccaccgcgtgtcggtggtcttgatctgctgggccgcgcacggcgagatcaccagcagcgacgcgacgctgagcagcagaagaaacgtcgccgtaaaatcgcgagccatgggtcgcctcatcgttgcacgtagccgagaaaacgttttcgatggagaactagccgctacctgcatgtttttataggttatggctcgtgacagcctcggcgtttcccggtgtccaagttctactcgaggtcgtcagtaatcctgctcgaactagtactctatccgtctcgtattataagtttaattctttttaagttaaaattatttagatttaattaaattatagaaaaattaaaaacatctgtaataccattaatttagttaaatttaaattatattttaataatatatttgtttactaaaattattagtagtatattttttataaatttaattataaatttagaaaaatttagaaaatgttaaacgactcgtaatacgaaacgtattgagtattgcagatggacgggaagacgaaacccaaccgaaacggagccacgacacaggcttggattcggttttcttcacccccgcgggctccggctccgttccaagttcccaatgccaacctctccttccacgaacgccacgtcgcggtcgcgggcaacccacgcgcccagccgcccacgccccaaccagattggcatcgcggccgtccatcgccgcatcggcgcaggcgcggacccgaaacccaccacacggcaaaccaaaaaaaagaggcctcaccgcacggacgcggaaatgggtcgcgacccaacccacgcattccgcccccggctccgatctgctaagccccctcggatcgggttgcgggtcccctcctcccccccgacccaccaccgctcgccgccggccgcctccgacgaggtcagtccccgctcccttcctcgcccttccccccatccccacgctgcctcctccgcctcctccgtggtgttatcgggtccagtaaccggagtcataaaccctagccgagggcgcggtctacgagctgcttcgtgcccgatttcatgggattcgagtgtggggattggacccatggaggctccgatttagcttgtatcttccagatcgctcccttgtatacgctgattgcgtcgttggtttgggacactggggattcgggcgggttgagccggtgaggtgaggggatttaatgaaggtattttgtgcgtgtttcatcaaccgggcggaatggcagcttgctgcatctccagatgttttaatgggatttgtggattatcagaggcgttctgtagtgtgagtgtatgcttaggatatgagcttttcctgccaatttctacttgcgcgtgtatagttatagcttgtagctacaagtagaagagggcatggagaaaatatagtaacatcaaaggtcactcattgctttccagtgttttggacgcgtgagagtttgtctggaaaagagagtcaaaatgatgctattaccttttctttgtatggatgtagtgtctttatatatactatattgctactagcgttgcatgatgtgcttgtttggatctgctgcagtgggcgatcatatttagatacaagatagcatgctggagccaacagctatggaagtgccgattactagctcagtgaacactgcagtggtgcctgtgcctgtggtgcacaatccacgggcacggaaattgcggtctgcagtttggcaggacttcactaaggaacggcgtgctgatggaagctgtgttgctgtctgtaaccactgtaagaagcagctcacagctactagccggtcaggcaccacacacctacgcaaccacctcgcaatctgcaccaccacctccacgcgtcgtgctggtaagcgccggaagcttattgtgcgccgtattctccacaacaaaacctccactgatggacagtctggtgacggacatgcttcgggagaggaccatgacaacgatggcacgc

SEQ ID NO: 16048 - DNA, 1072 bp, Oryza sativa
gatgagtggaaagttaggaaaaaaattctgaactttgtgcatgtggaggcaccttttacagatgatcagattgctagtctcattctagagaagttgcgtgagtggggtattgacaggaagctagctgccattgtactggacaactgcgcctctggtgagattgttgctagagagcttctcgtagttctgcagcctaggagactcctcctattaaatgggaatttgttccaggtgcgctcttgtgcgcacattcttaacctcacagtccaagaaagcttagaacagacatctgatataattactagagtccgtgagatgattcagaatgtcaagttctcacaagaaaggttcgaaaagtttcaggatactgcaaaactgttgcagatggaccaaaaactgctagttcttgattctcctaataactggccgtctacatacttaatgtttgattctgcatgttactatcatgatgttctcatgcgccttgcagaacaggaagcacattatggtgcttttctcactgcgaaggagtgggccgatgtgaaagccctcactgaaatacttgatgcgctctatcataagatggagaagtttcctgtggaaaatccgactgcaaatctctattttaatgacatgtgtgaggtgcatgttcttttgaatacctggcgtaatagtccatctcctgttgttgcacaagtggctgaccgaatgctgacaaaatttgaggggtactgggatcttactagaccagtaatggcattcgcatctattctggatcctcgatataagatgaagtctgttgagtacttctgtagactcatttatgctgctgatcaatttagagcaaagacaacaatagatgacattcggcagagttttaccaatttgtgcagtgaatatgaacagtcaggaaattcattcaagaatccatctgctctcttctactctgcaaccagtaattcttgcatgagttcggtatacagcaatggtgatgattttaagaccttctcccgtatcacattatctgatgctcgaaggggacttgatcaatatatacaggagacgtcatcag

SEQ ID NO: 16049 - DNA, 1931 bp, Oryza sativa
gtgaggttaggtggagttttcaactccacctcccgaactcagcctgtataacggttgaatccaactatcatgaatggttccccaaataaacatcaaatttgatcccctgcattcctttcaatggtacaatttatgcttgcggtgctatgatgcgcgttgcttattttttaagtttctgtaaaaccaaaactataactgttgttctttgttttactgatcaaattatgattatatataaaatatgttattgaacttttgattatttactcgattactttatacttctaaactccaacaatattatcatttacaatatatgttaaaataaaaccaatttgccaatgctaaaatgcgtaagggcaccaatgtatatggtaaagtgatccatatagatggaacccacataaatagtttttacccatagcaatctccataatgtatatagatacaatatatcatatgtatatatatacaatatattattaggagaagagagaggagtagagatagataatataatttattttatatgggtagaccatatgtatacgggtatcttttattattttttctatatggattagttgcacaatgataataggtggctgaatgaaatattctattgcttatgaactacttttacaccacctaaaagatgttagatgttggtggactcagtgtgattatgagaatccaccacaatgccaaacaacctatatgttgtattactctccgaaacatagatgaaggtgctaaccaattcttctcatttgacatctttacttacgtacaagagcgaaggtgggaatatctcaatcatagggctcaaccatggaatataatttttttgggaaaattttaactgaaaattagtactttgctaatgcaatttttttgcggtgtgtggggctcgatcctaagctgcccccacctggctccacccatgcacttgtagaacgctagtccatctgcactactcgttcaattccaattctaaaggattgtaacaaggggttatatggagaacatcacgtaggcactaaaaaaacatttatttgagaaaaaaaactaaaatattttagagtttaaatccctagcacttatattctgttggagctataagcattctaattttgtgatttagttggttctcaacctatagttttgtgatagttttatcactaaatttatagttttatgatactcagtcttaaatatatagttttataataaatttgatgctaaatctgtaatggattatacaacaccttaaatcttcatttttttataatctattatattattaagacaactttgaaagaagacaccacgctcgctgtggaggctagaaattcctacattaatcggagaaaaagagaaaaaaagctacaccttagattataatagatccagattaaagggcatagatttatcataaaattatattattaagacagctttaaaagaaagcactacgttcaccgtggaggctagaaattcctacattaatcggagaaagagagaaaaaagctacaccattagattgtaatagatccagattaaagggcatagatttatcaagaaaaaaaaaactatgacacaaactatatccagtacgaatagaaaatatactataaaacaaactctatcgggtacatacgtacatagagtcagagtcccagtgtttggcctaggatgtctccgattcagagtgagcaagaaaaggggaaaaagcagagtccaaagcaagttcatctacactccaagttcatgcagacatatagctgccactataagaccacatgcgccgatccatcttatgcagtatattttatcaatttgtcaactaaaatatgcacaataattttaggcccacattaatctcatgtgaaaaaataacaatagtagtcaataaagagggatcagtttat

SEQ ID NO: 16050 - DNA, 1752 bp, Oryza sativa
atattataagttttttccaacgtgtttgttaaaaatatgacgctacacttttcacgtgatttcaatcacttttttcctcctataattgttttctctcctatttatatgtatgcttccatctcttccatcccctcttccacgtgaaactacttttaatcataattctcttatacattgcgtattagaaaattacatataaatattgaaacttaccatacaagttttaaaatttatataataattacaatgtaattgtaggtaagttatagagtgttttttaaaaaaatgtgaagctattaaatataactacactataatttgtatttatatttttataagaaactgtctataattgcacattacataaactaaactaaaaaaacgaaattcaaagattgtgaagatgtattatagtcttatacaatcaaaatataaagataaaaaacaaaagaacttaaaaagtaaaacaaatcgttttttaacgaaaaaaatcgatataacgggctgcctatgtgctgttagtatatatcgatattttttttatcctgaaaaaaacaaccaggttgatgcgtcatcggtgtaaaaacctaaaaaaaagagccgatccccctccctccacatcgaatcaaatccatctcttttctccccttccttccttccgcctcgcctccccttcccctcctcgccgcctcgctcccctccgccgcgccgtcccgtcgaatcccgccatgccgaagggtgccaagaagcgcgccaagctcaagaagaagcagcagggggaccaccccgccggctccgatgacggcggcaacaacaacaacaacaaaaacaacgccgccgaaaacggcagcaatgactccagccgccgccgcgacgccgccagcgacggcaaccaccacctaccgtcgcgaccaaacgttcctcatggtatggatggcatctacccttccctccccgtcccccgctttaagcccgtgtagatctgtctccccccacggcacgccgctttccgcaccagcggggagaggaatcgccttttccccccactccctcttgcggcgagggtggcattcccgtgctcttcgctggctctccggccacgttcccacctcctctttcgagctgttcgccttttctttctcttttgattgcttcctttcttccgctatattacgatggatgcgtgtgtgtttctgatgctgtggtgtgtgggtgcagtggatgtgagtgaggactccatggagagctccgaggagatggtgacgccgagggccgccgcgtccgaggcggacgaggaggagaggaaggccgccacgtcggaggtgcccgtggaggtggtcgaggccggggaggaggtcatggtggacgccttgccgcccgaagccgccgcaggtgcgcaggagcaacagggtaaggcggaggcgcttgtggtggtgcaggaaccggaggtgaagcgcgaggagttggtggccaaggtgcatccgatgcatgacccggaaccgcagggcgaggaggtgctcatcgtggaggcggctgcggtatccgcggtgcaagaaccggaggtgaagcgcgatgaggtggtggtcatggagacggctgcgccgcctgcggtgcaggaatcggagacgaagaacggtggggtgttggtcaaggatgtggtggaggtgtcacggtctctgggtgcagctgatactacagaggtattactgtttgcgatcgagtgctatgccatcggtccccatgttttgaaat

SEQ ID NO: 16051 - DNA, 1383 bp, Oryza sativa
acataattttgataaaactagctgtatgattacgatcaattttgatatgccacgtggacatatttttttagttttgaatatttggatatgcctgctatatgttagtcaatttgtttgcagagaatctgttagttgttaaaaaaacgaaatacccggtttagttatcgagtcatttcataaacagggtttgttccaatgctgataaactaaggaaggatgcccaatggtaacactgtaactacgagaaattgaaaacacatgatttatttgatttgtctgttgtatatatgttatgcacatggaacatgatgccccaagtttacatcttagtggagaatagtcatgctatgcatatgaacatgattggagttttacatgttctaatttgttttccctgttgatttggttaaatcaagttttaatttccaaaatagctgaatgatctctcttagacttttacacgtaattatgttctgttggcaatccaacttggcatccaaagagactaaagtttaccctaccattttggtaccagcaatattgtgatgtctaccacatgaaaatacgaggatgcaccttttgtattctgaactatttctctgctctttttcccctcatctttaaaatgggtacctctgttcctaataacaactattttgtacttgtggataacatggataactatcatagctggccaattccatttgagatacagtccagctgtaatgcttggtatgcttgaggttgtggataccaaacctctcaaatttgtgtaatgtcaaagtgaaattggatgacaatcgtataggaaatgactaaatcggaatttttcttgggctcagatgatttatctgagaaagtactaagagcaagtttaataatatagccaactattacctctaaaaaataacacatcatatatagctaacttaataaaccactcatacaatagttaactatagatacgtatactgcaccattattgtgcactccatatttctctcagttcttggagcacgagctgcaatctgtagcccgcctttcatctcctcttatttcttctccacataagcacaaatatgatgttgcaacatgtagagcccgcttacatcatcttattatctttgctctaatgggacaagatgtttatttactattttggtttcgtagtatttattactgagaataacatgtacttctaatcttctatgttgtcttaaaagttctcttgtttttcccacataccaggttggaacttggaagccaagaagacagtacacgcgaagttgttcaaagctgatggtaattgtaactagtctggtttatgctcatatgaatggagttgaagaatggataacatctagctgatgtttctctctggcc

SEQ ID NO: 16052 - DNA, 3225 bp, Oryza sativa
tctacgtagtaaaaggactgcagtaactacggtaatttccttgctgacagaaaccctcgcaacgtgcttttcgccagcgagtggtgtaattttgcatttggcgaaattaatcactccgtggaattcagaagaaaaatacagagatcatgagatttactggagacagggattgttcattcttgcagtattaccatatgagtgaaaggagaagagggatattctcaggagcaaactcttaatgattactcaaaaatttaactggtggctgtggcgctttgtgtctctcactgaccgactcgtgctgccctttataatagccacggaattttagcacaaagaggcagacacgagaaaagggaagatacaagtgtcatcccgcatccaacaaccatggactccttgtatgatatctcctgctttgctgctggtcttgcaggtacggaacttcatttcgatctcgcacttacaattcttcttaagttcctatcgcaaaatggtctggatcgaaaagaggcttgctaatcttctgaaaatctggccgcctccttttgttttgtcgctgcaggcaacatctttgcgcttgctctcttcctgtcgccagtgtaagcacacgttcggtttggttttttcttgatcctttgatccgtagccgaagttcataactgaattttccttgtttcaggacgacgtttaagaggatcctgaaggccaaatcgaccgagcgattcgacgggctcccttacctgttctcgctgctgaattgcctcatctgcctgtggtatggacttccctgggtcgccgatggcaggctgctcgtcgctaccgtcaacggcattggagcggtgttccagctcgcctacatttgcctcttcatcttctacgcggacagcaggaagacgagggtaattcttcccatcctgcaaccaattttgtctcagaaaaatgtacttgtagactgcagtaatagattgctaatgtagtagcctagtactgtacattttcaattttgtctgatgccaatatgccatcaagaaaggaaaagatgatggataatgttttccaattcctccacagatgaagatcatagggctcttggtgctggtagtttgcgggtttgcgctagtttcacatgcgagcgtctttttctttgatcaaccgcttcggcagcagtttgtgggagctgtgagcatggcttcactgatctccatgttcgcttctccgttagctgtcatgggacgtatgcctctcgatcaagctgagctcttgatcatatcatctccggcatgtttaatagaactgagggatctcactaacctttgcttgctccatccatccttgtgtctacagggagttgtgattcggtcagagtctgtggagttcatgccgttctatctgtcactctctacgttcttgatgagcgccagttttgcattgtatgggttgctgctgcgagatttcttcatttatgtgagcatcatcttgtatcgctttaaatcacttcatttcttgaatcgacatgcatgtttatgagcttgatggatcttgtactgacagcttgattcttttttttttaaccattttgatttttcagttccctaatgggcttggacttatcctgggagcaatgcagctggcgctctacgcttactacagcagaaaatggagaggccaggattcatctgcaccgttgctgctcgcatgatcaaaaccggagtgaatgattgatcgatcagctggttttgccatggtttggattcttgaaagagtgggtttatggtgaattgtacagttttggctcagtcttcacatgttggtactggaagctgtacttcaaactgcattcttcaaacatgttggaaagttttgcacaccaggggggcaaatgatggattttttttaatttgattccctccttttccttgaatacttggtgtgcaaaattatttcagctatgcacattgagcctcacttcttgttatcaattatgacatgtcacatatgtataagttgcgatgatagttttgtttcgttgctgtttgtaaactgcaatattcttctcgccaaactgtgtgaacaacaaatcaatggccacgtcatatatgtacaagttgagatgataattttgttttgctgctgttggtaaactgcaatcaatggccaatgtttatgacacctagggcaagtccgagatatttggttcgtccgtgaggaaggtgtacgacatgtttgcaccatcctggctatgaatgtacacacactcttatccttataaatacacacacatatcctatccctacgagcacttccgaaatattggactgacatatcttgatattgacgaagtcatcacatgcgcatcgttgccgataggtacgccacctactactaaaataataattagccgtaaataggagcatccatatcaaatatatgatttgaatctagggttctaacataagaaacctaactagttgagctacattttgtattatgttttattgaacttgaatttcacacaaaaaaaataaaaattcatatctcctcgcacaaataaaaaacaattaagcaccatttttggacagctcaaaattttatctcaccctagaattccgatttctacaagtggaaaatagacctaatcaaatgtaaaacagtggtaaatgtaccgggccttatagatctaattaggcccaagcccatccagcgaaacacgtttcagttggcccgtaacgtggaatccatcccgttccgttctcctcctcgtcctcgtggcgttcggaccaaacggagcgcagattaaccaaccatccctgtgttcttcctcctccgcccaataagccgctaatctcgtctccgcccttagaagagatcagcccctcgcagcggatgcctgggctagcattttggttggttcgatggagtctaaatcccccagtttttaatctgtgagccgtctccctgcactctgatgtctgtttcgtctggcttttgattccattgtgattaattaggtcatgatgttagatgcaaatttgtatgtcattgcggatgataatgctgtattgaaatgcatggggattgggggttcatgcaggtagactcggacgctagctggccggcgcaaatatgtgagttcttctgatttttttttttttacgtaagaaggtagagtcagccatttcatcaatataaatgagtgtaaggtccatgaggaaggggggtgga

SEQ ID NO: 16053 - DNA, 2467 bp, Oryza sativa
  unsure (1)..(2467): unsure at all n locations
agggcgggtgggttgatcggttcctgtgatacacagatactgctactcaagcttggtctcttttgtttatttttatgcaggtgactgtgtaaagctgacaataggatgttgacatgttgctgtttagatgacaccagatgaaactgtacaattctagacacaattgtgatgccttctttattgatctccttttgtatttgtgcgtgcatgtgtcaaactattggctaacactaatgctccatgtttaatattctcaaggcccttattactttaaagaaaggtactaaactcatcaagtatagccggagaggaaaacccaagatccgtgcgttcagactttctagcgtaagcgataagccccaagtatgtgccgattgcttgatgtcggtgataccaaatttgattatgtccctttgacctttacgtattgcaggatgaaacatctttaatttggttttctcacaaaaaggaaaagttcctcagactgtcttctgtcactaagatcattcctggacagagaactgtaagtcctccatatccttaaacaacaacagttgcaaaagagcataaacttccatcaagctggtaccttgctatcctactaatcaacttttcaccaggctgtgtttgggaggtttttacaccctgagaaggattatttatcattttccctcatatttaaaaacgggcaacgctcacttgatctggtatggtaaagataaaattatgtaattcactcaatctaagtcccaatcattagcttatgataaatacttattttttttcgattcatagcataggttgagtctatgatagcatgcactgcagaggacattcctagtatgaacttctttctattctgcaggtttgtaaggatcaagctgaagttgaagtctggttttcagcacttgaggggttaataagttcattccgcaaaaaatctttgattaacgaacacaaggatagagtatcattttctgaagtgagttatgctcgaccttcctacaggaatttctgtgcctctgtacgcaactatattcatggttcagttttgctatacagttaccattttagaaggaaaaaatgactcaagcatcgtagatatgcatataacgcacaaataccataataccgtaagttttttcgagaaaagaaatttagttcaatttataatgaaagttataggtttatacagcaaaagtaaaagtaggggttactagcttacaataatgtacatgaaacaaaagcacctaaactttaggagtgcagaccctctagacaagatggaacataaacttttccaggatgatgagtccaggctaagactgcctcagctccctaccttttgttttgctctgaacaattaactcatccaccaaaattctatgattgttactgaaaaaaatatatgtacatactaaaagcatacatcattaaaatgttactttgatcaatctagtttttagttatgtactctactccgctctgtaacatgtgggagctaggtatccactttgaatcttttatctatctagattttggttaccaactcttctcctctttctatcaactaactctgctcctcttcgagaattataagcccctatataattaggatgtatagtatattctgagacagcaagtctttacaaatattctaatatagtgcgccttccttcttttttccaggaagtaacttattatcaagatcgccattcctatgattcaacactagatattgcttcaaatatttcacgcagttttaactcagctggttactgtggaaccaattcatttagtttcagaaaatcagatgtgggatttgatcgtctaaatatgataagaacaagtgctgcagacagtagccgggttagtatttctagtgcccttagttcttacagtcaaggttctggaacagatgacatagaatcccttggtgatgtttatgtctggggtgaagtatggactgatgtaaccccatcagatgggcacacaagctcttcatgctcaaaagtagatgttttgatccccaaacctttagaatctgatgtcgtgttagatgttaatcagatagcatgtggtacgagacatgtagctcttactaccaggcaaggagaggtgtttacgtggggtgaggaatttggtgggcgcctaggtcacggaactgatgctgatattagtcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16054 - DNA, 1898 bp, Oryza sativa
ccatcatccaaactgttttaggatctcatttgtgtttaattttaaaagtttaggaatacattatcggaaatgctaggtaccggtattccgttggtagcgatcggaacgggatcatcctcctcgcaccatccctctcaacaagtacgacgcacacgcgcatgcatgacttttattcgctttaccacgaggtccacgactgtcagatggcactgcctactcaatgttggccccacctatgcattttttcgtcattttttcttttaatcctttttagttaaatttgcttaatatctcaattgtttcgtttagtgtaactttgaaattttacttccaagtatttttaatcactgatacctacaatcatcatcaatcattgatacctcataggtatcatcacgatacctgtcaggtaccatttgggtacataaaaacaaatcttcgatacattgctatctgaaaggtatcatccctggtatttacaagtatcattactcactgatacatcttaggtatcatcacgatacataccatgtatcatttgggttcctatcgtcaatatacagatacctcacatgtatcatcctcgacacctataagtatcatcactcattgatacctcgtaggtatcatcatgatacatggtaggtatcatttggatatctatgatacctcatgtgtaatgttcttggtacctataagtatcatcactctctgatacctcataggtatcatcacgatatatggaaggtatcatttggttcctatcgtcaacatacagatacctcacaagtatcatactcggcacctataagtgttatcactcattgatacctcctaggtatcatcacgatacatgacaggtatcatttggatacctatcatcaatatattgatatctcacagataccattctcggtacctataagtatcatcattggtacatgcatatataaaaaacccaaccaatagtgcccataaatacgtaacagagcatggcccaataaaaaaataatacaataataatccaaaaaaataatacaaaaataatacagatcactaggcaagtaaaatataccttgggaggagtacatgaacgtggtgtgctcaccatcgtacgaagcagcacgcacgtctttccacgggatgaattacaggggtataccgtccaaacggtatcccgtcatatagcagtcccctattattcacgggataaacgattgtcgtgcggagatagccattcggactgaatttcaaacaggtaaaccatcacgtccacataatcaaatcgattaaccagacacggcgaaatcaatacagtataaatcaacgcatccaaataatcaacaaatcacacaggagttcgagtattcggcacacgaattactaagaagtgctagtcacacactgcataaaacacacacacacacacacacacgtattcgtagacaagcacaaacagcgcctcgatctggttgatccatgtcgaacttaatctcacaaaccggtgaaatcaaattaggctcgtaaagtccatgatctatgcccaataatgctcacaaaggtgtcttcaccttcacaactttaatcagaaaaacctgaccttcttctacctcccgccgtgaatggcgagcagataaaacagctgtgttgccgagagtatgatggtgaaggactccatggttttctgcaaaaatcaagaccagagcagcatgcacacagttaatagcgtgtcttcggttgtcacgacgaactaaaaaaaaaaactgtgtttgatgttgttcgatcttaccaatctggcgttcctgccgtgcaggtcaatctccttgacgggccaatctgaaaacgtaacaaatgaatccaggaaattgatttagtatacccctatgcatgcatgggac

SEQ ID NO: 16055 - DNA, 7977 bp, Oryza sativa
tatgcactttctattgacaaacataattaggcaccaatctcaatttagagcaagttttggttcgttgtgcccgataacaagacaccatcgagatcgacacggtaaatcaaaatgtgagctagttttaccgatgaagtagccggtgtggatggcgtggttgatggcccagccgccgaccgccgccacgatgacgtacatgcagaagttgagaaccaggagaaggccggccaccggcttcagccccgcgttagccatggatatcaccaccgagagctagcaaaaactctctgcactctttcagaacgtcttcgcaagctatctacgtgctgatctacgttacttgcgtagtagtactatttctacttgattcaggaggcgcaccgattcggcgttagcatccgggccttatatatatacacgcgatcgatagagaacgcgaaataatatgaactattttactgacgggacatagctggttttgttccttgcttccatgggatgcatatggacagccgaattacgttaagtttttgtgacaaacgtgatgcttaaggcatgaaagaaagaagaaaacatacgtacccggctggggtccgggggtttggtttcagaccatctagagttttcagagattctgttcgtctggaggttaagatgacggctagctggaaaagtacagccttttctttcatgcagagacatgtgtatcctttcagttcagttcacttcagcacagttctaacgagcgctttattccttaacagccggagaccgctgctttgcccaacgaaccgcggcgaatgtctgcgaggtgttaggattgctggatgctgcgtcgaggacacgtctggtagatgccgaaacgtaaacaaatattcagataaggatacgcataacccagggtgaaaggcatcgtatcgatcgtttcttctgccaataattccttgttgaaacggaagcgacagaacagctgcttgctaatgaaatttggttagtaggtccacatggtaattaactttgtttagctatctcgcaaagcccagcagatgctttttttggccccaattcagttctttttctcaaagctcgaacggcagcaggtgtgagtctttgtgtctacactgccggacctttaattttcctttttcggctgagccatcttttcagctctgcagagtgttcgattgacccctgaaaattgggaaggcgtattccactcacctcgcggatgctccatttaacgattattatgtcccgaaacaaaactgcaattcaatcggtgttgggaacccgaaattctggtggatgacaccgagatgatctcgatccgatcgcaccgcgacactaaaatgtcctgttaattgaagcccagagggaggaggcccataggattccaggctacccaatctttgcacgctgcggcccatatacagatactaccaggccgtgttggatccgtcgccttcacagaaaggaataagttcattctagctccctcaagttgtcgcctagtctgacattcgtccttgaacccccaaaaaccagatacaacccatcctccaacttataaaaccggtgcaaataagatccctcggcagtattgtcaccggttttggatgacgtggcgcctatgtggctcatttgacttggtctttgtcccacgtggcattgacataacacttacgtggcagtttgatcgaaaaaaaaaagagcaaaattgaaaagttaaagaaataaacaaaatatgaggaacccacatgtcagtcaaacaaaataaatttaaagtacttgaccccacatctaccttatctacttctcaaagagggagaggcggggagatcggtgagcttcacggcgctctctcccccgctgctgcattgcccacgctcttctcctctctcccactggacgtcacgcgacgctctctctcccgttgctgcccacattcctctcctctctctcgtcgatcgatgcaccgcgtacgctcctgtcctctctgctgctgaccaccacaccacgcacgctcctctcctctctctctcccgctgatcgctacgcatgttcctctcctctcccccgccgaccgccaaagagggtgaaggggatggtgaagtggttcgatgccaccagggggttcgacgtcaccggcggaggttatgaagctgaaccccttgcctatgccggcatgctccagtcgccgctactccatgtcgacggcttgccggcgtcgttggcaaccacgggtgccaccaacatgtgctcaagggcatcgatggtgtcctgcagcgcgaggactccattgcgccgtagaccgcgttgagccagagcagcagccgcatgagaacctcgctgacgacatgatcctcctcctcacgttccgcctcagcgccttcgcctcggcctccaccttcctcgccaccttctccgcctccgcctccaccacgcgcacctcccacaccatcctcgtcgccaggaaccccctcgctgccacctccctctcaatcttccccccttcatcttcgtctccatctctggctctgacctggcaaactgcatggggatggacgccggcctcgccctgctcctccttgagctcgggtgtagtacatccaccgtctcccttggccgacctactccggatgccaccaaccccactccacgcccacccatcgcctgcttcgccttgctccgcccaggtgggagcgagagaggatagagagaagatgggagtaaggatgacatgtggggtcgcatgggcccaccattttttattattttgttgtttaactgacacgcggatcatatggttttcattatttttcggaatagaattgctacttaagcatcacgtcgatgccatgtgggacaaagacctagtcaaaggatccatgtaggcgtcatgtcagcgaaaaccggggtcaatactgcctagggatctcatttgcatggttttgtaagttcggggacgtgtcgcatccggttttctggactaaagacgaaaatcagactggtcgacagcttgagggacccaaagtaaacttattcctcacagaaagcggctgacaaattagcgccgtttagcgcggcccataggctgcagcgtccgaaggggaaaacaaaccaagcgggccccctcctaaccctgcgcacccatgcgcttctcgactcgcgacgagcggaaaacgaagggccgcgaccgcgggatgagggattccaccacgttccaccgaccggtcccggcgaatcttcgagaaatcccggcacggacggcggccacgcgcgccgccgccgccgtgggggtcccatgagtaggcagcatcgcatgctgccactcgctcgctcgctcgtcggcgcggccgcggcctaaaaacgaaagcgaatttggaggcgtgggacggccgccggatgcagcatggactgcggagcaactgccctcagccctcgtggcgctcacctcacctgccgccgccttgtcgtctacgtgacgtgactggcaccggcgtcaccgcgcacgcaagtctgatgggctgatgatggctccagatgcagagttctactctgttgatggtaaattgcccattggctgttctctgtttgtttccagaatcttttcttagggcgtgtccacagcgtggagaatcgacaaatctccgaagctcctcattatccaaatcggcgcgtgccccgcacattgtcacatatcactctacaatgtacagtatgtcagtatatataatattctgatggaagataatgaactggcaagtggcaacgaacagacagtaacagaattcaggcattcgcagaaactgccgctggttaccacttaccactgcgtcatcgcacatgtccgcggttttgagtgagtatcaccatcatccatcttgctttacatccgcatggcatgatgcgatcttacctcggcggcacaaatgcggatatgctggcgcttttcgcctgccttcgtggtcgtgagttgtgacccgccaattttctggtgatggcggcggcatcaccgtgatggctccggtactagcagagtaacagcgtgtcgcccgttgattgaccaccggttgtttgcaagctcttgttccggagggcgtccacggtgtgaccgtgtgagtagaatgtcaactctggagttacattacggcacggtgcatgcacacaccgacacgcttaagaatgacaatatgacatgatctcatgcatgtatgacgctccggcgtcgatgttaggagtattaaactggcacttgatgatactttggtagtggtaaatggaaacagaatgcccaacggctggttaccactgcgttcgtggttttgggtttcgtcatccatcttccactacatctgtcgtacacccctagatgaagtatcagtacgtcattagggaaagcaaccaaatgattgagcaccactttaatttataagaaaaatatagaaattttagaggatttcaatcttatcgaaaattttcctatgaaaacctttaaaataaaagattaaataatattttatccttcaaaaatttctatggaactgataatcccatagagattttgaagaaaacttagtaagagtttcaacttcttggaaaatttcctccgatactatctctctcatctgattcctacattttttagttcaattaaacagttattcctatgtttttttctatgttttgtaattctctgttttacatttgtatttctatcaaaatcatatgttttttcctttgtttttccattcctatcattcaaaggggcatacatatgcaatcatacatccattctctcccaaaagataacactcatatatccattctagatttctagatgtctatgccaataatgtcatgtggatggcttaaaaatgttcatggcaggcataacaacggaaaactgtgaccccaggtaggcaatccaaggcgccgcaagcagtacgcaaatgcactcttttttcttctttttttagaagatggaaatgcgtttttttttcccttctcccaggtcaagcacagcgtgctgatgtgctgtggaaaacaaatccgataccaatacaccatatccaggccgattttttcagagcatcgtcaagaggattacagcgtcggttccttccgtcccatttcgtattgtatgtttagagcacgctcacagttaagcatgttccagatttatagtccagtccacctatagtcatttccggatggcacaactgcacaaaattgaaatgggaacgcacgttcctttttaggatttccacactagcatgtgtccacaaattccttgtgcgttctaagctgtagatcgatctgggatattacccaactttttgggaggatgagcaacaatgatttttttttggggtggaaaagagagggatgcacggtcaattggccacaaatattcaacacaagagagatatgaatggtatagtacacccacatgtttcagactggttgacatttcaccggcccggagaaaaaaatcgagggtgttaattaggtggcttaaccgcctaggtaccaagtgcacagtcaaagctgcaactggaagagcagttcgccataagaaaaccgtgtctggtttttaaattcaacaggttgcctatgaaatgattaatcacgggaaccctatccgattttgaatcttggaatggttttgcgtcttttattccagtgctgcagatattttaacggactcatatcgtcgacatgcagctcaaaaacgtttttttatgagagaatgaagcgcgatatgactcttcaacagacaggcaaatgtttacgtgctggaggaatgagagaggtgcatgagttgacgaagtaccaatccaaagtatccaatgaatcttttttaggcgcaagtgtgaaccttggagagcgacagcgatatggttggtacgatggtagcaatagaattgtcaacatatttttattgcctgtttcagcagacgcaaggagatatgcacggggcgaaaatgacatactagaactttcgtacatttttttgtcagcgagaagaaggaagggcgggtgaaacggccttgattttggatagctttttgtgtagtggttgacctgagagacctctcgtagggaacgggtccctttggaaattccaacagccaagtgagaccgcagtagagcagggggccaagtgcagtaacgcttggtcaactgccgggctcctgcctccggctgctggctgctgttgttagagcagatacaatagcaggctataagccagttataaatatattttaaagagataaaagaagagagagaagagcagcgggctacaattctgtagccagctgcagaacgaactacaaaatgtaatgtgtgtatgacaggtgggaccagtattaatagtatagtaaggaactattgtatgaattggctattacattggctatagatgatttagagctagtagtggagggcgctgatacgcgatcatccgcgcgcgcacggttagtcgcccccctctagtctcttctcttctctgtatatattatacttatgtatatactatatatacacacacgtatatacgtgtatatatatatatatgaatattttttattgcataaaaatatatatacatatacaaagtttatatatgatgtatacaaagtttatataggacatatacaaactttgtatacgatgtatacgaactttgtatacgatatatataaactttatatacatacgtattaaaaaaataaaaaaacaagaaattgcatcacgtatacaaagtttgcatacacttatacaaactttgcatacgtgtatacaaactttgcatacttacgaatacaaactttgtattcatacatctaaaaaaccgaaaaaaaaaaacagaagagaaaccgaaaaaaaaaaggaaaaccaatctgaacagaaaccaaaacaagggaaaaaaacagccaaccgaacagaaacggaaaacatggaaaaagaaaaaaaaagggaaaagtcagtctcccgcgcggtgcgtccgccgccctctctccacacgcgacacgtgtccagtcacgcgtcgcgcggagaggagcgcgcgcgactgatcgcccaatagccttctcggctagtagtgggctatactattaaacttgctcgtagagcaggtaaaatagcagactataagccagctgtaaacatattttaagaagataaatgaggagagagaaaagcaacgggctacagatttgtagcctgctgtagcacgaactccaagacgtagtgtgtgtatgacaggtgggaccaggtattaatagtgtagtatgtaactattgtatgaatgagctattagattggttatagataaattggagttagtggtgggctatactattagacgtccattgatcagctgattacctcactgcatccgtatgattcgacttttttttcacgttgattttatattcacaacatggctcgtgggctcgtggctttccggtgcagtgaatatatttctcccgatgaaacgaagtcgacgaatggggaaaggaagtccatcccaaagggaaaagtgaagggaaaaagaggagtcacttacggcacgcatagcctaagcttatccaccacggacacaagattagcgtgcagttaatcttcgaagcagattccgtgctcacctgaaccgctgaacgaatatgcgcataggagtaagccaattggacgatccgtgacgcatcgatcggtcggtcggtcagtccgcgcgtccgaaacggagggtgatcctgcccatctaccgcgcccgccgtggcgccaggatttgaccaatcctccgggcgcaggcgcagcagcggctgcgatctcgtcaagccgtcgcctaggcgttgacgggcgcgagcgagcggccttcctactgcgcgcgcgattaccacgcgacgcgctcgctcgctctcttcccgcacgtgttgcacgagacgcgggtggaggcagaggcagcagcca

SEQ ID NO: 16056 - DNA, 1114 bp, Oryza sativa
cctgcagccccacgcgccgcggcgggcggggagtaccagctgttcctcgagttcgcgcctggcgggtcgctcgccggcgaggccgcaaggagcgggggccgcctcgcggagcgcgccatcagcgcgtacgcggcggacgtggcgagggcgctggcctacctccacgggaactcgctggtgcacggggacgtcaaggccaggaacatcatggtcggcgccgacgggcgggccaagctcgcggacttcgggtgcgcgaggaggactgactccgagcggccgattggtggcacgccggcgttcatggcgccggaggtggcgcgaggcgaggagcagggaccggccgccgacgtgtgggctctcggttgcacgatcatcgagatggccacaggccgcgtcccgtggagcgacatggacgacgtcttctccgccgtccaccggatcgggtacacggacgctgtgccagagattcccgaatggctctccccggaggcgaagaatttcctatccagatgcttcacaaggaacccaagcgaccgccccactgccgcgcagctactggagcacccatttctcgcatccgcctccagcgacatcgacgaaacggcgccgaagcacggctgggtgtcccccaagagcacgctgaacgccgaatgctgggaatctgatgaagacgacgaagtagaagaaggcatgtcacagagcgcaaccaagaggatcagcgcattggcgatcacctgctcggcgttgccggactgggactccgaggatggctggatcgacttgcaaagcgacccatctgaagtttcggaaacaccggcgcccatggtggtgactactgcagatttcggtctttggtgggaggaagcattggacgcggagattgatctccatttcgttgacgtggacggcgatggctatgttacgcgaactgtacgcgcgcgtggtttcattgagtacgacagacaactgagtgtgagagttcgcggtgatatgccgttgtgcccggttgattgccacgggagcacactgtaaaattcggttgtcattgtaacgggaacagagtaataaatttcgagtctgcacaaatttgcctgttgttaccattcatcttgca

SEQ ID NO: 16057 - DNA, 725 bp, Oryza sativa
  unsure (1)..(725): unsure at all n locations
cataaagaaataaaattccgatttattaaaagaagttcaatgtaagcagtcaaacagactccatagtccatgtacttaccagcttattcaacaatctgtcaggcacgggaaaagatgggcaataatatgtgctcaaattatttggatcatctgaaccagcagtactcccatatgagaaagggacagaattataatcagcccaacctgtatctgtcccatttcctgtataaagaaaagatgtcagatgtaacattgtttaccacaagcaacataaaatatagtgttgaatgtagaggaagacgtgtagatgcaaatatgcatcttagaagaaataaagtcccttacttgaactgattaaagatgctcatcaactaaattcaagcatccttcctgcaaacttacaaaaggtacaacaaaaaaatgtttgggtccaattagcattgctagttgtgctacttgtgcaagtattgctcactctcactatatcgagctccataacaatgtaactatttcctagtttggttgctagaagaatagctactgcaggaattcaacagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16058 - DNA, 621 bp, Oryza sativa
  unsure (1)..(621): unsure at all n locations
tgtttgggttaactagggatgacttgtttttattatagtcatttccttggcgtgttatatgcctgttttcatggtaaatagtcatggcctaggctattcgacttatttattaccataatctttataatacttgatgggtaatctttagagtttttatattcggatgcctgtcgagtgtgttcattcgtgaaccttttagagtgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttggaggctacacctaattaggtgcatctattcgatgcaccatattctttatcttttcgccctttacagtcttcgtcttcgctactcaacaggccttggcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16059 - DNA, 680 bp, Oryza sativa
ccctttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctacgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcagatcactcggcacttcatcaaatgccgactggcgccaatcaaggaaagatcccgcccagcattcgagttcgacggcaaacatgatcccaatcgtgaagaaccagactccctggatttcaaaatcatgaaagagaggatgtataaaacttctcaaa

SEQ ID NO: 16060 - DNA, 792 bp, Oryza sativa
agatgctcatcataaatgtgttttgcagatcgcaagatcaaatctcaagctcagtttgacgtcctggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctagcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagtgatgttgtagagcaatttcgcaacaacgacctccagccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaagaagctattaaaaactttcagtcctcgcaaactaagtagaaaaaccaaacaaggcaatgataaaccaagtaagcaaactgaattgataaaaaatcacactccattattatgataatagcccccgactgacaacttaaaggagaaaacttgatgtttgacagtccaaatagggaaatacaatgataaa

SEQ ID NO: 16061 - DNA, 7639 bp, Oryza sativa
gcttgaagaagggcatcccccgctcgccaagtcttgaaacaaatcggctgagcgccgccatgcatccagtcagcttctgaacgtctttctgggtacttggcggtttcatgttgaggatagcagtaactttctccgggtggcttggatgcccctatgagacaccataaagccaagcagcttccttgacggtactccgaaggtgcacttttcagggtttaatttcatcctgaaaacgcggatgctcgcgaaggttttttctagatcggagatcaaatcatcttttgcttggtcttgacgactacatcatccacataggcttcaacgttgcggccgatctgtgttgagaagcatctctgaatcatgcgttgataagttgctcctgcgttttttagtccgaacggcatggtgacgtagcagtatgccccaaaaggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaaaggatcttttgggcaagatttgttaaggtcagtgtaatcgacacacatgcgccattgccctgttttcttccgaactagaaccgggtttgccagccagtcgggatgaaggacttctttgatgaagcctgctgctaacagcttggtcaattcctccttgatcgcgtccttcctgtcttgtgcaaatcggcggagtcgttgtttaataggtttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcagtttccccactttttgaaatcttggcagcgggcacttctccttcgctcaccgtggttgcagccagtcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtacgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccggaagggtgatctggccgagtggagtggcggataatcctggaattactccatgaaaaggcgcattgctcggtttcagctcggagcgagggatctgcatatcatccaaagtcttggcgaaaaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcgtaagccatggggccgccgaaaatatggttgagctccttgcggtggtcttgaaatccagccggggtgtcgccgtcgtccttcttccttgacgtgctttgttcctcgtcggagttcttccgagtagacttggtgtactgctccgcgaactgcttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtattcttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcagaaaatcgtcggatatactctcgaagggattctccggatttctggataacgttgtaaagatcatattgtgtgccaggacgctcgaaggtgccttggaagttggcgatgaagtggtcgcgtaattcggcccaagatccgatcgtaccacggggcagtccatggagccaagatcgggcggaatctgccaaagccactggtaaataattcgccatggccttgttgtctcctcctgctgcgcggattgcgagaccgtagacggtgagccacgattctgggttagtggtaccgtcgtacttctctattccagtcggtttgaagccggctggccaatccactcgacgcaggtcgtcggtgaaggctgctaccccatcaaggtcgtcgtcgtagcggtctggcgagtggtgacggcctcgagctgctcggcgctgtatgattgtgtcgcgaagatcgatggggcggcgacgaggcggtgaacgtggccgttctactcggcgctccccacggtagtcgggaggcgagtgcacggaccgctcgtcgtgacccctgctcctgcgattggatcctgcaccggtgatgctgaggcttggatgacggtagtcctgagatcggaagtgggggactcggctgccagtcggcgtgtggacgctttcggagttaactgggaccgaagccgcgatcatggtcttcgtctggttcaagatgttgacgacgtggtcggaacgattgagctcgttttggttgaggagggtgtcgagaagggtgatcgcggcaaccgcattctgttgaggggtgcggaaaaccggtgtcccttcgacgtcttgttggccgatgagatcacgcgctcggcgccctgcttccaaagctcgctgacgtcgatcttcagcctccttggcgatccgctcacggtcctgctgctcacgccgtagccgttcctgttcttgtgcttgctgctcctcttccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgtggtagcgagagctaaactcatcgtactccacgatgtcggtggggcgcgagtcgacggtgggagagctgtagtggtcatctagctgatccgtcgaaaccgtgccgagtggttggaggatgacgccgacttccctgaagctaggcgaaatcggtgttgagaccgacttccgcataggcctacgggatgaagacgctgtcgtggtggagacggccgctaaatcgtcggggagcttcatcaggactggtgggtaagccccatcatcttgatctggtgtcgttggagaagatgcgatctcagccgagtggtttgaagccgactcgattgagatggtcttgaagtaggtttcagccgcgtttggaatccaaacgggactgagatccggttctctcccgactggtccgattccaagtcaaggagagaaatcttgccgaaattgtcggtgacgaagtcgaggctgccgaaccgaaacgtctgcccgggtgggaagacgaggtcgtcgatgccggaggaaggacccattgcactgatcggcgaaaagcttgacgctacccctacctggcgcgccaactgtcgaaactagatttcggcaataataaaagggggtggctatcaagctggaaaagtgtatgggtttggagacaaaagatttatacaggttcaggccttcttataaaagaagtaataccctactcctgtccggggatgaatccgccgagtgtattattgattgtgtgattcgggaaaaaatcagcatatgcccctagaggcgcccggaccccccttatatatgggaaggagtccggattacaaaagataatctatattcctaacggaatatgaagatacaggtaaaatacagtcgtaaccgactaaatctcagggtgtttccttgatacacaagttaagaaacaaacccgagatacagataagatattctatctacattaagtatccggtacccaatccaaataccgtcgccgtgtagatatgggatacccataatctccacaagctgtagcacatttttatgatgttcaccggtatcctccacgaaatttgagtgttctctactaaaatttgcctatcgtcatttctaaattccagtaagtctgtatgtctttccaaatgtttgcagcaaatcaaattacaagaaaattttaatcaggttcatgcatgcatatatataaagtacatactactcgagggactaggtggcagaaggatactcgttaatttaatttgctttgcacgtgtgtgtgcatgtcactgctaaaaacggccgggttcatctgtacacacatgttcagttatggggtgagtaggacaaaattctccaagtctccaacatccgatccaagtagcggcgtcatcttttgagagctgacgtcaaacgacgtccgtgtgagctcactgtttcttagctgaacatatgcttaactggttgacaacttgccactatcaaaagggtaagtactcttcgtgccataattaatatagattaattaattattataccgttttcttgatgcgcgcgtgagaaaaagaatgagatgtgtgaaatggataactatacgatgaatttccctgtcatatgcattttaatttatgatagagatgaatgatcgaaacttaaatttatggaaataggttcaagcaattcacttattatagtgcttcacaatgttcttttcttagtattccagcactacagctcattgacaatgacccaacagtacattgaaaatatttcagtagcgtgtggatcgaacaaatcaataatatttctattgtatgttagcacaattaaaacaaattaaagcttatgcaagtggggtgatctagttttctgaaaattagcaagcatcggctagagattttattttttcatgagaatacaacttataagccgctggttaaacaacggttatgcacatttttatcaattatacagagagctttagcaatatgttactccttccatcccagattagggggcgtgtaattttttggctggttttccagcatacaaggcgtaatttctatttgattcacgtactgtctcccgagattaccttttcctgattcacgtgcatttgcagtggcaatttcctttgtgtgttacttaatttattgctgcgcacactgctacacgaaatattttcctcgacgctagacccatttatttccaggcgggacataattggcaccgcatgggataatcggaggaccgacaacatgctgtcgcccgcacgggaaaacacatttatcccgtacgggccactttactcaaccgcacgcaaaaataccgtgcgggcctctttactagccccgcacacaaaaataatcctcatcctcactccttaactctcccactcctctcctaccactccactccttctctactcccggcctctcctttcctcacagcagcgacagcagcggcgccgggcgacagcacgcggcggcccctccctccctctcccgttggctcccctcccctcccctcccctccccttgcagatccagcggaggggagggatgggggcggcggatccggcggtggtgggcgcaagcggaggtgacagcggtggcgggcgacgacggttgtacacggccactccctccccttgcagatccggcggaggggaggagtgtctttggccggcgacgggagcgggaggtggatccggcgtgggaagagggcgacgacgacggcggcagttagggttttggttttttcttttttttgttttgattttttattttaccgtgggggcggcttaagcgcccgaccgcgaaaatcgattttcgtgggcggtgcctcacccgtacgaaaaaatcgtgattttggcagacgatggattccagacgggcggaaccaccgcacacaaaaataagtttccactgcacgcaaaaatcgtgattatagtagtggccggaatattgatatttcccatatttagtacatacacaaatacgaaaaaaggtagataaagcaaaaggtttcgcctcttgcatgtgcatctgtgtcttctatgctttctaacctctcattaacgttataaagttcacttcccatagaaattaggaaagaaaattaaaggaattggaaacgttactctctccggtttcaattatattatcagcttttatttttagtaataaaataaatcctgacctttacttaaagaaagctacaactaattatttaaaaaatttgcaattcagcttttatatcgatcgagttaattaatttatatttttgacaggagaaagctacagcatttattttggatgttcattcctgggactatgaattcgtcttggccctttgatcattgagcagctatgcccacggcgagacagaattgatactatgtctttacaaaatatgcagcattaaccaacaaaaatgaacttacgatgctcattagtactgcatgcatgtagacactggaaataattgcagatagtagaaaatattctctttgccccaaaatataatgatctagctaggtatatatttgatacaatgtttacaatgaatttaaacaaactctatctctagatttgtagcactaacaatctaattaatctatacccacgttacaaatattttgggatggagataatataattctgaaaaccgtgtataaaaatcctggggtgaccggagacatatggcataaggatgtcattttcaactgtaagataaccacgtatacggaagtctaatagaactctaatgaagttaaaacggattatcgtccaaattcatgcatgcaagggtggccagcacgatacagagaaaaactggtttcattaaccacacgtgtgccactatatatcacaaaattaggccatgtactcatgtgcacatgtgtgtagttatggatggcacaaggacagtttaagacaaattatgtctgtgcgctatctgtcctttgcggccgcgtcgtggataggtgttgaatttaatttgagagtgctctcaaatggccacatgagctcactgttcatcactgcttgatcatctgctctgaaagttctgacttgtctgaatcgatttatttggcatcgatcaagtggctactacagtgtaatgttgttggtgtacataccgtatggtaccaacttgattgttggaaaatttctgccaccgtagtggacacaaggtgcttaattgccacttattatgtgtacgtatattacgtatgtgctagtgactgagtaaagtccttttgcacatttttaaacatcgacacagtctttgagatgctactttaacccacgatatctataaaagtaagatatctatcttttattata

SEQ ID NO: 16062 - DNA, 1529 bp, Oryza sativa
ccctatatccatccattgaacaagctctggatgaagaagaaatcggagaagacgttgatcaagccgcagccgaagtaagcgatactgacaacaccatcagcttcacctaagcagacccctccaactccttctgctccaactccctttacaagagtaagcacccttctttaactatttttgtaatcatctcactttatggccgattcctcacatactcggtaattgcagaaaaggaaggctgctgtaaagaagaaatcgactccaatgacatctaaaccagctccaccggtacaataatcttacttcttttattaattaatgtcagccgattttatataacacttgtttattttcagcctcattcccctcctattcaacaagcatcaagcgatcgaaccccatcagctgtagggagtcatcacatagaagaagaagttcaaccaattgctccggctattccagtaaattacttataactaacatatgcagatcggctatgcctgtttgatctctaaccctcttcaaatcattactgcaggtcttagccgatcttttctcctttgatatcagagattatcttgatgaggagatagaggatgacactactagcaaagctttagctcctttgtctgacgacgtgaagaaaattcttgaagatatttctcatcggctagagacatcatcactagacagcctagtagtcgactgtggatcaatcaggacttggcttcatgaagtccaggctcaaatctcagatgagttagccggtatccttactccagctgtttatcttgaacaacatcaatttaagctggaaaagtctaagctaagattagccgagcgtcgagagcgcaaagacattgaagcaacaatccaggccactcgacaacttgttcatgaagaaaaagccaagctcgatcaattatctgaaggcccgatcaaatccaatattgactggcttgaagctcgcaagattgaactcttagcacaacttcaagaatgcaatgccgaactggatttagagcacaagaagttagccgatctcccgcagtcgatcgaagaacaaaaagcaaagttaaaatcagctatcaagaatgttgctgattgtcacgcccagaaattcccgaataggattccaagcagaatgtgtattaaaacccccgtccaggaccagccggggtacacaaacgacaatgttgacatacagatccacgtcttacaaacatcataaaggtcttacagaaatgcagtggaaaacaaaagaaactggagctaagccttgacttgaactgcagcgggaacaccactccacaggcatcctcgacggcacggacgaagcctactcctcagggaaaccttcatctgacacatacccgtcctctggggttgggaaaagtagagcaagactgagtactacccactgtactcagcaagtcataccggaataggggtatgatgcagggaattaacaagaagagctagagtggttcatttgcataaaaactggcatttataaacaggaattgaat

SEQ ID NO: 16063 - DNA, 8071 bp, Oryza sativa
ccttctcctgatcattgcactgcaggagattcagcttcttctcttatcgcatggagccagtcatttgcctccatggggttggtagtgctggagaaggtgggtggcctgacacgtagaaactccggcaacttggactgagggggagggggaccaaactgctggtgctgctgttcggcgtgctgcatcatcctctgatgcatctgctggtgctgctgctgcatctgctgcatcatggcggccatcatctgagtctgatgtgccataacttgggcaagcgtcggattctcgggaagtggtggcggaccattgccagaatcaccgttggggtgcacaccatcagcgcgttcttcgccgttgctgccctcgcctgccgtgcggttgccagtcctggtgtagaccatctggagggaagagcagacggggaaaagaagaaaaacagatgctcaagaactaagctttattatataggaattaaaactgcaattgttctgatctgaattaaaacacttaaaaagagcaaacaaaaatccttattaagacagccatatcataggcacatgatatcgaccgtcgactgaccccaaacgagcaacctaaacacacaaactaacaaacaaaaactagacagtcgataaactaatgggaaaaacgagcctaatgctcggaacggctcctgcggtcggtggagtcgaaggcgtcctcctgctcgtcacccggtccctctgagcgactcctggagcctgacggatcagtctcgccgctgccactgggagtagcagacagccaacctccggtaccactggctgaacctctggcggctgatgctggagcgaaggagagagtgaacgcgggagctggaactggagctgcaggaactgcgggcggaaccggagctgctgcgggagctgctggtggaggtgggttcctgggcgcaagctggatgcgcacaggtgcagtcgtcctcttacggggcgtggtgcggatccggactcctcctggcgctggaagacccttcaactgagcattctccttcttcaggcgcgctacctcgtccttcagagcgacgatcctcatgagcttcccatcgttcaaggccttggtcgccttgtgcaggtccgagtgcatcctatccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtaacctggccatcatcaagtaggctgcctcctgacaggcatgatctgcggtgcctcctgacgcctcaaccgccatgttagcgaggcaagtccccacgtagccatggacctccaagcggacacggtgaggaagctcgccactgagcggtgggatggtcgtgtactccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagtgcgaataaataagactcacataacgataaaataatgggaaattagatacataataataataacgaacaaagcataaataccttgcaacccatgataccgagctaggaccgaatgcatttcacccatcaaatcccaactgactgacgaataaatcccaataattttactaaaaccctagactgactcgttttgaaaaactcactttaaacgagcgaccaagatttttcccttgaaccacaagaacagatccccattttcccggaacaaaatccaattgcaaagaacatatgcaatgaagaggattcagagggctcttaggtctttccatttggcttgtcctacggtcaaggtcggctctgataccaacttgtcacgcccagaaattcccgaataggattccaagcagaatgtgtattaaaacccccgtccaggaccagccggggtacacaaacgacaatgttgacatacagatccacgtcttacaaacatcataaaggtcttacagaaatgcagcggaaaacaaaagaaactggagctaagccttgacttgaactgcagcgggaacaccactccacaggcatcctcgacggcacggacgaagcctactcctcagggaaaccttcatctgacacatacccgtcctctggggttgggaaaagtagagcaagactgagtactacccactgtactcagcaagtcataccggaataggggtatgatgcagggaattaacaaagaagagctagagtggttcatttgcataaaaactggcatttataaacaggaattgaatgcgaaaacggttgtaataattaagcagtattaaacatccgctgtccaacgctaacccacgttgcgacaggcccaaccatccacctaaactatccaattcaacagatttcactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctataatctaggttttaaatgagatccccaatgtgtgctagttgatctaagcatggctaagcaattcctagtccaaagtctaatcatgttataacccaagctaacaaaggagcatgatatccaaaagcatggctgtaacaataggtatcccacccatagtgatattataaaacaatgcaatatttgaaagaaaacaatagagcatttgcaaaatgggatcaacatgttcaagtgacaagcatgacttgccttgctctgctgctggagggacctcggcgactatctcgaagtacaccggagcgtcggagggatcggaatctagcgacatacaaagcaaacattgcaaacaggctataaggctactgaaacagagaacaaaaccatttttaatggattctacacatttttcttgatttactgagacttgaatgggattaaacggagctcggatgaattagttatgaattttagaagattcactgtgtttattactataaaagaaatccttaaataatttattgcgcaatatcaaccagggctgacgtcagcgagggggcgcggcgccgacatgcggggcccaccggtcagcgaccgggagagagagaaaggggggtggcggcgcgcgggcccactggtcagtggcacggggaaaggaggggcggcggcgccacgtggcggccgaaccgacggccccgatctacccaagggtagatcggacggcgacggggacctcgcggccgggggcgcgcgggcgcggcgcgagacagcggcgaccatggcgccggcggcgcggcgctcacacggcggcggcgcgcatgcggcagcggcgcaaggcggcgaccgaaggcgaccgaccggcggcggggagcggcggctagaggaggagcggcgggcggcgataaatgcggccgccggcgcggctcggcatcaaagccgaccggccggctgggttaaacggcgacggcacgcatgcgacgacggcggctaccggcggcacgggaaacggcggcggcagtcgaaggcgacggccgacgactcgaagcggcggctagcggctctaggaggagaggaagaggaaaagaagggaggggatgcctcaccgagggtggccggcgcggaggaaggcgatggcggacggcgacggcaagccacgggaggacggcgtcggctagcggacgagcttcggcgtgccctaaggaaggagaagagagggattagagagagagagatggaccatggcgatcgggatccatggccgaaggcggcggtagaggtggcgctcacccgtgcgcgtggagatgagggctccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggagttcgggagaggtcggcgcaatggggaaaaagcgagagggggtgccggcgatgcttaaataggggatgggggaaccggacttggccgggagcggcgggattcgacggccgacgtgggggaagtggggaggagagagaggcgggattcggttttcgaatcccggccatctcgggcgcgggcgcgagcgggagagagaggggaacgggcgcggggaatgcggcgcacgcgcgggcgtggtcgacgtggcccgggagggacggaggcgtgggcgcggcggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggagggggggaaagaaggaggggaatgggccggcggcccatccgaaaaggaaaaaggagggaaaaagggagggaaaagaaaaagaaaaaggaaaaggattttccctggaattaaaaattgcactttagtgatttttaattggttgaaattatttctagagctctgaaaattccactaaaaatcctgttaatgaatttcgacatgtagaactcaagaaaaattccacatgtcaaatccgattattgtttgcattgttttcttagggttttatcctgatttcctctgcattttcttggggtcatttgtaaattacaattttggcttgggaggaaaacttcggggtgtgacactgatatgaccaaatctctgaaggtcattcctggaaccgatgctcaagatgcctaagccatagaagaagtagaacaaattaggcagagagccatatcggctatccagcaatacttgtcccaataattttgtaatcagcgaaaaaaaattttttgcactgtattgtgagatatatatatgtccccctagttttataatgtcaagagcattgataaaaatatgaaacaactaagggcgatataacaatatcggccattgtacatcggcaaactgcaaccgaatacatcagaacaactaagggcgatataacaatatcggccattgtacatcagcaaaaaccgcaaccgattacaataaaacaactaagggcgatataacaatatcggccatctcaaggcgatgcaaacgcaccggctatcatgtatcggcaatactagccgatcacgcgtcaacccaaacactcgggtgatatttcttcaaatacttgccattaagcgctcgcccaaaaacttctccatgaagtccttgcaacatgtatgctcctttagacacaaccttatggatttggaacggtccttcccaattcggcgaccacttgccaaacttactatcacgagtaccaatcggcaaaatcaatttccatacaagttcttcttctgaaaaatcttattataaggtaccactttcttattataatgccgagcaacacgttccttatccctagtaacttgtacaagtgctcgcaatcgcgactgaaccaagtcctctcgttcatcggccataagattatagtactcgtcggctattaaatcattttgcaactctgttcttcttgagccgattcgaatttcccatggtaaaacggcttcatgtccataaacaagcttataaggaggaacttggattgatccatgacaagccatccgataagaccacaatgcttcggctaaacgggtatgccactgccgaggataatcagaaattttccttttaatcaacctgatcaaactcttgttagatgcctcggcttgcccattagcttgtgcataatacggtgaagaattcaataatttgatacccatactatcagcaaattgaacaaactcatcggacacaaagattgaaccttgatcagttgtaatagtctgaggaataccaaatcggtagattatatgttcttggacatactgtattgcatctccagaatcagccttcttcaaaggaatcgcctctacccatttggtgaaataatcacttgccactaatataaacttatgtcctttactcgatggtggattaatcatgccgatcatatcaattccccatcctctgaatggccatggtttaatgataggattcatagccgacgctggcgctctctgaattgcaccaaatttctgacaatcttgacaacccttgtaatatctgaaacaatcttctaacattgtcggccaaaaataccccttacgccgaagtaaccacttcatcttatgagccgattgatgagtaccacaaatcccctcatgaacttcgccgattgcaattttagcctgatcagcgctcaaacacttaagtaatactccatcaatcgttcgataataaagctcatcatccaatagagcatacttcaacgccttatatcttaacttcctagaagccgattgagatggattttgtaaatgctgatgcacatcatatctccaatcatcggccgttacggcagcaacttcaacctgaacatctttgatcatcgacttatacctcgatgcccctgagctaaatcattggcctcaacattctgctctcgagacacatgcttcaaagtcactagccgaaacgtcttcatcagttattgccacttctcattataaaccatcaacgtatcattcttgcactcatattctcctgccaactgactgataactaacaaagaatctcccataatttcaatagcatcggcttcaacctccttgagcaattgcaaccctttaagaactgcctcatactcagcttgattattcgtcgcataaggtttaatagtataagcaaactcaaagcatgccccccgaggcgaaattataaccaagccgataccacaaccatgagcacaaaccgacccatcaaaaaataaagcccatggcacaatctcaaccgagccgattgaatcatcacgatagtcaactatgaaatcggctatagcttgccctttgactgccttcggcgattcataccgaagatcgaattcacttaatgaaaatatccattttccaacccttcctttcaaaattggaactgacaacatgtacttaaccacatcggccttacatatgacagtgcattcattggacaacagataatgccttaaccttgtacatgaaaaatataggcacagacataacttttctacagaagaatatctagtctctgcatccaagagtctacgacttaaataaaacacaaccctttcttttccttcaagctcttggatcaagactgagccaattgacttctcaccggccaacagatataaccaaaaaggtactcctttctgagtagaaatcaaaactggaggagaactcaaatattccttaatactatccaaagctttttgctgctctgccccccaagtaaattgctgattggccttcaatcgtaataatgacgtaaaaggctctaatctaccagacaaattagaaataaaccttctaacga

SEQ ID NO: 16064 - DNA, 3938 bp, Oryza sativa
atttcgacatgtagaactcaagaaaaattccacatgtcaatccgattattgtttgcattgtttcttagggttttatcatgatttcctctgcattttcttggggtcatttgtaaattacaattttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtgaccttgtttctggttctcctttcactggtatcaagtatgcgaaccggcttctccacatatgtcaggtcctcctggatatcaatgtgttccgaatcagcctgttcttcgggtacccttaaacacttctttaattgggacacgtggaacacgtcatggatgccgatcatattggatggaagttctagctgataagcaacttctccccttcgttccaagattttgtatggtcccacgaagcgtggtgccaacttgccttttgtctgaaagcggtgtactccccggagcggggtgacacgaagatacacgtaatctcctgcctcaaaagtgagctcccttcggcggttatccgcgtagctcttctgtcgagactgagcaattctcaacctttccctgatgattctgactttctcttctgcttccgctaatacttccgttccgaacagttgacgttcgcctgtctgatcccagaaaagaggtgtgcggcacttccggccgtatagagcttcaaacggtgccatctgtagactggcctggtagctgttgttatacgagaattccgcatatggtaagcttttgtcccaagctccaccaaaatcaagagcgcaagctcttaacatatcttccaggatttgattgactcgctcggtctgaccatcagtttgcgggtgataggccgtgctgaaattcaaacgggtccccaattcttcctgcagcttctgccagaactttgaggtgaactgactacctcggtcggatactatcttcttgggtaccccatgcaaacacatgatccttgcgagatacaattctgccaatctctttcccgtataggtggtatgtactggtataaagtgagccaccttggtgagtcggtccacgactacccagattgaatcatgtcccgatgatgtccggggcagtcccgttataaagtccattccaatctcctcccatttccattccgggatttgaagaggttggagtaaacctgctggtctttggtgctctgctttcactcgctggcaaacatcgcagagtgcgacgaattcagctatttctctcctcatgctgacccaccaaaacttctctttgaggtcttgatacattttagtgctgcctggatgaatggagtactgggtctgatgagcttcggtgagtatcagatccttcaattccttgtcgtccggtacacacaatctttctcccatccagattgtgccatgctcatcctcaaggaaatcccgagcctttccgactctcatgttctttttcagttctgctatttccggatcatttacttgagcggctctaacttgatccacgagcgtaggccgtgcctccagagcggctacgaacccgtgttcaacaattcccatgttgagatgttcaagctcctgtcgcaattcctcacacatgtcctcgatgcatagagcagtgcagtaacttttccggcttaaagcgtctgccaccacattggctttacccgggtggtagtgaatactcatgtcatagtctttgattagttccaaccatcttcgttgtcgaaggtttaggtctggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagttcttgtcgcactcagctgtccatttaaacttctcgtctttcttaagcaactgagtcatgggtcgggcgattcttgagaagttttcgatgaaacgacggtaataaccagccagtcctagaaaacttcgaatctgcgacactgtcttcggtggggtccacttggtaaccgactccacgttcgatggatcaactgctacaccctggggctgtaatgacatggcccagaaatttgacttccgtcaaccagaagtcacacttgctgaacttggcgtatagctggtgctccttcaacttttcgagtaccaaacggagatgttgctcatgttcttcctcggattttgagtagataagtatgtcgtcgatgaacaccacaacaaacttgtccagaaattccatgaacactttgttcatcagattcatgaagaatgcgggtgcgttagtaagtccgaaggacataaccgtacactcatatagcccgtaccgagtggtgaaggccgtcttgggaatatcctcttcccggattctcaaatggtggtagcctgatcgcaggtctatcttatagaacactttagctcctttcagttgatcaaataaatcgtcgattcgcggcaaaggatatttattcttgattgtgacctcgttaagtgcgcgataatcgacgcacatcctctttgtcttatcctttttatccacaaaaatgaccggagcgccccaaggtgaagtgcttggtcgtatgtaccctttctgcagctgttcatcaacttgcttcttgacctccgctaattcgttgagccgccattctatacggtctcttatagattggagcggttcctggtgccaaatcaatccggaattcaatctccctcttgggtggcatggtggtgaggtcttcggggaacacctctggatactcgcagactatgggtatgtcctccaattttctcaagttcttctattcggtgtccactgggatttccgtctcaatctgattcaacgaggctcctttctttggcgagactagagatttgtacaccacggtttctcctttctcattggtcagggtgactgtgcgattcgcacaatcgatgactcccttaaacttggtcagccaatccatcccaagaatgacatctaggtctttggattcgagaaggatgaggttggctagaaacggtgacctttgaatttctattgttatagaagggctgaattgaaccgaagtggagctattccctggggtatgaacccgcatcggtgtgctaagttcctctcttattaacccatgcatcccgacaaatttcttggagatgaaagaatgcgttgcaccagaatcaaaaagtactgttgcagggattgagttaacaggaaacgtacccagtacgacctctggtgctgcttgtgcctcctccgcagatgcgtggttgacacgagcctggataaaccttggtccggcacgcctgggcttcgggcatttgtcagcgaagtggccaagctcgccacagttgaagcaggaccctggttttgctcccgtctccttcttggcttgtgcgggctggcctgactgtgccggtgccattggtgggcgtggagctgcaccgcggttgggctggcctccatggtggttctgactgccactagtgccctgatggaagttgctagggttgaacgggcggtgctggcggacgatcatggtggtaggtccaccctgctgtccgggagtgaagcgcggtcggtgctgactaccttggttggaccggaactgcgccgcctttcttt

SEQ ID NO: 16065 - DNA, 1829 bp, Oryza sativa
  unsure (1)..(1829): unsure at all n locations
gattgattgccccagccgccccatcaagttgaccaatgcaaaagaagaggtggtaaccttccagtctccagtgccgcggaagccagggattagtttaaaccaggctgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccaacgagttggcggaagtcaagaagcaagtgatgaacagttacagaagggatacatccgcccgagcacgtcgccttggggttctccggttatctttgtggagaagaaagacaaaaccaagaggatgtgnncgttgactaccgcgcanctcaatgaggtcanccatcaagaaacaagtatcctttgccaaggattgatgatctgtttgatcagttgataggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatactaatctactccaagtccgaggaagaacatgagcagcatcttcgactggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaagtggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagtcgttcatgctttaaagatttggtggcactatctcatcagtaaccgttgtgaggtatatacagatcaccaaagtctaaagtacatcttcacccaacctgatctgaattttcgacagcgaaaatgggtggagcttattaaaaaatatgatttgggaatacactatcatcccggcaaggcttatggggtagcaaatcccttgaccagaaaaagtaactgcaccgtccattggttaaaggaactatgctgtgaagttccacatgaattggaacatttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttgaggatgaaagaggaacaatctggatgggaaaaagattgtgtgtacccgaaaacaaggaattaaaagacctgatactaaaccgaggctcatcaaactcaatattccattca

SEQ ID NO: 16066 - DNA, 10392 bp, Oryza sativa
cagctcgacttgaatctccgacagcgaagatggctggagttgataaaagattatgacatggggatacaatatcatctaggcaaagcaaatgtggtggcagacgctttgagcagaaagagctattgcaatgcagtatgtaccgaaggcatgtgtgacaaattgcagcaagatcttgagcacctaaatttgggcatcgtggaacacgggtttgtagctgctctagaggcacggcctacgctcgtggatcaagtcagagcagctcaaataaatgatcctgaaatagctgagctgaagaagaatatgagggttggaaaagcccgagattctcatgatattgagcatggcacaatctggttgggaaaaagattgtgtgtacctgaagacaaagaactgaaggatctgatactcatagaagctcatcaaactcagtattcaattcatcccggcagaactaaaatgtaccaggaccgcaaagagaaattctggtgggccagcatgagaagggaaatatcagagttcgtcgcgctctgtgatgtttgtcagcgagttaaggcagaacatcagtgacctgcaggattgcttcaaccccttcagatcctggaatggaaatgggaagaaatcggaatggatttcatcactagtttgcccaggacatcatcagggcatgattcaatttgggtagtcgtggatcgcctcacgaaggtcgctcatttcattccagtgcacactacctatactgggaaaaggttggcagagctctaccttttaagaatcatgtgtttgcatggggtacctaagaagatagtatttgatcgagggagtcaattcacttcaaagttctacaagaagaattggggactcgtttgaatttcagcacggcttatcgtccgcaaactgatggtctgaccgagcgagtcaatcaaatattggaagatatgttgtgagcctgtgcacttgattttggcggagcttgggataaaagtctaccgtatgcggaattctcttacaacaacagttatcaggccagtttgcaaatggcaccgtttgaagcattgtacggacggaagtgccgcactccgctcttctgggaccaaactggagaacaccaactgtttgggacagaagtgctaaccgaggcagaggagaaagtcagaaccgtcagggaaagattaagaatcgcccagtctcggcagaagagttatgctgataaccgccgaagagagctcactttttaggcaggggactatgtgtaccttcatgtcaccccgctccggggagtacaccgtttccaaaccaaaggaaagttggcaccacgctttgtgggaccatacaggatcttggaacgcagaggtgaagttgcttaccagcttgagcttccatctaatatggctggtattcacgatgtgtttcatatgtctcaactgaagaagtgtttgagggtacccgaggaacaagctagtccaggaagatctgacagatgtggagaagccgatacgtatcctcgaaaccagtgagagaaggaccagaaacaaggtgatcaggttttgcaaagttcagtggagccaccactcagaggaagaggccacctgggaaagagaagatgaactgaaggccgcccatccgcacctcttcgccagctcttccgaatctcggggtcgagattacgtttaaggggggtaggtttgtcacgccctgaagttcccctttttgctttaaaattcataaaataaattgtccgaagaaatgatttaatttaacctagaggtgaatccctaaattaataaatgcaaataataatcggaatcgacatgtggaatttttcttggattctacatgtcaaaatatgctaataggatttttagtggaattttcagagccttggaaataattttacctaattaaaataagcaaagtgcaatatttaaatcccaggaaaatctttttttcctattcccctcttttctttttcctcttttcctcatttgggtcgtcggcccactcctcccgcgccgccctcctccttgctgggccggcccacatgtccctccctcctctctccgggtcaccgataggtggggcccacctgtcggcctcgtctttctcctccagccggcagcaacagccgccgaaaccgccgcccacgccgccgcttcgtccgcatccgcaccccactccgtgcccacacgcccccccacgtcgccgcccacgttgcccgcccccttcgtcgccttcccgcccgcgcgcgcgtgcccgcatagaggcgggtttaattttgaatcccgtctctatcgctctctctctctctccccaaattccccacgtcgtcaccggccaaatagagcccattcccggccacaaccgccccacccgagcccctataaagcttccccgcaaccccctctctcgtttccctcactcgccggctgctcccgagctctccaccgctcccgcaccgtgcaccatccatcgctgccatctccactcctccggccaccgctcgccgccgagctaagccgccgccgccaaagctaccccggccgccgcatcctcatccaatcccgccgccggaacgctgctctctccgtgcgccggtgagtttcgccgcccttccaatctccgaccggccacgctagccgccgtgggcttcctcccaacccctaagtcctctccattttcctccgtaggagcaacctccgcccgcctacccctccgcttgtcaggtcatcgccgccgccttcatccttcatgccggccgccgtgcctgctggtgagaactccctctcctccctctttccctctctcccgtgtgcgccgccgtcctccgcgcgcgcggcgtcgccttcggccgccgccactgcttttcgcgccgcccaccgccgcttctcgcgctggtagccgtcgccggcaacgacccgccgccgccgcatcgccatcatagtcatccggcttgaagccgagccgagcaaagccggtgccacctcctcactcatgagccactgcccagtgggccctgtctaccagtacccactacctcacccttgtgcctctgacccgtgggtcccgcacgtcggcgccgcccccctccttgatgatgtcagccttgggatgagttattgcgctataaattgattaagggtttttcttttatagtaaaaacacagataatcttctaaaattcatatctcattcatccaagctccgattaagtccattcaagtctcagtaaattcataaaaatgcatagaatctagtaaaaatggttttgtttcctatttcagtagacgtatagcatgttttgcttgtttgctttgtttgtcgcgtagatttcggccgtttcgtcgatccgcggttccgcgaagatgttgctgtggtctcatcaacacgagagcaaggcaagtcatgcattataattgatcatgttgtacccaatttacaaatgtcccacatttctatcaaatgttgcattattttacaatatcatgtgggatgggtcctactactcagccatatattgtttaccttatgccattgataacttgagttttaaaatgactagatgttggtttaggaaatgcttagccatgcttagttcaactagcacacaaagaaggaatcacattaaagcatagactttgattaatggcatagctttggaatagagccaccgcaatggtgttagttaattaaaatacactacacggtgggccgtgggtgaatggttttgctagtcgtgcccacggcgattatggatcagttcgcgggatgccttggaagaacttatcgtacttaccacaagccagcgtgggcaatgtcctgtcacggcctcttttcggtatgccgtggtggcatgtcgacgcacggaaatgtgtcgtggggctgtgtcttgtgggtacagttgtacacctctgatcagagtaaaactattcgaatagccatgcccgcagttatgggcggtcgaccagattcaacgtgattagtctcacccctagttagcttttgaactggtgtagttcaggtggttggttgggcctgttgcaacgtggtgtagcattcgacagtgattggttaatattgattaattactgcaactgttttactgctttcaactactgcttttaaatgctagctttatgcaaaagaacctttttgcctcccttggatatatcctgcatcatacctcctcttccggtatgacttactaagtacagggggtagtactcagtcttgctctcttttcccccactccagagttgaagtccttctcaattggatatgtctcgaagaagttggttttgtcgctgccgtcaaggatgcctgtggaaaggaatcgcccgctacaggagtcaagtcttcaagcttagctcgcttttatcttttccgctggatttgtaatcttttatattttttgtaagacgtggatctgtaggtcaagaattgtcgtgtgtgtaccctggctggtccaggataggggtttaatgcacattcagcttagaaattctggctcgtgaatttctgggcgtgacatctacctcctcaaatcgagctgtagatgtgccaccaggaaaaagaaatggaagtaagtgcgatctccctatcatcaacttggacatcttggacgctggtgaattggcaaagctgtgccatgaagacgtcatgcgtgcagcattggagtagtagggcttcttacaagtaaccaaccacggcattgttggcggctcttaaatgccgattctataccgccaacatctgcataaagatcagacaataaaacatccaacatagtgataggtgcttaatctcacgtatttcacaagtgttgatatatatttatatgcagatgataaactctgatgttgggaggaaatctagactaaagtgaggagaattctgtatccatacaaggatgggctgtgaacttcatcgaaacatcagtaaattagcccaaaataccaagaaatggataaaggagaaccaggggaggacatgggccaaaggccaggccagatggatgtcacgccctgaagttttcccccctttgcttgctttaaaaattggctaaataaatcgtccgaagaaattatcttaattaacctagagctaattccctaattaataaatgcaaataataatcggaatcggcatgtggaatttttttttggattctacatgtcacaatatattaacaggatttttagtggaattttcagagccttggaaataattttaaccaattaaaatggagcaagtgcaattttaaattccagggaaattcctttttctttttctttttctttttcccctctttttcctcctttttgcgaaatgggccgtcggcccatttcccttttcctcccccccctcctccttgctgggccggccgcaggccgaggcccagcccagtagccggccgcccgcctccctcctctcggggtcgccgacaggtggggcccacctgtcgggcccgtctcccacctcccgccgaccccggcgcgccgccgcgcccgcaacggctgccgcgcccacgcctccgcccctcccgggccacgtcggccacgtccgcgcgtgcgccgcgttccccgcgcccgctcccctctctctcccgctcgcgcccgcgcccgagatggccgggattcgaatttcgaatcccgcctctctctccgccccactcccccacgtcggccggcgaatcccgccgctcccggccacgtccgaccccctctccccctatttaagcatcgccagcgccccctctctctttttccccatttcgccgacccctctcgagctccccatcgtccccgcgccgtgcaaccacccaccgccgcttctttccgctctccggccgccgctagccgccgctagactcgccgccgtcttgcgccgtcgccgccgttagcttcgcgcggccgaggtccacctcgtccgcccctcctccgtcgaggttcgtcgccggaaccccctccccacgtgcacgggtgagcgccatccctaccgccgccttcggccatggaatccgaccgccggggtctacctccctctctctaatccctctctcctccttccttagggcacgccggagctcgtccgccggtcgccgtcgcctcccgtggcttgccgccgccgctcgccatcgccttcctccgcgccggccaccctcggtgaggcatctcctctcctctccttccccgtttccccgtgcgtcgccgtcgcccgcgctcgccgtcgttttgggtcgttgccgccgtccgctgccgccgctttcgcgtcgcctccgctgccggatgctgtcgccggcgacgcgacgcgcccgcaccgccgccgctagctcgggtcggccgatcggctttgacgccgatccgagcccggggttgccgccgccgtcgtccgtccgatcggcctgagggcgatccgggccgtcggttcggccgccacgtggcgccgccgccccatcctttttcccgtgccgctgaccggtgggcccgcgagccgccgccccctttctctctctcccgtgccgctgaccggtgggtcccacatgtcggcgccgcgccgccccgcgctgacgtcagccctggaatttattgcgtaataatttatttaaggatttcttttatagtaataaacacagtgaatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccacggtttctcgaagacgttgctgaggtctcgtcagtgcgagagcaaggcaagtcatgcaatacgtttgatcatattgtacccaatatacaaatatcccgcatttctattaaatgttgcattcttttacaatatcatgtggaatgggtcctattactcagccatttattgtaccatatgccattgataacctgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacattgaatggtgggttgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggtgcaagaggggaccgcccactgccttttgaggggtgggggtgaaaccttagcgtggtgtggatggttaggggagggttatgtggagggtcttgtcacgatccccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttcctgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagccgcccgctgctgaagtcaagcttcccggtttagctcgcttttatcttttccgctgcatttgtaatcttttctatttctgtaagacgtggatctgtatgtcaacaattgtcgtttgtgtaccctggctggtcctggacagggatttaatgcacattcagcttagaaattctggttcgagaatttctgggcgtgacaatggacctagcccaagttcggccaaaccaccaggttcggcggaaccactatctccaccattggatgtggggtttggcgtggacgttccagatgcatccctgatggcggttggagggcacttcggacatttcctcttcgccaaccgtcatacctacctctatataaaggcttcactccctcacttcacacacacacttccaaggttgagctgaattataagaggctctattgtactatattgtataatagaataggaagagagtagagtagaaggagtcggaagaattccggagttgtcggtaatcttctcctatttcttttaatctatttattactctgaattcaatataatattcttcttgagtaattagatttatcttgcgagaattacctcttggttagttcctaattagcatacgggattattgttcactataatcaactaaaatatagtgattgctttggtgagttataaacaccaaagtagatagtaattgctttgacgtggtgtttaggtaattgttatccagtaattgttgcgtatcccacagtacgttgaggtgggtgtagaggtggtgacagccctcgagatcaatgaagtcctccctgtccgggtacgtagtagagcgacatctgggaacagcgggttgccagtgcctgaagtattgcgttaggattaaaattaagcattccctagacactgtttctcactagtgaatcctctctatcctggactatcatttgcttggtgtccttggatgaaccagaggaacctctcatcacacacgttcccttggattcgatacccttggaatactccgtaggggaagtgctacatcggtatatccatgcgcttgcggattttatctgtaactgtatcaaatactaacaggcatggtgcacgcgctgctgcatgagcatcatgatgcttgggtgaccagccatttgcctgaaccgtgcggcgaagacataatgcacacaacatcaaagaagctgctcaacttctcgctagagagtaactgatgggcacgacgatgaccacatgtcaagagcagtcctcatgatcaacctagtggacaccattctcccccccaaattaaagaacatgccgccaactctgatccctagaatagtgactttatcatcatgctagacctcgagctatggcgaaaggatgcaacgtcaccttagttatctgcttcctcatgccccttcacatgtagatctggtagatgcataggggcatatctaggctaactctggcaacggtgaagaacatcctcaagtcgttgtccagggagagggatggtgggtgagatgaggtaaggcaagcgcatctactggagtgccggggtgggcccagcacctcccattgggccacagaaccctccccccaaccacgtggtgtgtaagatcaagtgcataattaagcatcaacttgtccattagcatcatatcaaaagaccagcgatggctcgccttctttgtgaagcttctttgcttgggttactcatgcagccacgggtaggcgatgcactgggctcgtctctctgacttttcgtcctcggtctaattgcctgaatggccatcgtagcgtcacctagtttcaccggtgagcatgtgtcgggacccggttttataacacagggatccacatgtcttcacaataccaactacctagatcggtaggttggcatacacatatataaacatatctgtgttgatggaaaacacgtggcctgggggatctgcttaactccagtgcaggtccaaaactcgccttcggatgtatgagcgtgctagttgatttgatcctgcaatcaacaagaaacaaagacaaagaaaccgtgattaaatccataaatgatagtcgatcggctagatgccgatgacatatcatttatctttgagccgatgtcatatgtgaatcgatcggcaattgttaaggaaacaagtcggaactatatctacccgatcggctgtagatatcaatgatatataatccttataccgacatatacttaaaccaagtgattgggatagatcggtcaccttgccgaagcagtataaatcacttaggttgaaatatatgttaataataagattatacatattcatagcatagccgatcaaatagatctagcatgtatcggctaatactccgatactactttatattaagatattaaagcaaatagaatat

SEQ ID NO: 16067 - DNA, 1077 bp, Oryza sativa
aagacgggatctgtatgtcaacaattgtcgtttgtgtaccctggctggtcctggacagggatttaatgcacattcagcttagaaattttggttcgagaatttctgggcgtgacaagttggtatcagagccgaccttgaccgtaggacaagccaactggaaacctaagagcctctgaacccctttttcatctgcatatgcctttttgcacctggaattgtttcgggaaaatttggagttttgcctctttggtttgcgggaaaaatcttggtcgttctttcggatcggattttttttttttaaaaaaaaaaaatattagctcagtctagggctttagaaaaattttagttggagtttattcgacagtcagtcgggaatttattgggggttatgcattaggtcgtgtctatattcgatgggggcaatgttatgcgcatcgttttccatgcaactagtctatgcattaatttattgtttagttgcattagtgtctttatttgagttcatgaaaaatgttctatgcataaaaatcatcatgctcggttatttatttgagttttcttttgctttgtttaatttgggtttgagcatgaattggttcctatcccttgtctactttagatgtcagtcctatccctcgtttgcaaagcgccgcctcgagcttcagagtcgccgcccttagctttatcgtcttcttagtctggttgcttgctagttttcgtgtttaggtttgttgcttgtgggctagtcggcggccgatatcatgtgtcagtggtatgactgcctcaattaggagttgcgtgcctctttttcagtgttttaatcaagattaagataattgcacttaaattcataagcaagattagtttctgagcccctgtttttcttccttttctcatatttctacctatccccttcagatggagataaggaatggttcacgcgactcgaacaacgccagtggcagcgaagagccgatcaatggagcacgtgccaacggtgcatcttacaacagtccgtccccaccgcccgagaacccaacaattgctcaggtgttggacaatcagactcagatgatg

SEQ ID NO: 16068 - DNA, 1361 bp, Oryza sativa
gttccattttaatcggttaaaattatttccaaggttttgaaaattccactaaaaatcctgttaatatattgtgacatgtagaatccaaaaaaaaattccacatgccgattgtgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaaaaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaatccgatatggtcccacaaagcgtggtgccaactttcctttggtttggaagcgatgtactcccctgagcggagtgacacggagatacacataatcccctacttggaaaacgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagcggagtacgacaccttcgtccatacagtgcttcaaatggtgccatctgcagactagcttggtaactgttgttgtacgagaactcagcatacggtaagcttttgtcccatgctccaccaaagtcaagcgcacaggctctcaacatatcctctagtatttggttgacccgctcggtctggccgtctgtttgtggatggtaagcagtgctgaaattcaaccgggttcccaattcttcttgtaatttctgccagaactttgaagtgaattggcttcctcgatcagacacgatcttcttaggtacaccatgtaaacacatgattcttgctagatagagttctgctaatttctttcctgagtaggtagtgtgcaccggaatgaagtgagccactttggtgagtcggtcaacgactacccaaatagaatcatgccccgatgacgtcctgggcaaccggtgatgaaatccattccgatttcttcccacttccattgtggaatatgaagtggctg

SEQ ID NO: 16069 - DNA, 244 bp, Oryza sativa
tccaaagttcgcaagtctatcggcagcttcattgttgtgtcgaagaacatggctgagctcaagtccatcgaacttatcctccagtttgcgtacctcttgtcgatatgccatcatgttgtcgtcaatgcaggaccactctttcataacttggttgacaaccagctgtgaatcacctcgaacaattagacgctttatccctagggaaattgcaatccgtagcccatgaaggagcgcctcatactcg

SEQ ID NO: 16070 - DNA, 672 bp, Oryza sativa
aaagctgtgccatgaaaacatcatgtgtgcagcgttggagtagtagggcttcttacaagtaaccaaccacagcattgttggcggttcttaaatgccgattctataccaccaacatctgcttaaagatcagacaataaaacatccaacatagtgataggtgcttaatctcacgtatttcacaagtgttgatatatatttgtatgcagatgataaactctgatgttgggaggaaatctagactaaagtgaggagaattctgtatccatacaaggatgggctgtgaacttcatcgaaacatcaataaattagcccaaaataccaaaaaatggataaaggagaaccaggggaggacatgggccaaaggccaggccagatggacctagcgagcttgtgaatcctctctatcctggactatcatttgcttggtgtccttggatgaaccaaaggaacctctcatcacacatgttcccttggattcgatacccttggaatactccgtaggggaagtgctacattggtatatccatgcgcttgcggattttatctgtaactattcaaatactaacaggcatggtgcacacgctgctgcacgagcatcatgatgcttgggtgaccagccatgtgcctgaaccgtgcggcgaagacataatgcacacaacatcaaagaagctg

SEQ ID NO: 16071 - DNA, 657 bp, Oryza sativa
cggaacgcctctctctccgtgcgccaatgagtttcgctgcccttcctatctctggccggccacgctagccgccgtgggcttcctcccaaccactaactcctctctattttcctccgtaggtgcaaccgccgcccgtctgcccctccgctcgtcgggtcgtcgccgccgccttcatccttcgcgccggccgccgtgcccgccggtgaaaactccttctcctccctctttccctctctcctgtgtgcgccgctgtcctccgcatgcgtggcgtcgccttcggccgccaccgctgcttttcgcaccacccaccgccgcttctcgcgccggttgccgtcgccggcaaccacccgccaccaccgcatcgccatcatcgggcggccgacttgaagccgagccgagcaaagccggtgccacctcctcactcatgagccactgcccagtgggccctgtctaccagtacccactacctcacccttgtgcctctgacccgtgggtcccgcacgtcggcgccgcccccctccttgatgatgtcagccttgggatgagttattgcgctataaattgattaagggttattcttttataagaaaaacacagataatcgttctaaaatgcatatctaattcatgccagctccgattacagccattcaagtct

SEQ ID NO: 16072 - DNA, 578 bp, Oryza sativa
tgtcacaaatctaacacaaactaaacggatactcaactctcatcaaatctattgagctccaaatgtggcacatttcatcatagctgaccgaactattacatcttactccaggttttatgtctcacatgcaagtgtggcgcagtagttttcaacaaacaaccatcctaccccttactagctccttgggttttgggtcttcccatggctccatgtccgcgatctttgtcgccatggagggcaccgctattgaagtagtttttcacccttgttccagccaatatttttttcctcagctccatccactagtggctttgaaattgttaggcaaactttttggcaagttaccaaaaaaaaatatatggctagctagctagctagttcgataggtttcctcatgttgccgccactgctatacgtcgaatgatttggctgtgcagtcacaacgatattattttttcaaccaaaatgattacatttatatgcagaacatataagcttccttgctagtcatgtctatataagcacatatatattatatattttttagcggaaatttagttatcttttagtatctttca

SEQ ID NO: 16073 - DNA, 1788 bp, Oryza sativa
gcagatactaaccttttcttgagttcttcaaaactttggttgcactcagctgaccacttgaatttttcatctttctttagcaactgtgtcatgggtctggcaatctttgagaaatcttcgatgaacgacgtttaataacccgcaagtccaagaaaactctggatctgagaaactgtctttggtggggtccacttagtaactgactccacatttgatggatccactaccatgccttgagcagaaatgacgtgacccagaaatttgacttccgataactagaagtcacacttactgaacttggcatataattggtgctccttcaatttctcgagtaccagacggagatgttgctgatgttcttcttttgactttgaatagatgagtatgtcgtcaatgaacaccacgacaaacttgtccaaaaattccataaacactttgttcatcaagttcatgaagaaggccggtgcgttggtgagtctgaatgacataactgtgcattcaaacaacctataccgagtggtgaaagctgtcttggcaatatcctcttcccgaattctcaactggtgatagcctgatcgcaggtctatcttggaaaacactttagcttcttttaactgatcaaacaggtcatcaattcttggcaatggatatttgttcttgattgtgacctcattacgggcgcgataatcaacgcacatcctcttggtcttgtctttcttctccacaaagataaccggagcaccccaaggtgaagtacttgatcggatgtaccctttctgcagctgttcatcaacctgcttcttgacctttgctagctcattagctgccattctgtacggactcttgtagatcagagcagttccgggtgccaaatcaatccggaactcgatttctctctttagtggcattgtagagaggtcttcaggaaacacctcagtatactcttgtactataggaatatcctccaattcctttagacttttcttcactatttctgtctgatcctcaattgcagcctgattcagacttgctacagactcctgcgacactggagaaaggaaggtgatcttttcccctttgtcgttggttagggtgatggtgcgacttgcatagtcaatcacccccttgtgtctggtcaaccaatccattccgagaatgacatctaggtctttggattcgagaaggatgagattggatagaaattgtgaccttttgatctctatagacattgaggggcagtagtgtgcggtgttcatgtcatctccaggggtatgaacccgcattggtattttaagttccactacggataatccatgtgtcccagcaaacttcttggaaatgaaagaatacgaggcacccgaatcaaaaagaactgttgccgggtgtgagttgacaggaaatgtgcccagcatgacctctggtgctgcctgtgcctcctctgcagacgcatgattgacccgggcctgaacgaacctaggtctagcgcgcttcagcttcggacacttgccagcaaagtggtcatacttgccatagttgaagtagggtcctggctttcttgcagactccttcttgagctgttttggctgagctgacacagctggcagttctgactgagccggtgccattaatgggtggggagttgagttgtcgttgccctgctcacttctgtaatgactgccaccattgtagtcgttgttgaagttactcgggtagtagggacggtgctgtcagacgatcagggtggaaggcccaccctgttgtcccatcatgaagcgaggcttctgatcg

SEQ ID NO: 16074 - DNA, 11551 bp, Oryza sativa
ccatcaggagggggataggtagaaataagagaaaggaagaaaacagatggctcggaaactaatctttcttataaatttaagtgcatttatctgacttgaattaaaacactgaaaaggtagcaaacaactcctaattaaggcagtcataccactgacacatgatattgaccatcgactaacccacaagcacaaacctaaacacagaaactagcaagcaaacaaaactaagaaaatgataaggctaaaggtggcgactctgaagcttggagcggcgcttgcgatcgcagaataggtctgacatctaaagtagacaagggataggaaccaatacatgctcaaatccaaattaaacaaagcaacaaatgactcaagtaactcgccgagcatgatgatttttgtgcatggaacatttttcatgaacccagacaaaagatactaatgtaactgactaaacgataaattaatgcacaaaaatacatgaatagctataatgatacgcataaaatgtccccatcgaacctagacacggcttagtgcatatcacccaacaattcccgaccgactatcgaataaattccgaataaacttttactaaaaccctagactgtccctagtcgagaaatccaattaaataagtgaccaagattttcccacaaatgaaaagaacaaaccccaaaattttcccgaaacaaattcaagtgcaaagagcatatgcagatgaaaaggtttcagagggctctttgggttttccagttggcttgtcctacggacaaggtcggctctaataccaacttgtcacgcccagaaatacacgaaccagaatttctaagctgaatgtgcattaaacccctgtccaggaccagccagggtacacacacgacaattgttgacatacagattcacgtcttacaaaacaatataaaagattacaaatgcagcgggaaagataaaagcgaactaagcctgaagacttgactcctgcagcgggtgattccattccacaggcatccttgacggcagtgacgaatccaacttcttcgagacatctccaactgagaaggacatcaactctggagtgggggaaaagagagcaagactgagtactactcactgtactcagcaagtcataccggaaaaggaggtatgatgtaggatatatccaagggaggcaaaaaggttcttttgcataaagctagcatttaaaaagcagtagttgaaagcagtaaaacggttgcagtaattaatcaatattaacaaatcaatgtccaacgctacaccacgttgcaacaggcccaagcaaccacctgaactacaccagttcaaaagctaactagggatgagactaatcacggtgaatctggtcgaccgcccataactgcgggcacggctattcgaatagttttactctgatcagaggtgtacaattgtacccacaagacacagccccacgacacgtttccgtgcgccgacatgccaccacggcataccgaaaagaggccatgacaggacccttcgcataaccccctctaatcgatcgcaccacacctcaggattcgcccccgtccccagcaggcaatgggcagcccccctctcatgccgcggtgaatccggaagccaatcaaccagacaccccggccgacccaactccatcacgcccaccctcgcctgggtacatcggctagaggaaagctacactacaagcccagccgttgcccacgctggcttgtggtaagtacgataagttcttccagggaatctcgcgaaccggtccttaatcgccatgggcaggggtagcaaaaccatgcacccacggcccaccatgtagtgtattttaattaactaacaccattgcggtggctctattccaaagctatgccattaatcaaagtctatgcattaatgtgtttccccctttgtgtactagttgaactaagcatggctaagcatttcctaaaccaacatctagtcattttaaaactcaagttatcaatggcataaggtaaacaatatatggctgagtagtaggacccatcccacatgatattgtaaaataatgcaacatttgatagaaatgcgggacatttgtaaattaggtacaacatgatcaattataatgcatgacttgccttgctctcgcattgatgagaccacagcaacgtcttcacggaaccgcggatcgacgaaacggccgaaatctacgcgacaaacaaagcacacaagaaaaacatgctataagtctactgaaacaggaaacaaaaccatttttactatattctattcatttttatgaatttactgaatggacttaatcggagctcggatgaattagatatgaattttagaagattatctgtgtttttactataaaagaaaaacccttaatcaatttattgtgcaataactcatcccagggctgacgtcatcaaggagggggcggcgccgacatgcgggacccatgggtcagaggcacaagggagagggagggggtactggcaggcggggcccaccgggcggcggttcatgggggaggaggtggcaccggccaggctcggctcggcttcaagtcggccgcccgatgatggcgatgcggtggtggcgggtggttgccggcgacggcaaccggcgcgagaagcggcggtgggtggtgcgaaaagcagcggtggcgccgaaggcgacgccacgcatgcggaggacagcggcgcacacaggagagagggaaagagggaggagaaggagttttcaccggcgggcacggcggccggcgcgaaggatgaaggcggcggcgacgacccgacgagcggaggggcagacgggcggcggttgcacctacggaggaaaatagagaggagttagtggttgggaggaagcccacggcggctagcgtggccggccagagataggaagggcagcgaaactcattggcgcacggagagagaggcgttccggcggcgggattggatggggatgcggcggccggggtagctttggcggcggcgaagctaaccgcggcggcagcttgattctgcggcggctctagcggcgacgagcggtggccggagaagtggagatggcggcgatggatgggtgcacggtgcgggagcggtggagagctcgggagcggcctgcgagtgagggaaacgagagatggcgttgcggggaagctttatagggcctcgggagaggcggttgtggccaggaatgggctctatttggccggcgacgacatggggaaggtggggagagaaagagggagagagacggaattcaaattgaatcctgcctctatgcgggcacgcgcgcgcgggctggaaggcggtgaagggggcgggcgacgtgggcggcgacttgggggggcgtgtgggcacggatgcggaggaagtggcagcgtgggcggcggttgctgccggctggaggaggaagacggggtcgacaggtgggccccacctgtcggtgacccggagagaggagggagggagacgtgggccggcccagcaaggaggagggtggcgcgggaggagtgggccgatggcgcaaaggaggaaaagaggaaaaagaaaagaggggaaaagaaaaaaagattttcctgggatttaagtattgcatttttcttattttaattgtgtaaaattatttccaaggctctgaaaattccactaaaaattctgttagcatattttgacatgtagaatccaagaaaattccacatgtcgattccgattattatttgcatttattaatttagggattcacctctaggttaaattaaatcatttctgcggacgatttattttatgaattttaaagcaaagaggggaactttagggcgtgacagtagacaaacctgtcgggtgggctccttaaggtgtgctgtgctggcatgcctacgtgtctttccacgtagtcaaaagtggcaaatagttaagaaactcccctctcttcgatgacaattttgttgggatgaatacataaagtggtatttggaaagtggtattttgtaagagtggcaaattgtttaattcgtaggagaatgaatgaattgagaaatggatcagttatggtgtggtaaaagggaataaacaggtgagacatgattgatgttagtgaaaacttaccgtatcctcagggttaaaggatgcggggtgggagaggcgcagtggacctaacaataatagcgtgtatgtagctcatagttctaattatttaaacttattctcgattataatacacaatggaattatgcatgtgtagtttattttgtttgtttgaatgtattatatttttctctagtaccaattatgtataagagggatattatttccgatagttgatccaaagtttatcaattcttcatcttctatagaaaaataaaaagatggcttgactaagctggatcaatgagagcaacgtattttgcttagtttcacccagacaacatatcaactgtcctcttgtaatatgtatgtcggcttggatcggaggcaaccagcctaaagatgggacacagttgttacaactaacaacattgtagtctagaatatggtatagtaatacagtaacatgaagctcttaaatatttctcgatatttagaacatggaacaaataatgttgttatagtataccaaccttacatgagtatagagaaagtatgtggacttccaacatggaaggacatatacatataagaggcacattatttattctgtaagtaacacaacatggagttcttgctccttgcatctcaagtattacttgctcattgccttcattcctttcatgtcaagttaatgacaaatgaagttgcctatgttagcaaagccacaaacacgaagtatcgtttggatggagaaaccattagggataacaccaccactgaacttgaaggaatcacataggcaactggcggcatcagtgctagatagactggtgatcggtggacaacaatcctgcttaaccaaactcggggagatgagcagagttgacggatcaagttttgcgcacacgttgagcgctaataccttttcttttgggcactgaccacctctggatggaggtggcggctgtgatatcggtggttgtgatggagttgctggaggtggaggtggcatggtttgtgttggtggcggcggaacactgtgcggtggtggcacccgcggcggtgtacgtgatggtgttggagctggagcgggcattggagttggttcctcgctaacaggagttggcggtggaaccctttgtggtggtggtgcatgtggaggtgcacgtgatggtgtcggagtaaggttaataggtgttggtgctggagcgggtgccggtgttggttgttcattaaccggaggtggtgatggaatcctttgtggtggtggtgcgcgtggaggtgcacgtgatggtgtcggagtaacagtaacaggggttggtgctggagcgggtgccggtgttggttcttcactaaccggagatggcggtggaaccctttgtggtggtggtgcacggggaggtgcacgtgatggtgtcggagtaaggttaacaggtgtaggtgcaggagagggttccgcagttggttcttcgttaaccggaggtggtggtggaaccctttgtggtgccggtgcacgtgatggtgttggtgtcacattggtcggtgttggtgcttggccgggtgccgatgttggctcttcgctaaccgaaggtggcggtggaaccctttgcggtggtgatgcacgaggaggtgcacgtgatggtgttggagaaacatttataggggttggcgctggagcaggtgccggtgttggttcttcactaaccggagatggcggtggaaccctttgcggtggtggcgcacgcggaggtgcgcctggtggggttggttctggtggtggtgtggcacttactggtggtggcggtggtattgtttgtggtggtggtggtagcggcggcgggggtgcacgtggcgggttccttctgggaggtgttgcaggttgctgggccttggcaaaagaagagagcgtgagaatcacgacggcgaacaggatggcattggggactgccatggctactcgccgtggtgctcggctctttcctgcctttgaactgatgaagtatatgaagctatttataggctaccgctagccgctttgcaatgttggtggtggcttggtacagcttatggtcacaactggattggaattttgcctcacacaactcggagacttgtagcaattgctaattaatcgtagcacgtgtacacaaagcgtactgaccaattagatagcatcaatcatgcttaccttcaactatcgaacagtgagctcaaggacattttgggtcactctcgaatttattcaacatttatgggcaacatggcaggaaatgcttagatgctggaggagggaatttgtcctattggtcctatggctcccttagctgtgcatatgtacatataaatcgttcctagcagggacacagctccaaagcaaataaaatcgacgcctgttctctcacctattctccattgcatatgcatggacctgatacaaactttgttctaatttgatttacaagaaacagttcaaatcttgtaagaacctaaaatcaataggtgttccgaaagaggtggaggcatatctttacccaggtggaactccattaagttgtttgctgggtataaatctgcatgcaaatcaatataaaagatataatatttttttgaccattaattacaaagacacatctattgttagtagtgatactgctaggttgagaaccactagataaaacatttactctcccgtttcagattacttaccgttctaagttaacaagtgaagtgaattatatagtgtgaacatgtttctcatggtgattctaaaagtataaatctaacgatgtttaaagataaagatataagtttatagaatttgatggtgaaagattaaacttgtttgatatcaatgacaactaatttagaatggagggagtagtgtcttactcctttcgtccaaccattaatatatataagcatttaaattctgtaaaaatataagcatttatacactactacatgttatgttaatcacctctcatttaaatttcttctgatcttttgtctaatcatcctttcactcccaaccatatatgttattataggggggcactaacaatatttctccgcaacctaaacttttggtaaattactaaaaaaaagctttggaaaacaactgaaaatgcattatatgttggatggaaggaccttattgagggatgcaaagaatcattccataaagagattttgcgccactaaaataaaatgcacaccttatatatcattcactctagggctagttttggtataggccatatatagttgccgagaatctggtccatatcatttcgttgacacgctctaagggtcattagatactatatccatggcttaatttttggtgagtcacttctatccatgtttcttggctagtagggagtcaaatcatagacgtttccgttgcacgtcaccacacagttagccactggctcctctgacgggtggggaaaatatgtataaaaagtccatttcacaatataagttattctataacttttcacatttagattaatgttaataaatctagacatatatatctatttagattcattaacatcaatatgaatgtggaaaatgttagaatgacttacattgtgaaacggagaaagtatgaaggactgactccaattctatagaaaaatttattaggtagtgttgacttttttcataaccaacacaaaatcacccaacgatgatttacggtgtaaccaatggagtcgacaaaatcgatagataaaaccagctagctgagccaattttgaatttaatttactttcgcgtaatcaaacaactattttatgagcaaattaacaaagaagataaatattgtacttttctaacgaaagaacaactagcgtctgagcaacctccgcgctttagtggataagcatgacccttttttagtgcaaaacggcaaaaaattaaccaaattttagaattgctataagtcagccatgcaaacaaaataaaaattaacataaaaataaaagtaaagaacagaaaaattatagattgataaattgtttggggtcccttcccaataggtcatcaatggtatatataccagctgggccttaatatttgggaaatctagtcagttccacacaaaatatatctaacttcaaccgaaaacgaaataaactgatcgttatctctaactcatcaactcctatgcctaagataatcacatactcccttcatcaaaaaaaaaaaatctaggagggtatgtgacccctccttatacacatcaaaaaaaaaatctaggagggtatgtgacccctccttatacaacgaatctaagacaatcctctctgtctagattcattgtactaggaggggacacatcctttcttaggttaggaggggtcatatcctatcttaggttaccttttttttttatggagggagtacaccatttgtaattcagccaagcaacgcaggataaggtaactatacggactcccacaaaacgcgacttatttcgaaaacgcttcgtatcttatgtccgatatggacgaaactctggacggtgggacccatagccgaaacctttccccaactttatcctcattcttcggttcttcctcatccccaaccacactagcgaagttaactctcgcggcgaagggcagtgggacctgatccaggacggtgcggaggctgctgagtcggcggcacgcgccggaggcaaagagggagagtcaggtgacgagcggggtgccgaggaggacgaggccaacgagcaccatccacagctacttgcgcatgcgccgggtggaacaccaccgcccaccacaccagcacggccgcgcccaccactcccgttgccaccacgcgcgccgccatggccaggcacgaccacgtcaaccacatcctctcccccgctgccgccgctgctcgctgctgtcctcctcctcctctcgcctccacgtccaccttgttgactggctccctctcgtggtgcgccattgcgagcacactgctggtgaatatactattttctggaggggggacctaaggaaggagtcgccggcagccatgtaggtggcggcggccgacggagaagcacgaagcgaagagggaggagggctctgaggtcggcaatgaaggtgaagaggcttgtggcaacgtcgaactagctaacgaggattgttgcacactacatgtttttttgttacatatagtgtgttcgtgatgttggaattcgttttttatgtttcttaaatcagtactagatgttgcatttggtttctttgatgttccacatattgggttttactgagtgttacatttaattgaaacatcttcaataaagcggtgaaacattcttctgtgaaagatgaaacatcgagaaacaattaatgttgaaacattttttttcgagctatgaaacattacagcatttatttaacatacagtgtaacatcgtttggagatttcatgttgaaacattttttttgagcgatggaacattgcaacattcatttaacatacactgcaatatcatccgaagatttgcaaatatctggacgaccgatgcgtagcactatccgaataatttttgtacacagttccatgcatgtagcgtgttcgtcctcctgcacagcgggtcccacgtgaagaaaatgtggagccaaggaaaagatcacgcacagtccaacaaaagccatcctgcatcctgcatccagcaaatttggatggctgcatttcatctgcttcctttgcatgcatataatcaactcaagcacagttatatcagctgcatcggtacatatccaatataagccaaatgcttcagtagctagcaccaaaaaccaatacatccactactaaaaaatatttttttcctaacgctatgatttatttttctaggtggactataaaatcactgttgttaaaatagctaaaggtaccatgaaagtagtcccacctgcgaaaatcgattttttttagtcagaccacttaagagatctgcctacaaaatacaagaccttaagatgtctacatgcgacaaggttatactatataaaaatcatcacctatatctagccccatttccaccaagtcctctaacctctccttccctctctctcaccaaaaccggtctatcctcccacctctccttccctctcccacctcacactccacctccgaacaggcggcgcacgtggccccctcccctcccctccctttccctcccaaatccgacagtaagaggctagggcggcgatggcgtggaagcagcggggaggaggcactcacctctccccgctcctaaatccggctggagtaggggagagcggcagcggcggcgtggaagcagcgtggaggcagcgctcccctcccttacctccctcctcactcctacatccaaccggaggagggcgagcggcggcggcggcgcttccctcccctcgctcccttcctccctctccgtgctagattcggccagaggagggcgagcggtggtgtagaggcggtgacggtggcagctccactccctccctctctattcctagatccggctagacgagggggagcgatagcaacgttggcaacgctaccctccccttgctccctccctccctctcagatctggcacacggtgttggctctcccctcccctcccacccagattaggccggggggtgggtggggggggggagggcggtggcggtggctggcggctccccaccctctccctcccaaattatttttgtgttcgcttaaaatatttaagcaagcggatggatctagcgcctgcgaagatggagaagccgcctaccaaaatcatttttgcagactgaaggccacctgtgaaaatgacgtgttttcataggccttgaagtacaggcggggtgaatgtctgcctggaaaatttcatattgacctcttgttaaaatatgtattctagtagggattactccacatatttaaatggctcctaaaccaaccactcaacaaatttcctaaatcctaaagttagagctcactaaatcctaaaacttattatgcaaagatactccatcatcatccactaacaattaataaatttaaacatcatacaagcattttatattatctataattttataatttattaaattttatagcttttcaaattcaagcacgttaagtcatcatttcacataattcacataatatttcaatatgtctttccatcttttttatagtatcttatatagtccaacttaactcctaatttagtaaatgtgctctctctctctctcttctctcattaagccagatcacataaatatttgtgtccttaaatgattatacatggtccaaattctccgttcttttattctcttattaaggcccttcttttattctttagtcagcttaggattatgataatctagattattagaagtaagctgaaacaaacagatagcttattatgatatattattataatctataagctagat

SEQ ID NO: 16075 - DNA, 3869 bp, Oryza sativa
acaaacacaatagcctaggagatttgcttagctccagtgcatgtctaagggtttatgagatgcgggcgtgcctatcagtttgatcatgcaactgacaagatatagaaatagtagattaatgagccgatcggctggcaagccgatgaagtaagtccagccgatgccgatactagacgatagtgaaaggattttgagctatcggctatatgattgatgtagaatctgacacttgatgtaaatagagacaatcgactgatgatgatataatagaataagcaatgatccgaaggttaaagcatacatcggctggaggaccgacgtcatgaaatccaaacgattagataaacagtaaaatctttgttgcgactggctaaatccaatttgtatgtaatccttataagtcgatgcaacatccatataacttattggctgaaacccgatgaaacccttattggcaatcaaaaagcaggctagggattatggttctaaacatgacttagtagatcaaacttaactgatgcagcactaagtaagaaaatatacatctagacatgacttagtaaatcaagccctttgactgattttcagggtggtagataccttagctaatctaatctggtaaagcgatttagccgataccggcattaaccctaaagcgaatctcagccaatataagtaaatcgaactatcaaactagattaactaagatatatgatagataggtgcttatatggacaagatcagagtgttgaagccccagccccactgatgcaaacagccgtgacaagtataaaactcgttgaaaaagtagaaaagtaaaaagggtggcgatgcaccgaatttgtattgattgtggagatggtttacaatgaccctgggtggtgtacatatttatacccatgggtagatactggtccttattggacatgaaagaaactttcctaaagataaaaagaaaacataaagtccttatcggatactaaacacacttccctaaaggaaaaaggaaactaccagactattcctaattaatagataaattgccatgccgcatcctccttgaacttggtaacttctagacaaacttcttttagtagattaattttctaaaccgaatatagcaagaatctgactattggcgacttgataattctcatcggccgattccaggactccgttgacgagactgactctaggctgatgatgacttcggagcttaccaaatttcactgttaatagatcggcttcaaaatgttggttaaattagcaagatgtctagccggcgctttcagttgggccctttgttcttcaattgtccacggcaaatcggcaaacttttgcttttctgctatcatatcttgctgagtttgttccagctgagctaggaggtcatcttctttttgttcaagttcttgaatcttctgttgggttgatcttggaccagcaagcagttcatcaagtttggctttgtcttcaaggatttgttgtcgaatggcttcaacaattgtggatgttgtggttgtgatgttgcagtgttgtgatttggataatgacgtctaaacctaaaatccaccctataagtatatatattatgtaacctctgatctcaggagcgccaggactcccctcgctgctggctcgaggtagggttggtgtgcttgggtgcaatggaggttcgtagtccttctagcaggagtcgcaatgcgagagtgactgaaaagccgggctgtgacaaagcccatgtgttgggtgcgttacggagtgcgagattgaaagcatattccactgcagtgtgagtaaactaatctattcgaatagtcgtgctagcagttaatgagcaccgggaattgtagtattcttgactagactcatagatctttaatattgcttagattaggaaaggacgtgtgtgagatcttgcccgatgggtggagagatcattatgattttggaaatatggacaatttggatgcgagggtaacacgtaccaagcgagacttgggccacattggtaagccctcgatgtttaatgataattcaacacaactttgtttttattcaaaactgctaggtcatacgtttatgcaaccagaccaagccaacaatgtgcccctataattattatatgcgttaccatagtggtgacgtgctgagtatggttggtactcacccttgcaaattttacactcttttagacttagtcgatgtggagataccacatgagaacattcccgaggagggagaacccgaggagatgccttatgaactgatccccagtcgatacctgtggagtatagttggaccgtcgcagcttcgctttcgctaccatatcacgtcctttagttttcatattgtatcggactagacttggtctatttgggacccactcgggcttcccatgtaataatacgtatcgtaagactatgtgatgcagactatgttgtaccagattgttaacgaccaaatttggtaatatcagtatcggagataaagatgggatcgaagcggaatcgaagatgaggattgttgcagaaacagagtaaggatcggctggagtccggatcggctacgactgagatcggctcagcctgagttggactggttaagtgatacagccgattccagcaatacgacccgtgtacgacattgggttgagttgatgtgcttcaagataattgccacacaaggatagagtcctgggaaggcaattgtatctattaattaggatattttatgtaaattccttagagataaatatgggcaaaagtctgccgcaaagacttatggtatcttagagtttgttagagataagagtcgtgtccaatatggacatatcttgtaattctcgagtataaatagaccccgagccctatgtaatggttaacacacatgttcaatacaatttcggcgcatcaccaccttttttgttttagttttatttcgacgagttcttgctatcgggttgagctgcatcggtttcgatcttcaacaagaggtaaaacttgttatggcggcttgtgttctctcgagattagtgcttccatctttatgatactctaactttgtttatgtaatccatcaagttatcatatatcttgcataatgttcgacaatatcgtcatctaacttacaatcagctaacatctgctaccagaagacagccgattaggttaaataacgacgttggcttagactatatgagatatccaccaccctatgaaacatccagcggcttgatcgtctagatattgttcttcttttcatacttaatgttgaatcagttgagtttgatctattaagtcgtgcttagaatttcaatctctagcctgcttactggttgccgattagggtagtgtcggagtttcagccgatcttatctgatctaattgctctcgctctatatgctcaaataatatgctagatctgcccttcatgttaagatcttgtggcatttaagtatattagatctctgtttatgtcgcgaccgggaaaattgccttttcccgaacgctagtgtattaatccccgtcccaggaaaagccggggtacaccacacaaacatgatataaaagacacatctttattacatcgatagtatttacattattacaaaggcgctccaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcaacaggccacaccggagatgcataattaatgcaagggaggtgcaacggaataataatatagggattaagttttgcagta

SEQ ID NO: 16076 - DNA, 4812 bp, Oryza sativa
caactattatctgtgctctgaaaattccactaaaatttgagggctccttttagaccaaggagaatttaacaaaaattctccgggccacatttgaatttttcttgtacgtattttaaggtttgccaatttcttttcgaattttaattaattctattattccttttagaagatgatttttattttgggatgaatttatcagggcgtgacaaatccaccccccttacaagaatctcgtccccgagattcgaggaggctagcaagaggataggttgggcggtcttctcttcttgtctgacttcttccgttgcgtcttgacaaacttccagcaaaactttaccactcggaactgcttggcttgacctcctgttgcggatggaatcttctcttcacctgacttggaccagggtgcaccttttggctgactcagactaggttgcggtagttcagtgatgcttccgttccagaacttctcatgattcatatcttcggagtcaacctcggacaagttatcaacttcatgtcatgcgtcaacactagcttgtcattactaggatactatgtttgtcatcataagaatatcatgcttgttattcacttctaacttgccatcaactgtctcatattagctttcctggtctccggtgctaggtacttcggctattcgatgcaagggtcaaccactctaactataagttatgcttcccaagagaaccaatttatcccacttgacatacttcgacgtcttctccaatggctttattgctggatttgttattgtctaatcattatcctgccaaatctgaggcttcgctgttacatgtgattttaaactgacctctgcagactatcttcgaacatatcacttggttcataactgggaatagctcccacgaacaagcaactcagattcactttctttatgttcagtttactttccgctattctcttcatgttgtcatcagttagcactcaacgtattcctttacacctttaaccttgatgagttctttcccgttggatcatctcccaggacgtggcgtcgcctggtaaccggtgcttgcatttttcactccgtgtagcatctgataccgagtggaagatttcactctttgccttcatagaaacacttttacctaggtcatcttgctgacttaatgacaaggtgactgttgcggggcaattacaatcaggggtcttccttgagcgatgcagagcatgtttctgtttatcaatcacctttcggcctacttctttcatgctagagaacatctttgccaatctctttttatcaatcatctttcggcttatctctaacaggtggtattctttaatgtggattgcggacgcttctggggacgatgaggtcctttggcttgctgcctttcagtgaaaccttgatgtggttcgtcaaaaagctgcactgactaccttcagggaaatacattgcttgctatctgtatctatgccactagggtttagtgcttcctcgagatggggagcatccatattgttcttctgccatatcacctttgaccgttttctgatacctgatcgactaattaccaaccatcgactattatgttctagaatattgatgtcttcctggatcttcttaactgtttgcaggtatatccgaacctttcaatgtagaggcatggcgggtacacttatgggtttcattcaacaatccttatcttgatctgtaacaggcgtatccaaactcctgttccccaactactgtctcattggctttttaacccaacacagtttaattggttttcttttccatcaacaggttggttattaactcgaggttagaacatagttcctttgaaatgagaccctaggtctcctttatcagtaagcaattatacacataatcacatattcgcatcttccaaaagaatcctcatggaacttgtctgtattacacatttctccctcattacatgaatatgaggcactgccttaaacaaaaagggacggtgcttaacatcggtacattgtatcctcaacatgaatcatccataagcatagcaagctcactgtttatagacatgaatatatttatgtattgcattattgctgcaaactttcgattacaccatgataagtagcgaactgaaaaccacaaacatggctgctcattttgattccggagagatatagctggcattgttctagtgactgcatccttgattggttctgtgatgatgtgataggactgcataatgctatcattcacaggagaagcttccttctgattgctggttgaagcggatgacggtcttctgctgggtatcgccctccggaggttgattgcccttggctcggcctggagtaggtcggggagagacacaacttcttccatctacgacaattctttgctgaggctgtcgatgcagagaatggttgctatgatttattgccgagtcaggtgcagcaggaggagcattggtgcattgtttctgctatgggttctgattatcacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaacttccaaaggtacaacgcagatactggcctctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgtcgtgccggcagctatgtttctcggttttgggcacttgtcggcgaaatgacccattccttgacaattgaagcaacagatgtcttcccggactcggcattttcttttctcatttcgattcctctgtcctggcactggagttaggctggaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcatatagtggcacatgagctggcgacatgaccgatttctccacaacgagagcatgccttacgttccatttcatcttcatcatctgaggagacttgatctgaatcttcactatcagacactctacctccattagctaaaagatgttctgtcaactgtggtgcacctcggaaggtatttcttctctgacgtctggtcattcctggtggaggccattctgtgctggtaatgatcatcttacggacttcatcttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgtacttgaggttgcatccgactcgggttcaaaattggcatccgatgctgctgtagtatctctataagcaatttgttctggttaatcaggtgttggaccactgctacacaactggtgtctggtgcttcattcactcgggagcttgaggtaccaatgtcctgacttctgaccttattgcccttctcattgtcagccatctgttgcaaaggtttggagagggagagagggaaaacaaaggggagagacagattagaaactaaggataggaccttaaaggaactaactcttcttgctgatgtgttgtttgtttcacttattctgcaagttgattaagcaaacaacctagcatggttacatcacaccccactgatgcaaaccacgcgctacacacacaaacaaggaaacacacgactaacgactctaccctagagggcggcttaggttctgcgacgggttctccaagatcttcactcctgcttctcagctggcttcactgcttcctccacttcgctagcggatcctgcagtcttctggagcttcggcaaacaattgacgacatcttcttcttcgcaaacctgaccatctagtactagttgaaatctgaagaaggaagaagggagtaaaccttttgcaaatagcattaggggaaggagaaaaagaggagctttcgcaaatagtttcatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattacatcgatagtatttacattattacaaaggcgctccaggcctgacaatcaaaaataaacagcagcggactagcgggcctacggctccatcttcacaggcgctcaactggggtataagccaggactccacctaagacatcttctccaaagcttctcttactgaaaaggggaaggattgagcaagaatgagtacaaccacagtactcagcaagccacaccggagatgcataattaatgccaaggaggtacaagggaataataatatagggattaa

SEQ ID NO: 16077 - DNA, 5218 bp, Oryza sativa
  unsure (1)..(5218): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgaaataaattaaaacagttggaaacgaggtcacaaattttgtaattttgaataactggtttcaaaagaaagttataaaatcaacatactaaatttattttattgcagcaagattaaataaaacagtattgtaaaacttttgctggtaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaaataaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccttcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagaatgaacagtacatgtggatatttttaatgtgtagatctcaattttagaaaaatttagagacttgaaccaactaaatcggagctaagatgaattagttatgaatttttaaagattaaaccggattaaaacacttaaatcggtttaaaattgaattatgacgcaataatgaattatttttgaaaaggaaaaggggatttattgcgtcagcggctagggtttgggtggaccgggcgcatgggcggcggttcacgcgaacggacggccgagattgatccgatccaaatcggacggccgagattgatcgggtccacggcggttcacggcggacggccttgatgacgccagcaatgacgtcaccgacggcggcggcggctcggcgaggcagacgactcgagcggcgcacgctcaccggcgaacggcggcgctacggcacgaacggaggacaccaacgggtagcggacggcacggcgaactcaccgacgaccaaagcgacggcggacgaccaacggacggcgacggcgacgaggttgaaacggcggcggtcttcggcttgacgacggcgacgatgctccggtggtctccgacggcagcgaaagagcggacgaggacggcgacgacttggcgacgacgacggcgaccttcccgagcgacggcgacggctggaacgacggcggcgcacggctggagcggcggcggcgaaggcaaagctagggcacacggcgctagggctactccggcgacgagaggcgaaggcgagggtggcggcgagaagagaagagcacggggatccttttaaaggggctcggaggcggcggcggaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccgaagatcatttcccctctatcaattcagccggaaacggaaaggagcggccggattggaaagcggcggcgacggcagctcggcggcgcgaaactagggtttcggcccgaggaggacgacgggcctgacaggtgggatgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcggcctacggctccatcttcacaggcgctcaactggggtataagccaggactccacctaagacatcttctccaaagcttctcttactgaagaggggaaggattgagcaagaatgagtacaaccacagtactcagcaagccacaccggagatgcataattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccacattttagtgttgagcaaattttaagaattagaacactgacttgggtacattgctcggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccataactggcatgcacccaaaccccaccgaaaacaggttttaggggttttgaaagagaaagagaggtgtatgtccaattccaccataatccaaccattccatggtgtccaaaagatatgagaactcccaaagtctaaaattataaaaccacctaatgttgcctaattaaattgcgaagcatctacctaaatttaaactagtggaaccataaatagagtgtccactagatggggttttgtttaatctagggtgaacaaggtaataataataacaataacaataataatatggtcgtaacaaaggtaaataggcatggctaaataaaacagtgataacgcgggaatttaaataaagcgataatgcaataatttaaatcaacataattttacaaactgggattcaatatgctcaaggatgatgtgacttgccttgctcgctttcccaaacaccggcttcaacttccacgaagagcggatcttccgaagctgcagcgtctacacgaccgacggaaaagaaaaggcttttactctaataaactccaaataacagcataaacaaagcacaaaaatgggttctttacttcttaaggaaaaattagagacttgaacggtccaattccgagttcaaacggccaagatatggccatttgaagtttatatgctctttaaatggatatttgcgaatttcttcatttaattttcaattaaaaaaatcggattattgcgtcagccgaggggcgggcgcccggaccgggtccacgggaagaggggccc

SEQ ID NO: 16078 - DNA, 7805 bp, Oryza sativa
ggagacttgatcttaattttcactatcagacactctacctccattagctaaaagatgctctgtcaactgttgtgcacctcggaaggaatttcttctctgatgttttgtcattcctggtggaggccattctgtgctggtaatgatcatcttacggacttcatcttcggttcgcattggtgcttttcttttctgctgaggacagttccttgcgtagtgcccttgctcatcacacataaaacagatgatacttgcttcttttgggtcaacctgtggcatggcatgaggggccttctgggatgttggcggtgcgctgacttgtggtgtgagtgctgggactgcctccaactgcacttgaggttgtatttgactcaagttcagaattggcgtctggtgctgctgtagtatctctataagcaatttgttctggttaatcaggtgttggaccactgccacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttcagcgacaggttctccaagatcttcactcctgcttcacagctggcttcactgcttcctccacttcactagcagatcctgcagtcttctggagcttcggcaaacaactgacgatgtcctcttcttcactgacctgaccatctagtactagttgaaaatccgaagaaggaagaacggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcggcctacggctccatcttcacaggcgctcaactggggtataagccaggactccacctaagacatcttctccaaagcttctcttactgaagaggggaaagattgagcaagaatgagtacaaccacagtactcagcaagccacaccggcagatgcatgattaatgcaaggggggtacaaggggataataataggggttaggttttgcagtaaacagcatttaaaagtcacttagttgcccaaagttattttataaagacgatcctagagctacacaatattattaatcaaggccgtggacccacacgaacctgccttaacccaaggcctacgatgattcagaccgaactggcaacccaacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgagcttaatccttatagtggccggggtgctacttcccacaactggcatgcacccaaactccaccgaaaacaggttttaggggttttgaaagaggaagagaggtgtatgtccaattccaccataatccaacaattccatagtgtccaaatgatatgagaattcccaaagtctaaagttataaaaccacctaatgttgcctaattaatcagcgaagcatctacctaaatttatactagtggaaccatgaatagagtacccactagttggggttttgtttattctagggtgaacaaggtaataatatcaatagcaataataataaggtcataacaaaggtaaataggtatggctagataaaacagtgataacgcgggaatttaaataaagcgataatgcaataatttaaatcaacataattttacaaactgggattcaatatgttcaaggatgatgtgacttgccttgctcgctttcccaaacgccggcttcaacttccacgaagagcggatcttccgaagctgcagcgtctacacgaccaacggaaaagaaacggcttttactctaataaactccatacaacaagcaggaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaaatcgggtttattgcgtcagccgagggagagggcgcgcggaccgggtccacgggagtggggcccacgcgtcagcctctcggtccacggtggaccgggagcacgcggctggcggcggccggcgccgtgggtcccacgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaacggcgcggcggagcggcgcccaagagagaggagggaagggggaaacgaacggagcggtcctcggctcaccccgggacggcgaaggcggtggaaacggcggccggagcggaggaagacggcggcgcggctcgggatgacgatggcgacggcgctccgacggtcggcggacggagcggagcggcggacggggtcggcggcaacacggcgaagcggacggaggtgtcgccgagtaaggaggaagtccggagcggcggcggcggcggaacggagctcggcggcgatggcggagagaacggagcacggcgcgagcacgaatccgacggcgagggcgagcggcgagcggcggaaacggaagagcggagctcgggcaacgtttaaatagcgccgggggaaggaaagagcggccggagagggaggaaacgggcgcggagatctcggccgccattgatggcgccggcgaggtttgcgggagcgattccggacgaatccgagggagagagagagggaaaaacggggggaaagagagagggaatcgcggggaatgattcccccctcattatggcgcgcggggacggcgggatgcggcggaatccgcggcggcggcggcgctagggcacgggcgagcggcgggagcggcgggaggaaggcgatgacaggtgggccccacccgtcagcgagggcggcgggcgggcccgcctgtcagcggcgcgcgcgcgggggaggtgccgatgggccgcgggggagaggagagagagggagggagagttgggccgagccggcccaagagaggaagggggggaaaagaagacttttagggatttttctttttataaaccttttcaactttgtttatttcttaataattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattccttttagaagttgatttttatttcgggatgaatttatcagggcgtgacatgggacccacctgtcagcggctgcgagggcgcgcgcgcgcgcgggcggctgcggactgggccggctgggccgaggagagagaagagaggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattaaacttagatcttctcttcaagacttttaaaattatttctagaaattccaattaaacaacaatttatatattttgaattttcagggtgtgacaactaacccaaggtagctggtggcaagcaagtcaataggaaaagcgacaccccaccacctccaccaatacataattgatttttttttgacgagaccccctataggtgggccatacttgctcccgcctgcaaaaatcgtttccctaaggcccatttagtggctgcctgcaaaaatacattttcaaaggcaggcctttaagagacctgcctacgagtctgacctccatcctctcttccctctaaacatctttaatttcttccctcaaaaaacatttttcatttttttcaagtcacatgcttatctctttaccttctctctctccactcatttcccctctctctctctccaacttctcccctcctctcccattgctcgggctagcagggacatggctgggggcgacggcctagacgaatggtggtggggagggctcgggtggtgggcttgacgatcggacgtcacggagcggaggatccattggccgcagatccggtctgggcggatccaccggtgataggcaatggcgacggcggaccactctgcctctccatcctccctcccacggcttctaaataacatgagagcttcctaagtgcccaattattataggtctagaaagactagaggcaagccatctaaaaaatgtggcagcacaaatcataaatgttcaacaatgcaatagagaatactacaacaattataaaaatatgaaattatgacctccatgtaattcagcattattttgtgtaatagtatttggaacagcttacagtagcacatacaactaggcatgcatcatgcatgcacatttataaaatgacaactttatttattctataagtaacacctcatggagctctagctctttgcatggctcaggtattacttacttgttggcttcctttctttcatattgagttattaatagaatagcagaatatgttcatgcacgctcagaggaagcagccgaggttaccgagctcagccttgccacacacgctgagcactgcctcaaggaagaggacatcggcggtgacactgaagttaatcttcgcagcctcacataggcaaccagcggcaatggtgcttgagagactgttgattggtggacaacagtcttgcatagccttagtcgggttgttgagcagcgtggacaaatcaagttgtgcgcacacattaagtgcaattacattttctcttgggcattgactaccgccagatggtgttggtggctgcgtgggtgctatggttggtggttggctaggtgctacaactggtggtggagatggtgctataactggtgccggtgttggttctacagacaccgatggtggtgatgctctccttggtgatggtggtgcacgtggtggatttcttcttggaggagtttgaggttgtttggcttgggcaaatgagaagagtgggagaatgacaatggcaagaagatgacaatggaaatacttggctagctcttgttttgaaagttcttcattatctgatgctatttataggcagcatctggttactctgcaattcaatttttgtcatgtacggttccaatttgagtggaaatttctctcacgcgagttaagccaacgaataattatggtcacctttgtaccaatagtacttgccatttgctattttgatggtcaatcaagcacattttcaattgaagaacagtgaactcatggatatttttttttgagaaacacagtacaaacgcagacgctcacaacgtgcgcacgctcacccctatgaacgcacacatgcacaccctacccctatgagcacctccggaagactgggctggcatattttgagattgacgaagttaccacaggtgcctcgctgttgacgggtacgtctggatatttggggtcattctcttgaaacttgaatcgattcagtgctgatgcggctgcattggttgactagctgagatgatgcagagaatatgtgttatctgtcctatgcctccctaattaaactgaatgcacaagtgtagatcagatgctctgtttttttttttggcatagatacttgttgccaacaattaaatccttgtttctttcctttgtcttatcaatgccttcgaatggatgaattggattgaatctctgcaattactactattttactttgaagaaacagttcaaaactgatctggatttatgggtactagtagtcaatgaggcacgagtgatttaccttctacctcagtgaaatcctcttcccgttatatatgacctggcagtgttggatgttttcattagaaacatttcaatatgatcagagcatgtacatatttacggctagctaggaggacatccggtaacaaaagcttttgtgatggtaaaattgaatatatagcatctggaggtcccttttggttttttcaaatgttgtgttaaacaaggccctgtctcacccaaattcagtgaaagaaaaaattgtctagtttacatgaggcagttgattgccgtttgtatagatggctataaggcccaaggaccacgcggcccagcccgaagcacgccattttggcccggcccaagcacggcatggcccgactgggatcgtgcccatgccagcctagcctgacagctgggttgtgcctgggctgcaccctcggcacggtgggctggcccggcacggcctgatcaaataaaaaaaatattggtatgcaaaatagacttaaacaaccatataaagcaaggcccaaagagaagaggaatacataatagacttattttctagccatttgaacacagcccacacagttgagggacgaaaaatagactttttcttggagaagcacgataggccatcgtgtcttcgggctggcccggcacggcccaagttgtattgggccgtgccttggccatgtatgccacccgtaggctggcacggcacggtccggtgtgtcggtcgggccatgccggcccgactagcctcggccctggcatggccgtgccgtgccgggcggcccagttggccatctatagccatttggatgtcaaactccttttgcattgtttcacgaggatcctttccgcaagctgcagatgagcatc

SEQ ID NO: 16079 - DNA, 637 bp, Oryza sativa
gccatcggctaccgatttcatcatatttgacaaggtattagtcaacactccagattaattaatcaaagcattatacacagcatagtcaactcgatcttgaaagttattgaaaaaatcttggaatgcattgttattctgattaagatttcccccttgcggtccctgagtgccgttaccttgaaccccatggaccccttgagggttgtcgccttgatctcctggagagccatcagtagcacctttgttactcggctgggctgattcgtctagaacttgtttcttttctccctctttagaagaaccgatcccaaaatcctcaggaaccaccttcagcttgtacttctgaacaaatgtgcccttgcgagtttgcatgaatgaacttaaaaattgatctcgtgtttgctgcatcattgcattgaagtctttcttctgttcaggagtgaacttctctccaacgtggcgtagcattggacagtgattggttaatattgattaattactgcaactgttttactgctttcaactactgcttttaaatgctagctttatgcaaaagaacctttttgcctcccttggatatatcctgcatcataccttctcttccggtatgacttgctgaatacagggggtagtattc

SEQ ID NO: 16080 - DNA, 779 bp, Oryza sativa
tagctcatgttcgtaagcaaactcatttttttatatgttacagatactaaaatatggaatctctggtgcagaatttgaatttagtatctttttgtaactagagaacctgaaatgggcgcatcattttttcaaaacgatggcgagtatacaagcagaaacacaacccaggcttcacacgaccagcccgtcctcgtctctgttttgcatttgcacgagaaatccaatcttctactatgcttgacattttctgcaaacaaaatatgacaaaacagcttctattagatatgttttgagatgatttatcatatcaacacatgcataaaaaagttgataggctgagctcatggccaacttatgaatttcatgtgattattactccggtaaacatgggttaaagaagtccaacccatgagctcacaatgtagcctaatagaaccccacaacaaataatgccaagttgccaagcatcaagcatttttattttgactttcaaaagcattttttgtttatatagaatccaagcatgttacttcaatcagaatttaacttccaagattttaaataactaaatagtcaattttagtgcaaaggcatccagtagatagaattttgtaaagaaaaccacacattactaaatattaataaaaaaaacttgaagttttgatgacaacggacctaagggtaaatctttatggtagcagtgctatgttagatggaccagctgatgcaattttcacaagatccattaacagacaaagacaagaccagagtccaaaagt

SEQ ID NO: 16081 - DNA, 1891 bp, Oryza sativa
ataaagacaaaaaaaaaagaatttggttttacatgagaatcactttcaacttccttcctggttgattagaacgcttctcaacaagactcttaagaacaatcaacagaaagtcaccctgaaaactgggaaatcaggatcattcatggacttcctctaccatagaaacaaaagaaaacattgtctgattcgtaaagggaaaggacacaaacatgtacataccaaaatagtacgttcatgtacttcgtctactactacatgagtaacatcacttaaatcattgttcccctgaaattagcatgaaaaggaaataatttcttaggaactatcatcacatgacttgaaacacaagtggagggatgttataatgttagctttacatgcaataaaaatattgcacaagacaaactatgttaacatgacggcactacttacagataattttctaagaaggataccggtggtacagaacagaagctttgtcctttcattcctaaaacagtagaaagaacaaagttgaatacatcatagggatcttcaatgcaaaattacaagaattttttcacacatataataatgtgaatatgagaaagaccaaataccgagcactgtcaagacgaacttgatatccgaccaaagaatccttagatccaggagaagattcacacctctcactagacactctttcagccactgaaatggcctacaagtgagtagctataccacgttatattcaacaatctagatctgtttagtataagctgcgtgatcatcatataaaaaggatatctagcataccagatgatctcacagtaacaacactaagatattgtactttatgatgaatttattatcccagaagtgatttcatgaatatgacatgcaatttttatattgcctgcaatgtattgctaatatgctgcaccggaaagataaagaaaagatcaaggtctgcactgtgatcataccgctatcctccggggttgtgtgcagactatgctgcagtaaccaccaagctcagattcaatcatatcatccaaaataaactgtggcacctgcaaatgaaagataatataatcatgtaaaactccatgcttctggaaagatcagaataaactatacaagctggtattgcataacatctagtattgaatatctttctacatgttcaaggaatatatgcaaacctaactttgtaccaatagcagctagcatacctatcgtcaaataatagaagctgattggctgggagatgaagaatatcatgagatcagttcattaacacattccaataggtgaaaatggaccatggaaagaataagatcctaaaacacataggaaggcacttcctgttgaatatgttaagcatggccccgtatatcctagcctgttgcactcaattagtcaagttgttttaaaaacaatgtagaatgatagagtcattaagggaaaagtcaggtctatagtctagaaatcctagatcaagttaggcaagcaagtgggagtttcagagctacttggcttcccaaactataggaaaccacgactgccatcagacttgttatgacaagtttcgtgcagcagataattcactatttctcatgcctcaccatcaccaataatgtaaatattataatttcagggagccaaataaagggataaggcataaaaaaagatgatgttttgcacatgatatggttatcttttaaagctggaataacaactggcagcgcccaagaatgaagcctttgtgggggggtacttgagttgtcttcccacatccggtttctccgcaaacaacaatcacatcattttctttcagtaactgtagaaaatgatctttgaatctagagattggtagagaagctcttgcttccagcattgggctgcagga

SEQ ID NO: 16082 - DNA, 28855 bp, Oryza sativa
  unsure (1)..(28855): unsure at all n locations
ttgatcattattcagttaaaacaaaaaaaaagattatttcaattagaagaaaaagaaagatatagcatgaatatctcagagaactaatgaggtcaaaatacacggcatgcatgttgtgagcaagagaaataaagcaagattccaaatggaaatatagctaaaaggtgttataattctgtgaaaatagattctacataggagaaacctcattggtgtcgagaaagttgatagaatggagaagataagtctgtcatcagtgacagattaaaaggttatggaaggtaaaaaatggtcaccatccaaatcatgattgtttcacacattattcataaagacaaaaaactgaaatgatgattttattcaaagcttacctgtacgattcaccagataggtctctttcttctcatgaacagagtagctgtcctcgatgctcctagagtcaacagatgtagcaccatctgacgcatcctcaacttgatgtggagttgtattcgcatccatatccaacaacttatccacaaaaccagctcttcgactatcctcagtatccataacccttgaagatgatgatgataactcccctgcttttttgccaaaaccatgtaatatgtagcccaaaggccccaacaaatcgtgattcatcacagaagaaagcaagatcaatttatctaaccttcttgccatcttaaaacaagtgatgcatatggttcaataagcaattggcgcaatgaaagatcagcgaaaaattgatatagagcaaaagctgccactctgttttgtgcttcctgtcgaccaattcagcaaatgtttattgttcagaaatacaattctagacaaggaatgatgatatgtatattcttttctcagtattatgaaatcagaatagttaatactaacaagcatgaaaggtaaaaatgaagaaataaatctgaataagcagtggaaatgggatagcttcccaaacagattaacatgcactatcatatccatccaatgcgcattggggattggtgtgcctccaaaattaaagcaacgccccatcttctaagaattttgatgttcttgcacagaacattgagcactttggatgcataggatagtgcatggagccattgacatctgtatatatgaagacttgcatttctcattgaaataaaaacgaattgtttttatttttgagatattttagaaagtaacagagtgttcattttgtcaatactaacctcaacagatgcatattctttatcttgttcagttaactcgacttttgtcaagcctccagccttccgacttttaccacgaccagtagagccacgcagtacattaacagcatatatgaatttacgatccttttcagatattttactgtattttggcgcttcccaaccaagtttctgacagaatttttgcagaacagcctttggcattttaccagaatctccctgcagaccacaataaatagttagaaccaaatgcacgccagagattaaacagctttgttggttcattgtttatttagcaatatttcgaattgttacattctgcccattgcccaaataatggatctcctcaaatatcgttacaagtgagatatgttagttgtgttctcttctcactgtctagtacggtaatttactgaaacttgaatggtttatatgcagcttttaggagcaagtagcatggaacattgcagcacataaaggccaccccaactatcctactccgtatacaacaaggtttctctaacaaaattgagagaagcggcattataatcaagaaccaagacagcaaaaacacctccaaaattctaaagataaatatgacaataggaggaggggcgttaatataaagtggtgcagatgcacatgaccttcttccatatatcatctatgtttccaagaagatgcccataaccatcatgtgataatttctctattttttgctgttttagtatttctggagccactgcctcccaagcagaagagtcttcaaaaaacaggttatcaagttctacttcctcttcttctacctcctttgtgctggtttcatcaacatccttggacatttttttctccaaactggatcctccatccatatggacaggactctcacatttctttccagttgcaccagagtcaactagatcaccctcagcatttgcaatatcagaatttggaaagacattatctgaactgctgagatcttcctttgagtttccagatgaggatttcgcttgtttacctgaaaacaatcaaacaagaaggcataatataaacctgcctgaactacatataagcattcaaaacctagtcacaattagaagagaaaattcatatggttcactatagaatcgatatccttcaacaagtattatgtgtacccttcttctttcgcctacttggctttgcctcagcagtttccaaacttggtgggcagtgatcttcccatgtgtaggaatcattagaattcacatcatcttcctaacatcagcagcaagaaaaaggaataattgcaccaatatacattaaacaggaattaaaagaaaaagaagagagatacattgaataagcttaatctcgaagtttagcggagcaccatccaattcgtagtggattgaaatgcataagatgtttgtcactaactttaaacggcattcagtacattagaatatttcaatcacaaatgtaataaggtatgtcactataattacgttcgcaacataacgcttcctatcatgtttacaaacatattactgcaaaataaacagtcgaacacgcatattggagagcattttaattaatgaagagttaaaagatgataaaatatttaaattggtgtgacggagagagagtcccaaagtattactatcttgtgttaccagcttgatattaaaacaatacaagatattttcaaggagtgaaaatagaatacttgtcagataaagcaaaattgcacaagattaaaaatttaaacagtcattaaaagagtatcgatattcaatatttgatgcagcaatccaaggaacaaaatcacttgtttgaacatctgtcacctatacctcctcttgttgttccatgtactgccgaatccatgcagcttgtgatgattgcccgtcatccaatgtcacatcttcttctcgccgcctgctaattataatttccaacctctcattgctcccctgcacctcctctgactcacgactctgtggcacccaattgtctttcgctgttgatactaccttaactgagccttctgtccctaaaggccctagaaaagtaatgaacagctgatttaaacatgatagacttcttttttagataatggatttataaaacgcagactctaaagcatacacagccaaaacatgatagacttaacactcaacacttaaaagtttcgaaccaatccatgcctctatgagaaaacacaagcatgagcacaccaaccctgcagttcatgggtgtgtgcatacgtgcagaacctaaaatgcagaataactgcagcgcaaatacaaatgcagcaaaatatgtaaagcactacttcaaacttggaaccagtaaagcacagaacgcaggcaaatcattgtatgcgcagaagcatatattgcaacttcatgcatatgatctgacaaacatgttgatgctggcaaatgcacacgcagagatggcagagttcacagttcaaacagaaatgagactagacagtagacacgaagcgctaagccctaaacccgcgaaaccgcataccagccccagaagaggaagcggtgccactggagaacttgagggggagctcatcgccgggcagattaaagcacagccaatccaacgccgactcgaacgtagccgaatcctgcacccaaaaattaaaccccaaatcatcatcaacaacagaaacgaccaaattccatcgcacggcgggtgctcaacgagtgcttgggagcacgaaccgatagcgcggagagcgcctgctcgatttgcgcggaggagaagccctcgagggagagcttgtcgtacaccccgcgcagccgccgcgccttctgctccctcgactcggcacgcgccgcgggagcatccgccggcgcgggcgctggcgccgcggtcgctccggagttgaggagcaggcggcggaggcggcgctcgttctccgacgagatctggagccgcggcgcggcggaggcggcgccgccgccggccgaggacgacgaggaggaggtggaggagtgcttgggcttctgcttctgcttcggcgcctgctgctgctgcttcttcttcggcgccattccgcctccgccgagctcggcctccgccgccccgatcgtctccgccggcggcgagcttggctacggcggaggcactctctggtaggtgggcccagcgacgcgccgtgtgcgctgtgctttcgcggatactttgcgggacgcgcacattacgggacacgcgttctgggctcgaaagcgtaatcgtgcattcgcgcttcgcgggtactcgcgggccacgcacagcacgaaacacgccttctgggccggaaagcgtatttccacattactgggcttttactgggccgtccattggatctatacacagcctgaaatgtggaaagattccgtgttgaaattaaaagaaattttgaaatggccgagcaaatagcgatcgaacatgtaggcacttttggaggttgggacatgaacatcgagggcgatttcttatttggaatgaacatcgaagcaaatttgacttttgtaaaagtccaaaacggcgatgttgagccgtcgataaaacaatgagatttcgatagcgtttttttgtggtggcgtggacgctaccttctctgctctgtccaactaactaaccccaattggcaaccccgttatgcagcaaaatctctgtctttgaactgatcattagaccgaagatgccttggaattttgagacaagcatcaaagcatgtgcgtttgggaggcagccagcgaccgtgcatgcgtactagggggagaattgagactatacacgcgtggcctttgaatttgtctctagccgattaagtactactatacataaattcttagcagaattatctgttctatacagtagaaaatgttttaaaccattttatttgctgctgttcctctaaacacaaagtccagagatacacttaataatattgtggtaaagggtaagtggcttcaatcccgagatcccatgttcaattctcaacacgcttataatttattcttgaaaaatgtttggatggatgtctctcttcaaatctttcttttctgtaaacacataatccacatattcttcttcacatggagtaataaactaaaagtaccaaggctttgttcggcacattgagttaggaattaatccctcgcagacaccaaacagagcgactcattagcacataattaattaagtatttagctattttttgaaaaaatggattattataattttttaaagcaacttttttataaaattgttttataaaagatatatcgtttatcagtttgataaatgtgcacgtgaaaaatgaggatagcgaagtttagaaagcgcacatactagcacagcctaatgggaccacctatacatttgtcgacaaattttctactaaaaatttgacagatgtaattatagtacaatcgtagtgtaattacactgtaacttgtattaagtttcacgtaattttgaatcgttagatctattacaagattcgttccggtgaagaagaaaaaaatcacagcacacacatatgtgaaaagatttgttcctaggacctctattttactgaaataacatgttaccgagatattcttgaaagttacatacaaattacattatagttacagtgtaattacatgtaagttacagtgtaattatactacgattgtactgtaattacatccgacaaatattagggggagaaatttgatgacaaatatctagcaaaatcgcatcctaactactcttgagtaatatgatatgttttccttaagtatttgtaaatcttttgtagaaaagataactagtcaaattttaaagatgaatagtgccaatatcaactatggctgtgtttagaccctgtctagatgggactaaaacttttaagtccctatcacatcggatgtttgaaaattaattataaatattaaacgtagactattaataaaacccatccataatcttggactaattcgcgagacgaatctattgagcctaattaatccatgattagcctatgtgatgctacagtaaacattctctaattatggattaattaggcttaaaaaattgtctcgcgaattaacttttatttatgtaattagttttataattagtctatatttaatactttaaattagtgtctaaatacaaggactaaagttaagtccctggatccaaacaccaccttagttggatccaaagtttggattttggttgaaattgaagatgatgtgattgaaaagttatttgtgtatgataggttgatgtgatgaaaaaggactgaagtttgtatccaaacaaactttggatctaaacacagctatttaaaaacggagacagtacatatattgagtgacagataacagataattgtgagtgacatctgtatagtgatgaacagttaaagccacatttattaagtagcagatgatttttctttttggtcgtatatatgcccttgtagctggtagtagccgcgacggcttcagtggccgagagttgtaacgggcgcgattatccggcgagatgtcgtcgccgccgtcctcgggctcggagcgctcgctggcgtcgctcgtctccgcggcggcgcactccgtcaagctcaaccgcgcctacctcctcgccccggccgtcgccgcgggcctcctcgccgccgtgctcctctcctccctcctcgacttctccgctttctccgcctccccgcggccggcgttccctccgccgaccgcgggcgcgccggcgaacgcgtcggccctgtcagcgccgcctcgcgcgcccgtgcgcacggccctggacacgctcgggacgcggccgcgggagccgttcacggcgctgcgcgacgcgtacgcgcggtgggacgcggcggtggggtgcgcggccttcgcggagaagcaccggtcgcggtcgtcgccgccgcccggcccggcggcgctgcaggaccccgaggcggcgccgtgcggctcgctgcggctgccccacgtcgcgctcgccgtgaggggggtgacgtgggtgcccgacatcctcgacggcgtgtaccagtgccggtgcgggctgacctgcctctggagccgcaacgaggaggccctcgccgacacccccgacgtcgtgctctacgagatctggccccctcccgacaccgtaagtacacgatcgatcacctcgccgccgccgccgccgccatgatcgaacacctgtaacgttgtttgtgctccgtgggtgcagaggaagcagggcgagccgctgcgcgcgttcatggacatcgagccgacgaggaagcggtcggggcacgaggacattttcatcggctaccacgccgacgacgacgtgcaggtgacctacgccggcaagttcttccgcatcacccacaactaccacgtcgccacccacaagcgcgacgtaagcactctcaactcgaattaatccttccttcctccgaatgcacacaaatggcggaaacattcatcgtcgtctccgtcgccggcggcgggtgcgcgcatgcaggacgtgctggtgtactggtcgtcgtcgcggtgcttcgagcaccggaacaagatcgcgcgggagctgttccgccacctcccggcgcactccttcggccggtgcgagaacaacgtcggcggcggcgacaaggccctggagctgtacccggactgcgcccgcgacggccacggcgcggcggagtggtgggaccacctccactgcgccatgtcgcactacaagttcgtgctcgccatcgagaacaccatcgccgacagctactccacggagaagctctactacgcgctggaggccgggtcggtgcccatctacttcggcgcgcccaacgcccgcgacctggcgcccccgggctcctacatcgacggcgccgcgttcgcgtcggcggaggagctcgcggcgtacgtgagggaggtggccggcgacccggcggcgtacgccgagttccacgcgtggcggcggtgcggcgtcctgggcggctacggccggaaccggctcgtcagcctcgacacgctcccgtgcaggctctgcgagcgcgccagccgcatgggcggccgccacgcgccggcgcccaacgccaccgtgtcgtgacgagacgagacacgacttggccccggttggattgaaagcctatgaatgaaaaaagtttaaaacgtttaaacgaagtgtttgttacgtagcgtagctgcgttttgctttgaatttgttggtctgcgtttgctgtttaggaggagcagaacgattatgaaaaaggctggcatgagatggtttctgctgtccatatttcacattctttttgcagatacggatggattttggaccagcgtgctacagtaaccggttatttgtgctggcaaatactcgttccggttctaaatatttgacgctgttgactttttaaaatatgtttaaccgtttatcttattaaaaaattaagtaattattaattcttttcctatcatttgattcattgttaaatatactcatatgtatacatatatttttacatatttcacaaaagtatttaaataagacgaacggttaatatatgctaaaaaaatcaacggtgtcaaatatttagaaacggataaagtactttagtagtaatagttttgttcagttcgatacggcaattagtaatttaaaaccgtcgtgattccgaaccaatgactagacttgcgtggcgtcgtcaacctcgttccaaggtttttcaacgtcgctgtcgagacgaagagaaaaggactcgtgaatattaggcctggtttagttaaaaaattatttcccagaaacaacacatcgaatttatggacacatgcataaaacattaaatatagataaaaacaaaaattaattgcgcagtttatatagaaatcgtgagatgatttttttaagcctaattagttcatgattagctataagtgctatagtaacccacatatactaatgacggcttaattaggctcaaaagatttgtctcacggtttccatgcgagtttttcattcgtgttcgaaaactccttctgatatccaatcaaacatctggtgtgacaaaaataattatcttttcgcgaactacacatgcccttagttttgtgttcgttccaaggtcttgtgttcgttatcgtttccattttttgctgcagagacgaagaaaaatgactcgtggatatttagtttctgacgcatggcaaatgactcaggtggtgtttggatacagggacttaactttagtctatgtatttagatactaatttagagtattaaatatatactacttataaaactaattacataaatgagaatgtttactatagcatcacataggctaatcatggattaattagactcaatagattcgtcttgccaattagttcaagattatggatgggttttattaatagtctacgtttaatatttataattagtgtccaaacatctgatgtgataggttttacttccatctaaacagggtctgagtgacgcactagaatctccattaatgctgcggcaattttcagtgatttttttttgatgggcaggtaaaaggctgttgctgttccagcgtcgccaatgcattgctgatccccctctctgtactgaacgcgaacatatatgccttgtgcatgaactaacttatcagttggagccaccaaccctcgtgttgtaaaaacaccatactcattaggctccagcttgtcaagcaaaatgcctgctaattgcaaagcgtaaccaacccagtgggatattcatctatctcagtagttgactttcagtaaggaaatcaaatgtttaaagccttattcggttttgagggattgaagagaattggaggggattgaggaggaataattccatgtagaataaaatcccctctaatccctctctcacatggataactaaacatggcctaagtgtctgaaaccatcatcatctaacatccatataattgagcatgcatgattctctgtcaccagggggccatatccagaaattaatgagccaaggcctgggcttccaattgtaattttgggccgcatcttgcctttagtcataggccttgttacttgagggatcacaatattagccacaaccatcaaccacgtgagggaattgcaactgaatcctccatacgtaatcaaaatttattattccactagtttgggtttgacagtgaccaatcagatcgaggccctagggtgagtgtgaaatgtttaaattccacggtaaaagttcagtccatgtgacatccacatattcttttcccccctatgtttgatcattaattacatagtgtacaactgatcacaaccatatagctagcccaaaccacgccttccaaattcggaacgaatggtttgtgaaaaagcggaaaatcccccaaaacaaacacattttcttctttctgtactattttttgcatggatcaatcaaagttttttcaccataattaattagtaatttacacggtccaggaggcggagcgcttgaggacgggcttcatcatggccctgtcctcctcgagggagatcatgccgaggtgggaggggtcctccaccatcatcttggcgacgaggtagccggcgacggaccacgtctgcagcttcctcgcctgcttgcccacgtagcggcccagcttcccgtcgtagtactccggccacccgtccctcgccagcctcgcctcggcgagctcgatcgcccgcctcgcgatcttcagcctccccgtcttgatgcacgccgccgtcagcagccacaggagcactggccgccgcaaattaacacacaacacaaaacaaacatgctcggatcgttagatgagataactactcatttggtcactcgagtggatcgtacactcgttttatacatgccaactaaaaaatcgttaaaattgttttaagaaaagaaaaatgtgagcagatttgggtgcgtcattgtagtactaataaatgttttttttacagaaaaattaaatgcatatggttttcatacttctaatggtctaatcatttttcaaagaaaatatcaatgttcaatttttttttcttcccctcaaaagaaaatgttcaaaattcttaaaacatgacttgaaacacgttcggaacagcatgtttccgtgacttcaaagggagggatttgtaggatgtaattttatcattcttaataaggtatcggaaggtattatattttctaaggatagaaacaatcgaagtacaaaataactaacctggccaggatccgccattgtggtagctccaccgggtgttcttggggtcgcacccggtgacgaactcccactcgtgtgattcgatcgccgggaagctgatcttgagcggcatctccccgatgaggtcctcccaccgctcctcgatgaggtccatgatcgccgccgcctgctcgggcgtcgccatggacgcaaggatggcgacgaagttgcccagtgcgaaccatcggaagtccatccgggcggggctgacgttgccgacgaagtagccgccgcggctgggcatgaagtcgaacacccagtccgggatggactccgggatgacgttgaacttgttgaccgcagtgtgggagtactcctcggtgcggtagcggtagacatcgttgagctgctggaagtcgagccagaagtaggaccgcatgtggtaggtgagtgcgtggagccgtgtcgccacgcggtccatcgtctccttcccctcgggggcgtccggcttcagcatcagcagtgcgcaccgtagcgccatgaagaagagggcctggatctcgattgggtacccgtacacgccctgcaaaaaaaaaatcatttaaatttttattgaataaaaaaggagtaaaactattcaggcgcaagagaaaaaaatgtaaaggctcaaagccttttgcccgagattgctaaaacgtaagccagctaccgtagatgctttgtgttcgtcaagattcatgttttggcctctccttaattttggctattaggctagtcgccgaaagatcatgcggttcctttccttccatatctctcatacgactagcagtattagtgtccgcaggatcttcttggtgctttgctggtgccgtgcggtagcatttcaccactcgagaagcgtcgatgctgcttgttggcactgcgttggcttttcatttcatttttcagagagttcagtttcgattccatggtgaccacgacaccgtcggtgtcagatcgtatccatcagcgtaaatgtgtagttatcgatttatttctgggaatgggagtcgttttaatttctatcgattaggatatggatggttacggttagtttgaccgagctgcagtagctgcatgcatgtacaaacagtgctttttttttctgttttgattattgggatcaattaaccagacagtgatcagtaacaaaatttttcagcattatgttctttattatcagctaaagcagaaacttttttttttctggcagctaaattcatccggtaaggagcctcacccaaaattcatttagcaactgatgccaaaatgatcagcacaaactattttttttaactctttgatggcatataaaagtagatatggtgatcattatcaacaataataacatataggtgtaaaaaataagttttttttttaaattgacaaactagattaattatggtgatcattatcaacaatactactccctccgtttcaagttataagacattttgattttagtctgttttaaatttgactaaatttatagacaaatatagtaatatttataatactaaattagttttatcaaatcaataattgaatatattttcataataaatttgctttgggttgaaagtgttactaattttctctaccatcttgatcaaatttaaagcagtttaattttgaccaaagtcaaaacgtcttataacctgaaacggaaggagtaacatataaatccaaaaagaaaatcagtttttttaattgaaaaactagataaattacggcgatcatgataatcaacaataacgaacaaacatgaagctagtgaggacgaacgaacgacagtagtacataccatcctgcggtcgatcatgcagcagccgtcggcgcagaggagggtggggaaggtgtcgaagccctcggcgaggcactggttcatgatgaggcggatcccgcgctggcactccgccgtctccgccagcgacaggtcgccggtggacttggtgtacgcgcggaggaggatgatccaccagaagccggagtccaccggcgccacccgcccgatggcgctctccccgaagtccgccaccagccgctccgcccctcctcgcttcgcgtccttgagcaccttgaagctcgccggcatcgccccttcccccagcttgaacctgtcgatccgcttctcccacccctgcagcagcagcgtcttgagcaggaagttcttcacgatctccggctccccgttcatcaggaacgccagcgcgctcggcacgaaatccctcacgaacacctgcgtgtatatgcgtgcagtttcatcgatcagattgttgcttttaagattttgagaatatatgctgattggtagcagggttcaatctttcgtttttggcatttgtatcgggggtgctgatatgatgagattatttgaatttttaaataaaatttgtttaaatttgaacaaattttactaaattaaaatgtaataatttaaaaattttggggttttccgataggaacaaaatttcgaaaatttattccggaattttgaacacatgtgaattgtttgaggagctcaagattacgtccgtgggagactatgggcatgtttggggagcttaaaattaaaattctgagaagcagctggttggtagctagcttctaagaatctagaaaaaagctgggtttttcagtttctgatttctagttcattttctggattctacatctacagcttctaagaatctagtctaaaagctggactatttgaggaaacttctaattctgggtaaagttgcagcagctaaaagctcctccaaacagaccctatggctgctagaagttgaggacttggtatacctggtcgtagttgaggacctcgtcggaggagtggtcgacggcggcgatggtgccgaggggctggccgcggaagcagacgagggagcggcggagggcgtcccaggcgtcgaagacgagggggtgggggtcgaaggagaggcgggtggaggacgccggggtgccgcacagggaccggagcccgccgccgggggagtacatgctctcgtagctctccatcatcgccgggtaccctcctccgccgccgccgcggctggccgtgccggagatggagagctcagcgagggagcggtcgtcgaaggagcgctgcctgtccacgttgatccgcggccggtggttcagcatccgcgtcaggtcgaagtcgtccgggtccgccgccgccgccgccatcgacgcgtgcgacgacgccttcctcatccccgccacctccatctcgtacaccgccgccgccgtcgtcgcgtccgccctcaagaaccacaccgtacgtacgcgacgacgacgacgacgacgagaagagaagccaaacgcaacgagacgcacggtcgtcggagagtggtggtgttcacgtgggctcgccggagttcggtgcggcggaggagaggtcggtctctggctcgatcggcttcggcttcgggcttccggtttcgcgcgcgcgggtaaataaaggacaccgacgcggggggtgaggaggaggtgggccccacgagtcagcgacaccgcggattattgctgacgtggcgttgcgtgcgatgggggaagggaaggtggtgggggcggttacctgtctgcgcacaaaagggagtgagaggaggcgagatagaggcgacacatttgggattctttcccagataagggaatttcccaacagattttgaatgaagcaaaagggcaaacttgcatgtttgagttattttcttcgcaaccttatcattggcttaatacggtagaatgggttgagtggatggatgtacgtcatatattgtgttacggaattgatagaaaacttgcgacagttttcttctgtcaaattttcagcccttagggcatccacaatgtgcatataaagtgggtagtaagaaataaaatactactactaccagattatatacattgtgaaatagtaagtaataaatggtaatatgcttattacctagccataagcaataaacaaatgatttctctcatccctctctcatggctaatggttgtggggtccagcttactaccaactttttttatttcaccattgtaactacaacaacaactaatacccactgacgcagggcgcacccttattctcaaagtaggtagtaaacattggtgatgcccttatatccgctccaagattcatgcgggcaacaaggaaaaaaacagcagaatatagtgtcgtggaggggaatcgatcctagaccttgctcttacatagggcagcattccaaccactaagccagcccaaccgtaggtattcatatgctttaatctacttacatagcatttacatcctagttacatagtagttacatagcacttacaccgtaattacgtagtagttataccctaattatatagtagttacatgatagttacagggtagttacatttgtataaaattaggatttgcaaatttttttcaagagcatatgtgttttacttttgaattattcttccttatacatgttgaataatttcttaccattcaatcaactcaactgtggatgctaagatcctatggttaaaaaatttgaaagctttgagcctcaaaaactgtcgacagattactagctagttccttgtgttattatttaataggagtataggacgtaaatctcttctgctacttacagaaggagtttcgtcaatcccctccgcaacgcttccggtatgtgaaaaccctttcctttctcttaaaaataacatctgctttagaaaatgatttcctctaaaagaatccaatcatatgtctagaaaagataaacgagccactcagcccaattctttcaatgaaattgaataaaaaaattgtatcgaagaacatcatgttacaacacacaagtcaataacctttttctttaaaaaataatagtaatcccggttttgcttcaataaaagatagccaatgagcccataaccatagaaaatctgagggcaaaaaatatataatcaaacaatgcgggggtattctatatcttactaattaagtacaatccatctattaagtgatcctattaatacttgttgaaatttcatacaattgtgggggggtcaaagccgggcacatttgcctccactgtcctccaccgttgatattttaattagtttagttccttctcctctaggtggggtggattgagaaaataatatcattggcatccctagtcaagtgatgccaatacatttgtattggagcattttttatttctaaagtgtattagcaaagtaaatagcaaaatgtaattgacggttttacgagactgatgcttacatgttgaatccaccctgctactcctatgtgatgtgtcaaaacagttcgataaatatcgcagaacggagggggtacaatttttggcatgtgtgttccgatgttgcgtgcattgaacatggtacactgtgcgtttgcttattcgccatggtacatactcctattcaacaattgtctagcccaaacatggcaaagtttgaactttaccctaggagaatcttctcgaacttgctggatgctccacccgtttcagattataagtcattttgattttggttaaagtcaaattactttaaatttaactaagtttatagacaaatatagtaatatttacaacacaaaattagtttcatctataattgaatatatttcctgggttgaaaatgttaattactatttatttttacaaatttaattaaacttaaaacaatttgatcttgtttaaaatcaaaatgacttataatctgaaatggagggagttgtcaagtagaatagttgccctggattttattctatctagcattcaagaagatgattttgttgctattagttccttgtttgatgcatggtctcaacatgatcatggggaaacgccatcaaaaaaataattgcaagactagttgtcatactccaggtaaattaaatgtgtgtcacatcggtgtgggttccgattacacaatccagctgcaaacgcaagaaaagaagaaacataccactcttaataaattaatcatttctggaaaaaataattaatactgaatcatttcaagatagaagcatgcagaacaatccatctctttcattgatcatgcattgcaattgaatgcatgagctagattggatcacagaggggaaaagggattgtaaaccaccaaaatctttgttaaccaaatcaatgcaaaaatcaaatcatcatgcgtgcttgagtttgaaacactgccattgctgctggaggaattatgatgaattacaaggctccgcaagaccgcaatgaacaggtcaatataccagcacatgtatgattggcactttgagttttccagcctcatcttttcacttatacttatcagccaattttaaatttttaactttaaatttaaagttaaatttgggttttttccatcgtagtttattttttagtctttgtttttaaatcgttaagaacacatatatgaaaattttattcacaaattattttttatttgtaaatatgttgtttcactttttcctccaatatatcaaacgatgaggctgtttgaagcatatgtacatctactgtatattacgtgaacacgaagcaagaaacaattatacagtgtctctcaaataatttggttggataacttgtgcgtttgattaactgttagtgcaaatagagctgactacgcctatttttttggtggtgtttttaaggtaattgtgaaatgaaagctactgtttattttgtacatcacgttttattttaatttttttttccaaatgaggcttttgggaccaattgtcaatacctgctcacatcaatctcgtcattttaatttagatcttcgatgatgctgttacaaacgacggtgtgaataatctgaagattggcatatacactgtcaaacactaattaatcgttggcaggaataatgctttgttagcagcagtgctatcatagcttggttttcaatcctacatattttttcaaacggggatttgagtttcaccgcttcataaatatggcaattgaaaatgaattaccatcacgtgttaatttatagcacgtgggaataggatcaaagtgtgatgtgtgtcaaagagatatataccgtggcttatcaccaatgtcgctattgaggagcgtcgaattatcgaaggggtcacccctcttttttcaagcataggatcctcactgttatattgtttaagcactcaatgcgatcctatcaagcataggagtatcaatataatgaatccttgtcgatgttacaaaaaaccattgcacaacagtgcactccgataaaaaaaatagacagtcagtcatgtttatatggaataaccatggaacaacatttataaaaaaatatttacttattgtatatattataatggaaaaccatcgtcaaagatttattttagagaccgtgtcattttccaaaacatatgaaaccatagggaataaactttttagcatataaaatttgataggtttaaaatggggtgagctatatttcttttcatttctagctaaaaatattgaaggattgtaaaaagaaaaagagtttacccggcaatgccggatgacgtggccaaccgtttcccgccacgtggaggatctactggtcgctcggctgcccgcgtggcgcgctttgaccggtgcctttgcctcctcgcgagggaagaagaagaggagccctagctatcctatcatcgcctatactggctactgcctgtgccgacggcgacagtgatatgattcagggtagagttaattgggccgccggatatcgcatatcgccattcgattaatcaataatactactcctactagcgttcgagaaattttaaatcttactaatcatgagccttttcgagccttggattaagacccagacaaaaccagaaccgctcgctcttcaagggcgcgcgccgcgtcgtcggtaacgccatcgtcgcacggtgtacggcagcacggctgtcccgccacgcctccgggtgcgacgcgacgcgggcttcgccggcagcagcagccaaccaaccgatcgactagcttgtggcctgcagagacgcgcgcggctcgcgctagctctcgtggcggcggttgtgcgtgccacaccactgttacaagcttcccttggtttgaggtatacacgaatacggcgtgcgtgcgtgcgtggcgggcccctgcagctgcagctgctgctgccggtggcggcggcggcggggtggaagccctgtgcgcgggatggcgcccgttccagcggggcacgggtacccttcctcttacttcgcttctcctctcttcccttcccattcattgcatgccttgcctgcgtagttcgatcctagggggggccggtgtgtcaccgccattgcgtgcgcttggcgttgatcgcgacgctggcatgtcgaaggttacatgaaccggggacaacccggttacacgtcgtggaagagcagatcgagaccgcgatcgatcggctgggctggccacctttttcgcgaacgcgcaaaaaaaattgcatgttgatatattagaagaaaaaaagtttttgttacacgacataatcagccagatcaggctggcctggccacctcgaggctccatgctcacacgagcgcgatacctgcgcgcgtggtgttcttttcctcgaaaatggaggcagaacaagtaaaaaattctgtaaataagaaagaaaaagtaaattatattatgggtcatatatttttatgttcttttttgctttggattatttattgttaccctttggaccgcgtgatccacatgtaaatgacacatggataatagaggtagttagtttcattgacaggtagaccactcggtctaagtgtaacatttggtaccaatatatctactagtccagagtggaaaaacactgcaaaggaaattcaaagtgaaactttagtaagtatatgtggtccaaaatgcaaattactactcaataataaaagcagtagtatgctactggctgctggctggtgctggttgaaaagccatttgcaatgcttaccagaaaccgcaggttgaaacccttgaagcttcatcaacgatcatatatgctgggcaggaggaacttgctggatcacaacgcggcacagggtggttgctcccagcctcccaggtttaatttgagcatatcttagttttctcatgcaggtatatcaatatgcagcaaagcttaactatcgattcattgaaaagagataggtcacctgtgaatcacctgtgaactgactcactgcccctagttcgtaccagaagagaaacatatgttacaatcaaagaaagacatgttaattttgcaacacctccctgcgctctttatatatttcgttccccagtgctggaatgctaccatccaggcattagcttgggagagacaaccactcaacatacaacatacgctccttctcacagttatatcaaaggtagcagtgataaataaaagcctagcagtaaacaaaacctcgctccagatatacacgccttattactattgtatcacttgtacaaacgttttggcaatagttggacaacaaaaatatttttcacagaactgttcaaattagaactgaactaagaatcacattttctatcatgcacatgtggaagctagttttagttctaattaacaaataaacagaggaacagaaggcagaaccgcaggagagcacaactgcacaaggcacaactagataattgccgacagagatacaataatgtcagaatcaaccaataaaaccaggtccttcaggattgcatcacttggaagtttgaaacctgacctctgaactatatatatatgtatctcttggtggatagcctcttttggtaagcttctttcactcttcatgagctcgtcttacctgaggagtatcatcttgcccagtaaagtatatcatgacaccaagaagagcgaagacacatataagaatgtatagcgagttcaggctgacaagagagttcaggaaacccatgaaagatgggccactgactttcttctttgttgttcttcctgctctatatccctcaaggaattggcttatttgagaagcttgatcaccttcctctaacttctctgagccttccacctttggcagaaaacatttttggttaattacagggtgtaacaagttctctattagtgctaaccagccaagcagaaaaagatgtttcagaaaagattataagtagacaggaaaaaactaaaaactaaacataatacttctatgaatatgacagaaaaaatatgagcatgccatgaatatgcattaactcgaaaggtggctttatcagtaaaatagcacaggaaggggttgctgatgctggtgcaggcatggatttctaaggttctctacaattatacttaccacttcatactcctcatttctatcccagacgattagctttggcagctgtgagctcttggaaatatcaaaagtctcgacaaactcatcccattgtttgattccgacatacccaaacaccaagtcacggtttgcattggcagcagacctcaaaacttttaccaactgtgaagaagtttcatctgaatcatcctccaaaattgcaagaacaacttttctgtcatcatcatccaacattttgagtgtctctgtgttgatggggacagtcaaaggaagcagggattgccgtataaaatcttccaagaaacttcctgtgtgcacaagaaaaaagaattactaccacatatttgctaccaagaaattcatgggtgaaatagtatgaacaattgcaggtagctacaattaatcaccctttgttgacataagaactcagaaataatgtgatagtttgaattacttcatattagcatcaagaaaaatataaatatataataataaacacaagaaaagagtaaaaaaatagagttgcctaataaataccttcaaatgggccataaaatacactttgttctttgtactttggatgaagtgaaaccaatgcaggaaccttatcaaaatcataagtgaccatgaagtcctcagaaaaatcttttgcaacagcaaaccatgctcttttcttgtatttccctccataaccagcaatcaacgactcattcaccccaaacccaatgaacattggaaagctcgtgccagcattctcaacaaagctcttgatcgcagagtccgactcaagaatagaaacatcaggtgcaacaaacttattaagattgcggacaagcaagtcagcttttcttgaaccagtgtattcgatggggaccccgtggataaaaagcatcagtgtagggaacccgctgtattcagtaaaaaggaaaggaatattaggcatccaccggcatctatactgtcaagaaaaattgaactagttatgagggaaacatcttactccactccatatttcgatccaagcttcctgtacttgtcagcatttactttggcaactatgatgggctcactcagtcctgccaacaccggtgcagcttcatctaactgcaacagtttattttctcaatcttaagtcctagtataaaacagtataatccacagaaagttccctgctgccataagtagtaagcaaactgtaaaattcgagaacctagtaatggccaagaatgaaacatcttgatgcgtctacaagacaatatgatgattctcacgcgaccacgcccacaagcccacaataatacaaggacttgtctctctaccttttcacagtaaaaaaaaaagctcacaacaatttcctttcttgagttcttccccagagtaatctcgatcataatcaaaacgacggcatataacatctcatttgttgtctaatggtcaacataagaatcatagtgacaatcctaaaactatataataaaaaaaattatcatcctttaccctttcccccacacgccctaatctgcagttcatgagatctcatctcgccgaccaattacgatcccggatacctagtcaaacccaccacccccacaacactcgctgcggtgctgacgagatccacagcgggcggcaaccacagctcgcaacagttgttcactcaattcgcatcgcatcacatctcgcaacttctccgcacgagttcttgatactggtaacaagcaaacacaggtggtgctggtggtcgaggagaggggagtacctcgggggcgaggcgcttgcagtggccgcaccatggcgcgtagaagtcgacgaagaggtagtcgatggcgcccagcgccgcctcgaagctgctctcgtccagctctatcacccgcccgtcgcgcgggaactcctcggcggcggcggcggcggcggcgtggaaggagagcagcaggaggaggagaggaggcagaagcagcaggaggaggagggggaggggtctcgtcgtcgtcgccgccatcgccgccgattccgatctccgccgcgccggaagggagtggtcctgacgcccacggaacttgactagtctcttgatggattggaggggtttattgggatattttcgtattggcccctctacagtagaaacgtgtacattttgctacctacattaggggtctcatcgtttggctttttttcataataagctaaaacggtttattagagaataaaaatgaatttgttggtaaaatttttatatatgtgttctcggtgacttaaaaaccaatgctgaaaaaaaactacgttgaaaatatctcaaaatcaatatcaaaattaagtttaaaaattcaaattttggctttttctttggctgaataggccatccgatggaagcctaggattagatgatgtgaaagttaacctttgttaattaatttggagcgagttgcgtttcgagccttttatcaccaaactttcactttagagtaagaataaaagtgagctataactatataaatttatgtgaaagtaaaagataaagaaaaaacgagaagtattggatcttgagtaatagctagctatacatttgcttcaagacatttacattaaatatatagttagagaaagagatgatagaaaaaatatagtcaaatctattatacattttagttttagtatgagctaatagctactagtaacagttagctatactattaaactcgctcttaaatcatcctttagccaatctttgtttcgcatttattgtactctggagcacataagtgaatcacccgtacaccgacaatctttcaggcttacgtgtagaccatcatttgtaaggtgagatagtagatgcactaaagatgggattagaagtaaaacttcgataacaaagaggtggaccaaagtgaaatctactaaatctgtttacacgaattttacaggtcttttaaatagaaattagtccatttgctccaatattcctccgtaagatcgtataaaggagggcaaacgtacttgatttagcaaattgtaccggctaacactcgtcctttgactaattattttgttaccttgtacccgtcaacattatttgacgtttggagtattaagattagtactgccttcaacgtcaaatattattgactgaagggagtatataatcccgtatgtgaattctagctgacgtactgatttgagtccaaaaacatgtgtgacctccaacatttccgacagattggcagattgcacatctctacaaataatctgaaaactaaaaaagaatatgaccaacatcttctgaaaagaatggactcgtgaagctctgaaaagcacgaacccgtgaagataatactgttgcaggaaagaacggtaagtacagcttttcagaaatttccagcaacaacccatcaagcagaaccatgatatagatgggcagtgcaactaaaatacaatcgtggttagcatattcaagaactcaggttccgcttccatgtataatatccacatcagcaaaagaaaacttgaaaggcgaggtgtaaacaagtagtaaacatgaattccaactatcaatttcaatcacaataagaaataaaaaaaaatatgagttaaaacaactgtgatcacgctgcctggtttctccacagccaggaaagttcatgccatgatattattaacagaaaatagcagtattcctacatcaaacgccatgaaaaggagcttacaacttcaggcaagtgcaaaatggagtaacaagcaataaccaatttaaagtgaagtcccaattttaacttcgcggagtgctatagaaagtaagttcattatgtagcacttagagagcttatccggaggcggtcttcttctgctggaaaacaaccgcataaactgggactgcgatgccaatgccaactgctcccagcacggaaagatacaccttcggcttctggtgcttcatcctgtgcaagttgtacatgtgcttggcatggaggtagtagggctcatcatggccatgccctcccatcctcttcacaccagtggcatggaatccacgagaatctgttatatgcacagagaagagaattcagcaatcagaagtgaactaaaatagtagagttcacaatttgatgatacaggaacaagccaaacatctcgaaggcaaatacacatccaaaccaataactatatttgaagatactactaaacaataaaaaaagaacaagccaaacatcaaagatatatttgatgatactactaaacattaaaaagaagaacaagccaaacatctgaaacgcaaatacacatccaatccaatagccaacaattccaggtctccactcttcccccatccaagctactctgattatctctaagattcgctagaatgcaccatagatacatatagcatgacaagatggacacgtatttcgacccttggcagaaaaccattagtaatactgctcatcattaacatcacagacaaataaactagttaaaaaacggcagcgagcaggtgactagacattttgtgagaaaaacaggttatttgcacaatactctcctctgcacagatgaaaccagggcaaccaaaacgagaaattggacattctgccattgccaaaactaggttttgccaaaatgccactccgcaaaagggattcgttaaaatgccaatctcaacccgtggctacaagctacaatgctatacgggaccaaattaccctcgttctcctcgcctgggcatgtggagctgcttgctgttgggtcagtccatggcacggagcagcgaggacgtcgctggcacagcggctttcggcgaacgacagtgacggtggcgttcggcgagcggcggcaccggcaggaggcggcggaggcgaacgcgccgccgccaccgcctgacgtacgcgcgccgccgccgccgctgccgtccgacgcacacgcgcaccgccgcagccagcaacgcacgcgcacgtcaccgccgccgcccgacgcacagaatttggacatcagaatttcatcacagttcacaagatggccatccgtttgatcatttcacagtgacggcatatcgcagattcacattccaccggcctacggtcgattcagtcaccacaggctagcccaaaaatcaaccaccaacatggtccatcgcgggattcatccaaacgagaatgatgtagcgattgatctaataaacgcctacgcaaaccaaatcacagcggcccaagatccatcagccctagaaacatttcgatcgccaaacccccgattcgcttttccaggagtcgcggatctaccgtccaacgcatccaaaccaccacccgaacaaagagaaacgggaacatatgcatccatcgaggcgaatcgctcgccgcccggcgccgaaaccctaaccaggccgcctcgcgcggtcaacgcgacgcagctcgaggggattggggaggagaagggaggggtagggagcgcttgcctgtcttggaggcctcagcgccggtggcgaggaggcggatcccggagcggaggccgcggttgagcgccgtcgccgtcgccatcgccccctctctggtttcgctcgtgttctcgccttaggtcgcccccgccgccgccggtctggtggtttgggttggggttgggtgccgcggtttcgctgatcttggctccactaccggttaggtcaatctcaccactcccgagagatgcggggggagtgtgagtgggcttcgtaccttgggccccagcgctgtaacatgggccgtgtgggcctccatgggcctgaaaataaaagaagaaaggaaaacaaaccagacgagttgaaaggcttcctttccttccttctcttcctcctcgtctgctccatgcttccagcacattgcaatttcagttcttttcactgcacacttcaattctgccaagtgccaagaaccaaatgtttgaagccatatatgccatggaacgatcacacttgacacactgacactgataccttgagagttcctttttgagttttgataacccagaacgatcaggttgcctcctctatcatgacggagatgctatcaacctcctggcatatctgctcgatcagagggtgattgctgtcgtttgaagagaatgtgacgacctcccccttcagctcgatccagctacacccggtctccttcttcagccctcgttccttcatgaaccctctgacgctggcagcgctgctccacatctctttggcggcatatatgttcgacaggagtgtgtacattcctccgtcggagggtctagccttcaggacatttctggcaatgatctctccaagctggatttccccatgagagttgcacacgctaaacagcgtctcccacgcggtcgttcgatggtcagatgggattctcctggtaaaatcataagcctggtgtataaagcctgatcttcccaagagatcaaccatgcaggagtagtgatcagatcttgggaccaagttccagtcttcttgcatgctgcgaaaatggtagcagccttcatataggtaccccttatgtgcgcaagcagacaatatgcttaggaaggtcgcatgatctggtctaaatccagcttttgtcatcatgtcaaaaactttcaaagcttcatcagcaagaccatgataagcgtatgttgcgatcatggcattccatgtcactgtgtcccgctgcaaaatcagctcgaaaacttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16083 - DNA, 9341 bp, Oryza sativa
  unsure (1)..(9341): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagcattttatccttccagcatattcttgtgcaatctcatcaacaattcggtggaccattctgcagggtccacaccatgaggcccaaaactcaataagcacaggtatatcactgcagatcacatattcattccaagaacatgccgtaattgttttggctgtacaaacaaacaaaacagagttgtaagataactcctctatatttgaacgtaaaactaaacaacaaatgatgttatatgtcacaacagttgctacactcaagtaactacaaaagatgctaaatataaccctgacactatccgcttgctgagagtaacagttgctatccagcagccctatgctcatgtaacaaagttaggaaaattgaacatcttaaaatgtgttgtagctactagtatttacggaggtgaatatgagccgagttaattggtttgcctcaatggtgcagtttgcaggaacagaagcagcggccaatatcctggaaatgaacaactgaacggtagagctgccgaaaactaagagcagccaaagaaagaataattgaagaattgaagtttagtgatatttcactacagctccaggattttttttcgaacgaaccggcactacagctccaggatcaatcatactttactagtaacgtgtttatttcaagctttcgacatgtatcaaggtttcaacttttctgtggtactgaactggctgacccatttcttgtacggttacactacccgaaaaaatggtatacccctacattgcattctctagcaagtaaaattaagctgcttccttacggcttctcccttgaagagtgcatccatcataccactgttcaactacattagactactacatggaactggaagcaatgaacatgagaattgtcactaatttgtcaaccacacaacacaccaaagggggcaagggcagttactacacgacaccctaaaggcagcagaaatttttggcacaagcaaacggttagcttcagggggagggggggggggtggatcatcatcaaccagcgaggaggcacactccctttacctccgcgaggagaatacgcgcagctcaccgtgcggatccggtgcgccgcccagcggcgccggcagcccggccaccggcgtgcggcggaggaggaggcgccgtacccggccctccgtcggccgggcgccgcgagcgccacgccgcggtagaggctccgcggcggcggcggcgcggggcaagcggtggcggtggcggccatggttgttggtgttggttttgggtggagactcgtgcgtgcgtgcgtggcggaggatgcgcggtaggtaggaaaatttacgaggcaaatccgcacgcgacgcgagcgagcgagcctagcgcttatgatgatgaggacgacgctgacttggaggtgattttggagtgtgatgcaattcactcaaaccttattatttcctccgtttttattatatttatcaatagttttaactttttttacaaaaaaaatatattaaagttaatcgattttataaaaatatatgatagtgatttgaccacaaagcaaatatgttatccaaatttacattgtttaatgaaactaatttggtctatcttaacaaagtttgactaagataaaagttaaaaagcgatatattgcatccctgtgtacaacaatgttcaactaggccttcacataacaattccattggaccatgtgtacctcatcattctcatccttcaaagaccaaaccggatgggcaaaaactcatctcgccctgcaatcccctgcatgactgaagatctgaaagttggtagggcaagaatgtctgaatctcctacattcttcagggaacaaggttctcgcagcaagcaacgcctccatatccaagaatctcacttacgtttgcacggtagaaatgatgaaaaaccaggagcttttcgcaaaaccttgatttgttcgtctcgagctgcccatgctgctgcgtcccggtgtatcgtaccatcagattcagagagagcacacttggtttcttgtctccctgatcaagactcatgaaatggaatggacacatgacgaacaccagagaacaaaaccgcataggcaacagctacaaagtcagagagaaaacactggaggatgccgtcctggaagatcttcatgttctgcacctgcagaaaatggttgtgctcatataaaacttttgcgacaaaatctgtaaaatggaaaaatgcatgtggtcatcggttcacatacacatctatatttgagtgcagaaagattatttttaaaacccattttttataaaactgagctcttcgtacaaaagtcaaccttcactaaaaaaaccaagtggagtaatttttttatgggataaaaaggcttagcgcccagcttttctgggaagctcaacgggattttttaaaaatatccggcatttgacacttgaaacaagacaataagatgacaccagctttgccacctcatcatcaaactacctatcagcacccaaaaaaaaagaaaactccatcatcaatatgtgactatgtgagcagtgttagatgctacaccaccagatgacaaaaaaaatccattcaaatgttttgtttggtagttcagactctctgaaaaagaaaaaaaactactccacaaaactgatgtttttcctattggattaacaactaactggagatcacccaacgttagaaataaagggctcgtatcctttaccataatgacatttttatcataggcattgacatataaagcaatatgaggatggaacctacatgccactgactgtaatgttagtgcaatatgcgatgtttagttcccaaacaaaaacttttcaccctgtcacatcgaatgtttggacacatacatagaatattaaatatagacaaaaaaaactaattacacagattgcgtgtaaattgcaagacgaatcttttaagtctaattacgccatgatttgacaatgtgatgcttcagtaaacatttagggcaaccacaatgtggggtcttaagcctctaaagtggtccttatacattgtgaaagtagtccatatagtagtctttagtatgaactacccatatgcataatgcctacccataagaataaaataggaattgtcagggttatggataccacatacctaatagtagttgactaaatctcggcagggcccaccacatatcatgtcctatacggaaacaacctgcggatgtaggaggagttccggataaggaaagacaaccggagttctacgtggaaacgataaggactactcggattgtatccatattggtttccctaattctacttggacaaagggactcctatgagtataaatacaaggccccctaggaggagaggggggacagacaatcaatacccaacacaatcgacatagaagccacaacatacaagccaacatactccaagacaagacgccggattttgacttcagggataggcatggctattcccctacggtgtctccggataccgtcaggagagacgaaagcgctatctctgatctcgccggacacggattcgaggagcaaggctaccctgttgtcgactacgagtcagaccttcagaccgccatgtcgacaacagttagataggctaccccacatattgtactggtgtgattatggtgaataaaaagcaacatcggcttagggctacctgaccgctcagggacccaaacctgtataaaaatcttcgtctccatctcttttacctcagtctcacatgacatacaacacatgacatacaattgagtgggacccaggctaatgccttctcttaccatatacattatagcaaacagtataactaatgccgggtcccaccttattacctaagtagacattatacattgagcatgcccttactaataacgatttacaggcgaaatttataatttattttgttattagactatgtttaatatgtgtcccgtatattcgatgttatatgcagaaactttacatccctatgactaaacagggccgcccatgattgtaaagcatcgtaattcgtaaatgaagtgaattggatcgagtgacccaggtgggccccacgcggcagcgacccaggctccagtctctactccacgtcgacggctcgttgacccccaccggctcgtgcgttggcggttttgtcggtttccccctctctctccctctccctctccccctcgccgcgctcgcctcgcgtacgtacgtacgtcacgtcacgtagccgcctgcctcgcctcgccccgcgccgcgtcgccaactcccccacatgccgccgcgccgccgcgctcccgagcaccacccacccgccacgcccgcgcccacgcgccaccagctacgaggcggaggcgtccccagtgtagcaccaccactatggcggcgcggcggaggcacgtggcggcgggggcgggggcgccggcgccggctgcgggggagtgggcggcggtgacagccggtggcggggctgcgtgggcgttgtcgccggtggaggaggtcgggacgaagcaggagctgatgcggcggacggggctgccgccgcgggacctccgcgcgctcgacccggcgctgtcgtcggcggcgtcggcgtcgtcgtgccgcccgtccgccatcacggggcgggaccgcgccgtcgtcgtcaacctggaccgcgcccgtgccgtcatcaccgcgtccgaggtgctcgtcccgtccccgcgcgaccccgccgtcgcgccgctcgtccgggagctccgcgcccgcctcgccctcgccgcctccccaacccccgcgccgtcgccgtcgccgccgcaggtgacacatgcatgccccccaccctaccttccttcttgcattgcatcgtacgtcttcttcttaagcaaaagctctgatctctcactccttttcttttcttttttgaaagcatggcatggcggtggggatggacgggagcatctcgccatcgcaggcgagccgcggcggcgaggaggccgccggcaacggcaaggatggagaagctctgggaggaggtgacaaggctctgccgttcgagttcagggcgctcgaggtgtgcctcgagttcgcctgcaagtctctcgaacatgaggtgtgtgttcttctaccttgtctccatgctttttacctgcagtgctatctccatctccaattctccattcagaattggatggaaatgcaaccaatacctgatctttaagtgcagtgtagctatgcataacatgcattaaaaaaaaagagatttgaagagagatacatccctccaaacatttttcaagaagaaattataagcgtattgaaaattaaacacggaaccttggagttataaccacttactcattgctactgcactatcaattgcatctcaacatgcaatttgcttgggttgaatttaccatgaatagtgagtggctcaccaaactatgcaaaaagttatgcattgttgtatatttgtattaggtttgacattgtaattgtagacatatgttcaattcctatccacattgatttttctaggtatgtcatatgatcttttaacactcaactagacgtccactatcagtatcttgcacatgtatatgtctttccttgctttggtttatatcaccttcagaaggggaaaaaaagaagtggatttgtaccttgctacatttcgacaattctttagcggcatcccttctaatccaaccttttttattatatgaaaatgacttttgttcttctgccctgcaaacatgcttctccgattttcatggttgttgagatgatgctaagtatccatgccgtgccggtaacattcagtcatgtgtctcacccttttttacttcctgatagcactataacaatgtgaagacaaaattcatttctcgagcacattaaaacggtagtgtgtttagcaacttagcattcaggcaattctgcactgaaattgcagttcctaagaaaaatttgcttgatacatgattgcatcagacttgcacattggagaaagaggcatacccagctttagatgaactcacctccaaagtcagcaccctcaatcttgagcgtgtgaggcaaatcaagagccgactcgtcgcaatatctggcaaagttcaaaaggtcagcttcagtatatataccacaagcatatgtgaaactgaaattacttcctccgtttcacaatgtaagactttctagcattgctaatattcattaagatgttaataaatatagacatattaaattcattaacatctatatatatgtgggtaatgctagaaagtcttacattgtgaaacggagggagtaacatttatgtataccatggatcagatagtccattaggagtaattctgaagtgtttaagtaacattgccatgtgtatctcgtctgacaggtcagggatgaactggaacacttgctggatgacgacatggacatggcagcattgcacctaacggagaagctcgcttaccagtcatcaagattcgacatcgataaagaagcaagcgagctcgaagatcacaggtaagaaatttttttcttccataggttgatgacacaagtcgatatgcttcatccaaccgttgtcaacatgctacagatgtgtcgtctgaatgtctgaagctctgaatgcagcagcagggatgaagaaggagtcgagggaggcggcggcggcgacggcgacgacgagacgatcgccggcggcggcagcttcagccccaacaccgacgagctggagatcctgctggagtcctacttcgtgcagatcgatggcaccctcaacagcctctccaccgtgagtagttcctctcgccgatgaacgtcaatcatatctggacgtccacccatttattgtatgtcaactaaattattataatttttttttaaaaaaattaataagataaatcaatatataatatatcattccacgaatatataagctatcaattgtaacaaaagtgacaaataaaactcaaattagcagttaaatttgtttttttttacaacttatagaagtagaatttacttctataatttaaacttatatgtttgtgaagtgatatattatttattaaactatatgttaatttttttataaacatttagtggacatgtaataaacgggtggacgtcccctagagtgattagaatccatctcgatttttttataaccactaaatgacctgcattaaacgggtagacatccgctcgagtcattaaaacagattcccctctctcgccattgctaacgaaggtgaaattaaccatctgaatttatctctctctctctcacggatgaaactgaagctgagggagtacgtggaggacacggaggactacatcaacatgatgctggacgagaagcagaaccagctgctgcagatggggatcctgctgtcgacggggacgctggtgtccagctgcgccatcgccgtcacgggggtcttcggcatcaacgtccacatctccctctacgactcccccgcctcctccgccgccttcccgtgcgccgccgccggcatcgtcgccggcagcctcgcgctctacctcgccgccctcctctgctacaagcgcgccggcatcctccagtgacgttattactagtactacatgtaaaagaaacattgtttttagtattaactgtgaccatgagtgattaagaacgagtaattatgcgtgtgatagtgtgattacggtgttctaggcctctttgtttatatttattattactacctctatcccataatataacccataaaaaatgcatggtcaaacttaacacggtcactaatactaatttttgtcttataatttctcatatattataataaggattatagtaataaaattataaccatatgaaagtaaatttaaatatcaattcaatgatataatttttagcaagtaaaattcaattcatactatacacaaaatattttgaagataaaatctcaaaatgtgaacacctaggatggagggagtagttttttttttaagtttactacttcctccgtcccaaaatataagaactttcggttagatgagacacatcctagtatgacgaatctggacgaacgcatgtccagattcatcgtgctgtactatgatgtgtctcatccaaccaaaacttcttatattttgggataaagggaatatgatttataagccgacgaatttaaaaccatgtggaatgacatctctatatttgactatcttacgctattttttttcaaactactactccctccgtaccaaaagaaaacttaacttatggagtttgaattttgtcccacaaaaaaccaacttctaccatactacctacccttagcaatgctttattacttcgataccatttacctattttaatgatgtggggtattttgatcatcttcactctttactactgttgcattgggatgttagggttggattttacatgggatagagaaagtaacttttagaaagtaatataaaaatgatttatggctttaaataagaaaatgctgtttatctgtttagatgacttttcggttcataataaaccgatttataagtctaagtctatacaaagagtattcagggttggtttggtttatggcttaaataggcattaccaaattttgtcagtgccaaattttgacaagttttggcatgattaattttggtaaggcaaagttgtgtttggattgaagccaaaatatgctaagtttactattgaaatggcctattttcttaggcatgtcaaatttcgggttcaaaccaaatagacactaacactattgaaattgtcaaatattgataagtctaatttagacctcaaaccaaaccaacccttggtgtacaggagcttaatgatgaacactctcactgacaaccctggcccagacgtgtgtgccccaactgtcagtgtgtcaccaacaacccagcatctacggccccacgtgtacattccatttttctcctgagcgcagcgatgacgacgaccaggagctgaggagcagcaaaaaagaaaaaaaaatcgattagttcacgcaaaacccaaaaacgaaaaaaaaaaaatcttcattgagtgttaactacggaaaatatctgacgaattcgtcgcgaaatttcgtcctctttttttcgtcagaaacgaactaagcagcggggatctcgggatagcgaatccccagattcggactcgatctcgctcccctccgatgtccgtctcccggctgccggcggcgacggcgacggcgggg

SEQ ID NO: 16084 - DNA, 3022 bp, Oryza sativa
ggggatgggtccagctacggcctccgcccccgccacctccgccgccgcagggaaccctggcgttctatggtgcccagaatggccggcggcggttggatgatgatgatgatggtaatcctaacccccgctcgcggcggaaccgcggtggtgagaacaataatgatgacagtagtagtagctacaatggtagagggaagaggaaattcggtgcttacagtaggcattcggattgggggagggacaaggggaggagtagggggaattcggatagccggagttacgatgatgaggatgatgacgggcctcctggttataggagagagcggcgaggtggtgggagatttgatgatgctgggagtagcatgtcgggggtggcagcgtctaagacggaggccatgggggagtcggagctggaggatactgggtcgaaggtgggctctagcagtaatttcaggaaggatgtcgatccgccacaagaagtggagggcgttgataagttgaataagattaatgaggagagtaatccatcaaattcagaggtggtggagcaaatgactaatggtgagagcactagtaataatgcttcttgtattgttattgatgaggaacagacgaaggcaaaatatttgcctgtgccctcagatgacaaggtttcagatgagaagcctgacgatagtagtgttttgaatgagaagattgaagatgacgagactttagctgagaaagctgaagatgataagacttctgatgagagggtaccaggtgtgaagaataacttgcgtgatgattgtaataatttgctgagctattgcagttatccaaatgtaccgacaaggcggcgatcaatagttgcacacaggaatgcagcaccagcccatagggaagttgctgttgctgaacagattgatctggtttcctctgaagatgaaacccatatggccactgatgttacagggcatggcagctccttgactaatacccaggaaggcaacaaagatggccttgcctgcttggaacataccgatacaagcactacttgcaatcagatggtggagccagtaagattccagacagaggaaacacagattggaactgatgatttgagaggacagaaaaacattgagcaacattatgcagttcacgaatctagggaggagaatatgttacctcctaaagtgggtgttcagcagcaagttgaggaaggaatgcagatttacaatgttgatacaccgccacaagatgaagacttgattgcttcagctgataaagagaaagtagctggtgtggcattattacctagtatcaaagctgaagctgttgttgcgaaggaagaggacaagtttggtcagtcaagttcatttaaaatatgtgatctaaacctagttggtagtccagaggttgctgaattacgaaatgatcctggtttgggtcaattctcaactgctggatgttcaatggagccacaaaatcagcaacaagagtttagaaatacgggtaacagtgcagatgataccaacatgcatgcccaaattccattgcacaataaggtggttcaagttattgatcttgaagatgactcgccaattgaagctggtgcatgtgatacttcaaaagcaaagtgagttccttccacctccctcttatttgctatgtcattctgcttttatatgagtataattttttcttttggtattacggtttgatgatacagtacctagccttaaaggcttgtcccagactagttactattaggcaaccagttttgtgtagccagcgatgaatggtagctggcccagacgctcagcaatacaaaaatacaggggtgactgccttcttccagtcgctgcacaaggagaatgagtctaggcctttgccgtttttttattgtggtggcctttcatggttttgtagagtgcaagctgttcttgctccttaatcagcagacttgctgtcaatctttgtactcttcgctctgatcttaataaaatttctctgtcatctttatggctagcctgactaaaacagtatttgtacataatgcaccgacaaccatctaatttccacatccaacctatgcattagtttatttctgttattttctcttcatttatttatccattgtggctgctaactacatacctttaattgtgtatgctagagaggaaaacatggcaaaccctgctgtgaccacagatgttcttcctggtatccaagatggatataattttgcgatttcagattatcttggtgctgatataccatgctaccaaccaatgcaaacagatcttcccaatgggatgagcctaaatgattcagaggtgaggttttctgatattgttatacatcatgtggaggcttaataataggaaaatagattcaccactatccagtaccagtagtgacatttgaggatttgtgaccatatgtttgcttgacatgcgtagacacatatagtcaccataagttcataatactgttttttttccatgagtaagagattccttacactttttttcctcctgttgcagggcattactgtcatggatgattcaatatatggttctcttagcgatatcggtaattgatattacttaaccactttttcagtttttctacaacaatgtgcgttatgtctttgtcgtgttgattttcgatgttgtatttcttcacttgctcgttgcgaaaggatgttgatttcaaaggctatgaaagacatgcctaagctttaattcgtaaacctataaactgacaaatccttgtagcattattcactttagacaattttggtgtgacaaaccgatttgcaaaattcctgatatttatggtgcctatggtaattttcattgggaaaagcatcagtaccagaagtggttcataatcttaatacctattgagcatatgaaaattgcagccaatccatgacagctcatttctctcaacactgacttgcagttcttttaattcttatggttacaggttttatggaggtttgggaccagcaacctcaggactacgagaagtt

SEQ ID NO: 16085 - DNA, 4450 bp, Oryza sativa
cagcacaatgcctttgtatttacatgtgcaaatattgtaactatgtaagtgcgcgaatcaaactttttatatgagcaaaagatgtactggcatatacccaaacttgtgaatcagccgtttagaccacctgtacataaaaaaggtgatataaaggataaattatactacttaccgaaggatcaaatggcttgccaactgtttccacaactcctacacctaagcttctcaatgtctctactaactgcttgtatatgccttgatagcttgtgctaatcgtctgctctttatcagtctccggggtgatctcttgattcaccttctcaaaactatcaaccagagtcaatagactctgaacaacatccacctgtatatttgaggtaaacctagcacgctccttttcagtctgcttccggaaattctccagatcagcatttatacggaggaacttgtccttccctgaagtaatttcggttgcaatactttcatactgagcagctgagttactcctttctttctcaatggcaatgatagcactctcaattccaccaagagcctcatcatttccatctagaaaagctttcttgtatagacgaagtaggtccttcataggggggaaatcttccccattaacaacctgcataaagctattcagtttagtgaaacttgatgaaccacactctttttttctttgagaatattatgagtcacgctcgatgaaatacatagctataagttcaaacaaaacacccaaacaatcatcaattaccctgttcctcctctcaattcactttgctcatagtagtatgagcattcctttagttatttcattgttcaagttgcaacagtatggatttatagtcatgcttaacaactaaaatccgtgctctacccatagttcaaaaactcaatttagccaagaaatagcaacattagccatgtcgtccaattactcatgtgatgatttagaaagcaacgcagattccaaaattagctcttgttttcccgagtttagccaaccaacaaaaactaacaccgcatggtttttaggttcagaccatgctgcattggcttacaaaaaaaaagaagtatttagcactcaccaaaactcaaaaatgtttacctttccccactaaaatccagcattactcactcgaatgctctaattcaagcttcttactaacaaacaaaatgagctatatcactgcgaacatacagtagaaaaccaggaattaagagagcacaatctacatatccttttttttttaaaatccaccacgaaaacggggctccctatcccctcatcgacgaagagaggcgaaaagaaaaaaaaaattctccacgaactaaatcatcactcctcgaagccgataacagcgagaggatgagaagcggtcaaaagggacggcggagcggagatctcaccttggggtcagcggcggcggcacggagcggcggcggcgcggcatgggtgcgccggagggagagcagcgagggggtcgccggcctcctgctgctgctgctggggctcaggcgagcaggggttgaggcgggtggggctagggttcgggggcggtggaggtaggtggggcttgcggcggcggcggcggcggcggagaaggtcgccgccatattctatcgttttgctactacttctcaactgttcggaaaatactgtactacagggaaaaagggaaaaactgaaaggcaaatgaggaaattacacggtacacaccaggggttggcacttgggcccttggcactgcttgtgtgtaattctacagtggtttaaaattttatatttcatttaaaatagaaataaaatgattaatttaaaatattattcatatgattacagatccagctcgatggatttgtggagttaggaatacacagcttcaagaaatattggatctggaggctggagctatgtcaaacatccacgaagttaaaatttaaatctgaaaaaattaatttggacttgattttaggatttttcatcctagtcaaaattaggcttacccataaattatctttgacccttttcacttatttttttatcgtttattagttgtagcttaacctactagaggcttagaacgtagaagtttgtgaaaattttagaggattctttaaagtttttttttagaatttctttacttcaaagaaaacttgaagtgatattaattatgttaagaaaaatctaacaacctagcggtgtattcttcaaagagaaactttatttggatgcacacaatctacgcgtaacatatatgtgcacatatgtatacccacacatttgaaataagataggtttatgctcataaccatcaagatatgtttacgctcataaccacctaatatatatgctctaaatgacccaacaagctatagagatctacatcaatacaatattatgtgtgtgcaactggtagcagctttgtagccaaacaaaacacaataattcgtgagttcttgtcggctatgaagcatatatagttctggggctagagaaaattataacacgactatttgtacaaactagctactacaatgattattaattatatgaatttggactagagctaactgttcaatttattattatacttttgatatggtcctattgatgtaacatcaccaattcaatattactgaggaagttccctcatacggatagaaaatatatagtttcttgattgtttctatgctaataaaaacaatgtgatctagctcaagcctaaattgggcctaaatatttgcaatttgagcaaaaaatttatttggttccttgctaaaaataaacggtaccaaattttagtataaccaaatttcggtaagccaaaaatatagagataattggagtaagccttgtcaaatctcttcttgttttaagagaagtttttagagttaccaaaattcgataggatactagtggtagacggatagctgaccgttgccattctccaaaattgcaaagccaaaatttgagccataaaccaaagagagcttttcttagacccattttttgcactctttaaagatccagggatataatatggtgtgcatctagcaaaatataccccataattcataggatgtggttgcgaattagccgatgaaaaagaagacaaaaagaaaaaaaaataaaacgaagtatccagaggccacgagtccaggcgcttctcccccccgaagctcgcgcgcacgcacgcacgctgggcgcttcttcttcccccgcgcatcgtccgaaatcctccggattttctgaggaatccccccgaatttccttgcgtcccatcatggcctcctcaggtaattcctccgtgccaattcgtggtattcatcaaaggggggggggggatttctttctcttttttttttcaagcaatggatggtgaatcgagggctaggcgaaattactaattaccctcgccattttcgtgcgtatcctgcccttagcccaccgccaccgcctccggcgatccccatccatcccgcgatccgatacccgcgcactttttttttctcgaatttgcgttaaccctagcttcagttctagaaatttgtttgccttttaaccttgatactaataacaatttgatggttcccaaaaagttcccatgttagaaccgccactgtctattgcaccgtaaaagtatgcagcaaccgaggcgcttgatataatctattgagcatctaatgaagcagggctagatagaaaaaaaaagagaagttcagattgtcacagctgcaactgcaattgcttctagagttttgcatgagaaaatattatcgcagtcttaggacttcttatttctgttgtgaaatcctgggtatgttatcagttctcactttaacactcgcttgtatggtatgattatgcatttttatgcagatgtctccgttgatgttcggccagagtttaactcttttgatcatttgagaagcatacgatatattgcaacagatagaccatggctgagtaagtacagcctgaagctagccttttcttattttgattgatatggccttggtcattagcacaattgaggattaatgaactatcttccttttggtgtctggtttcgctaacagcgttatatggaataagagttcaacctgtaacaccattcagcagtttgagcagtagacctgatctggcactcattcatcaatgcctacctgatgagctgctttttgaggtaatatgtggaccgatgggcatttgtcttcatatttgtatcatataaaatgtattatggtaaaatggaattcctcatctctgtagtataatttgcttccttctaattgataaaatatcactatgtaatatcctcaattgacatataatctttttctgctcaagtatataagtagctttgtggctctattctgtagtacctccttgtatcaaattatcattacatcagcatgaaagaagtgggaatac

SEQ ID NO: 16086 - DNA, 890 bp, Oryza sativa
atctattttggttggtttcgtatgcgatgttttgctcaaatatttgaattttacatgtgaagaggactggaatggaggctaactaccagatggtgcagtcgctatatgattcttcttggaggaaaatgtggatgctgagaccaagaatccaatttgacggtataagttcaagaagaattttatcataacatatgttcaaacattaatttgatgaatgttaaattcatatgcgccaactaggctaatatcatagcacacatcacattctttagatttgtgtggaaagaaattgtctagattttaatcaaactgataaaatgtctcatcatgagctgtttttctctcacttggctgtttaaaattttaatcaggtatgtactgtacaatactggtaccttggtcaaatattgtacaaaagtatgtaagcaaagtaatgtgtcattcattctcaaattttcatgtgtcactagcctagagctcgtgcattgcaacagaaaacaaattgagtttctagcttattaagtcaattaataagcacttatttagtctaagtaatactatgaattttcttttaaacaaataggtgattttgaaatttgggggagccaatagtgaaataggggatgacttgttgaaaggtggtgtaataatatagattgtgcggcccagatgttagtggtaggggtggtgtgggaatggacaccaccactactaacattttaagtagtatagataccggcatacatgtaaaacaacaaaatactactactgtacacatgcatcatactcttgtgaattggctgtgcaaagacggtggtgggaggaggtgcatagcagcgtggaggcggacaaatcacagcatgtgctcaggcttgagcattgtgcactga

SEQ ID NO: 16087 - DNA, 2236 bp, Oryza sativa
ctgcagactaatcctgttgcatactgcgataatagtgtatttggatcagtagtttgctactgaagactagctgaaaggcattgcattagttttggaacttttctgttgttattgctgtaattgctagagtaccctgtattgtggctatactttctttggttctttgagcgaaatttgatacttgttgcttcttcaggtctttatgttagtaggaacacatatatccatacggggactgcggagtggcagttcacaaaaactgtcaatgtggtatgatattatggtggtattattgttcatttgattatacttacctgtacaaataccggtctttaggatttggttactgcatatttctattgttggtgtctgaatagctttagtgtttagtattaatttatgcgcttattgtttccaagttaatctgttaatggcatggtaatgatttttgtttgccccccaggtttgctactatcgttacttgagattttttccaagtggaaaattcctctacaaggttcatatttgaattccttttgttttctacagtatatttctcgttagtgtaacatcggttgatattttaatttcctgtgaagagcagatttccccacagaagattaaggatgttgtcaagtgcatgcatttccgggcatccaaaggtgattgtgtatttaaaggcgactacgtattgtcagaggatggccaggtgaaacttatcgtacttgtttattcgtccttgggcaggatacatcaaattactgccaacattaatcattaattagttttttttctggcacacagatagaactggcactcctgtatccagggcgtcgctacacactagttaggatgcgcctcaggtattttggcttgaacttctgtctatgttttgaactcttgatgatttctcagtgcttctaatttgaaatttgtgcggacattttgtaggcttagaggcacaactctgggcgcaaacaacaggttggatgtattgaagatcttaaccaccggggtgaatgcaaccgaactgagaaactggaaaggcagcgtgcttgaacttgtggagacctgggatgaggatgagacgcatgatccagaagttcctgctgttacccacagcaggggtttgaccccatttgtgtttgttccatttgaggaggtatgacctatgatctatactactgttaggtgtaatgctatgttttcatttgcgccccgcgcttttcttttgttttctatattggaaaattatttcatacctagatagcctagtagaaagaactgactaattaatggctttgactaaaatgttcaggctgatacttcagtgatgaatctgccagtggagaagatggactactttgtccctgggtgatcttgcgcacaaataatagtttttccaagatatatgatgaagacgcaatttcgctgatgttagggcaataatgtgcatacaccatcagacgtcagtctttgttcaatttcatgctcatgttgcttgtatactgttgtatgaataatgctatgttttgttggtgcttgaaagcaaacattttgttggaccatcctcccgcagcaataatggtccaatacttactagtacatggtgttgccttgtaaatagatcatggtgcaactgatgaaacaatacatttgtggttcagtacatttctcaccaaacactggccttgtgatatgtagtacagatgagaaccacatgtaatataatgtaatgtaatgactgctctttctacattgccaggactgcagattaggagaatttggtcctcggatacattctgaaatatacttgtactgaagatgaacattcccagcggtatcatccgcgttgtatatggcttgaaaggggcattatgacattatgagaagatacacttccatgagctgtatatatagctgattatttagggtggctaatttgtagcagagttgcatgaatatttcttctacatgctgctgggtttgggttctttctccgtgatcacgagctcgttccactccgggttgcgagggaggtaagtctcctgcaggttttgaaacgaagacgtcagagcaatgacagtttttgcctcaggccttgagttgccaacttatattgagaatagcatttgcttttcagcagatgtagtttgttactgtcttggtcctcttggacatgaactaaaatttgatgtcagaaatattactcccttcttccctaaatgtttgacgc

SEQ ID NO: 16088 - DNA, 38456 bp, Oryza sativa
  unsure (1)..(38456): unsure at all n locations
tttcttgaatacccaaggaaaacctgatccagctttagggagattgatgcatgtttaccaagtctctaaacggtatgatttttgttaaaaataacttctactttgtgttatatactacaagtttctatcttgtgctcgttttctgaacggctaaacaatgtgatttttttccaaaaacaagttctattgaaaagttgtttttttaaattatttcaatttactagtacttaattgatgtcgttccgtttagcatgcgggaagaagatcccaattcatttttccttcaaaattccttgaaacgacctcgaggttggtgacggttcaaccatccataattctctcattttcctccacgagctccaaaattcctgtgtgttccaacatatttcaaccatccacaattctctcattttgcaatgatcaaaactctagtacttgactataagcggcacttcgtccagacggccactacaaccgtactacttgattaaactctaaaacaacatttgcaattgcaattagtattccactacttgactcacctacactatcgtagtcagataagagtagttctactcatcaattcaatagctgaaatttatttttccccgaacacgaagcgaacgagagctaattgaagagagaacaagatgaatcgatttggggattgctgaacatatttttttttccctttccgattgcacgaagcgaacgagagctatttgaattgaagagagagcaaaacggaatcgatttggggagagggaggggctatagacgtacggagatgtaggagcaggtggggaggacgcgcatgccgcgctcccgcgcgtgggcgaaggcggcgtcgcaaagccgcgccgcgagcccacgcccgcgcttgctccccggcacgtacgtgtgcgccatctccatcaccgctgccggcgtcgtcgcgccgccgccgccgccgccgtcgccggaggaggaggagcgcggctgggcggcggcgaggaggcggtactggaggtaggcctcgccgtcgggcgtctcgaacctcctcgcgtcctccctccacaacacgacctcctcctccgccgccgcctcccgaccgccggccttcgccagcgtcgcagaccctggtgtgttcggccccaaattagattgcaaagccactggaatgttgcgctgcctccgttttttcctttccttttgtttttaattttactgatcaaactgcccgtgtgttgccatggtaaaactaaaattatgctaaaaatatttagtgaatatagttaaaactagttgggtggctagcatcaatttaaaattatctattttttaatacatgattttatttaaaattatcattcacataattctaataattttatagtttttaaaaggtacgccagtcgctaccccttcctcgggagcgcctacggatcgggcgatcgattcggggctgagaaatcgggcgcgtccgatttacgtgcaaaactattttaaaccgatttttctcttaaattaattatccaaatcataatccgattacaccattaaattcgttgcaattaaatcttcaaaaaaagaccacacatggatatattccgacgaaaaaaattagcttattattgattttttttaaatgttgcacgatgttccaccaggtatatcggaattgtctcactaagtagatcaaaaatgtttcactcgtttaaatcaggtgttgtttcaccttatataaaaacaatgtttcagcaaatagtgaaagaatgtttcagttcactacaacattagatttatacatagtgaaacattatgattgcactaggtgaaactgtttgatggtattttggtgattatacatgtacacaagacttactcatgatggacaaagcaaacaagcaatttgtaagttggctagcttatcatttctatgcaatgcttggccatgtatatacacgcaaatacatgcatgcacaggcagctggggatatatatacttagattagtataggtgcatgtataattaaccaataactagccgtgtgaagattggctggtgaggcaatcacgcgcatgcatgcatgtactacagtagacggtcgtatgtgtgtgcatgcctgggtgattaagcaacctatgcatatccgagtgattaatcatgggctcggcccatatggccgaagacgatagctgcctacgcgcgggtggctggacctctatctcgctaagatttcagaagttaatatgcggaagagataaaaccagatgaattaagagataaccaacaaaccaattgattttatctctataacaaacttgatcgagttagttacttcgcgcgagcgctagcgagacgcttatcactggactgtggcccagcagcagagaaacaaagcgaattacaaatcaagtttatctctattgattatttcttatctatagaaataatgatgaaggaatcaccacccagctgcgcatgcgcgggcggctgggcctccatctccccgatgctcagatatttgacgccgggagaagctaagagataaaatcaaagaagaatatgaacagataacaaactggtcgatcaagccttatctacagcgaacttgatgcggaggaaacggcgtgcagatgcggtgagcaccgacctcagatgcctatataagacgtcaacccctcggcagccaggggcattgacgaacttctccacacattcatagaccaacgcatctagcatccacaagcgatcgacacacaacgcagccatccatcctcgacgcggccatccatcctcaacacaatcttccctcgtcatcaacacatccatcatccagcaccggagcaacagcgcgtgcgcggccggagcacaccgacggtggcgagcggcttcggacgaaccggcgtccggcaggggagcacgaggagggagatggaatcgatggtcttccaaggtaaaattaattaagatctgtttccttcttatttcatatgtagcacgtacatacgcatgcatggagaggcatcaactagagtatggagtagtacactcgtgcggccaagtcgatgtgcgctggcgtcatggcgccggatgacggcagcggctatggagaacacctcttttggttggttctcgtcgtcagggcgcacggatcgctgccggcgctctcacacacacatctacatcatcatcacaaccatgcatggagaacgtgaagcgaagacgacgagacgaccacaagcagcttaatggaggttctcttacaggcctaaacctgcggaggtaattaactgggagcttatcgaggccccaggaaccaggagaccacatcgcacaagttagatctgtccaatgacaaattatggagcgcacatacatatatattacattgggaatttatatttatgatcttttaagattaataaagagaatgttccctatgttttgtttacattgtgtatcttggtacactggcacgctcgcacttattttctctctaaacatagagggatatattttcgtatttttccatcctaaacagaaacatttttcggtggaacaaaaaaataaaccaaattcccttaataggtttccaaaatatgtgggttttttttgttacaatggaatatttcgttaactgcaacattagatctatacatagcgacacattgtgagtacactaggtgaaacattttttatagaacaaacaataaaccaattttccttaatagagagtttccaaaatatgtgggttttttattgcaaaagagtattttaattcactgcaacattagatctataaatagtgaaacattatatggatactaggtgaaacatcttttgtgaaaaaggggaggaagaagtgggtgggccaacaggtagcacatgggggaggggcgcgcaccgggggagcgcccgatccggctccccccacgccggtcgcccggcgacaagcattatcgcccttcctcctatgttatttgcttactcaatttaacactacttctattcatacttttttgaactttaaaaattaggccttatagtttttagaattcattgtcttgttggctttcattttcaaaatttttagaagtatcgtcaaacatcgccaatttactattctacgactcgtccactgccacctctctttattgttattgggattttagaaatcaaacataattattgtttgtgttctcttttactttctgtaagtctcgtcaaatcgttagtggctttgccactatactcctctgaagtccgcccactgcctcccctccttattgtcattgagattttaaaaatcgaacatgattatcattggggtttattttttactctccataagtcccgccaaccatcgtgaccatgctgcttaacgacatgcctatcgtcactcctcttaatcgtcattgggattctatttggggttttgtttatagtgtttagatatcccatcaacggccagcaatctactcctttacaggtctattacttctcctctctttattgtcatttgtcatcgttgtgttctagatgtatttttttaaaaaaatgtatatttttaattccgataatttttattcataaattatattcctacttgaactcttctaattatttttaatcttttgaaatttattttatttataatttcgaattttaattagtctcgtcgtttgttttagattgtctcttatttcaataatatttatattttattacaaattttatttattttataatttgtatttaagttgagatcttatttttctttttctattttttgaatttattttattttttatttcgaattttaattaatctcgtattgtgttctatatagactatcttttaatatttcttattttttatttccaatttcaattgttccaaaattgtattcctacttgaactctctctctctctttttttttctaattttggattttatttgattttttatttcaaattttaattaggaaaaaatacgaattacccctcaaactatcgcggtcgtccgaattacccccctgaaccacaaaaccggacatttttcacccccaactatgcaaaccagacgatttacccaccttgacccaatccatagtgattttgtccaacgtggcgcacacgtggcaatccagtcaatgtttttttaataaaaaattgtgggacccgcatgtcatctcttcttcctctctctactctctctcgctcttttctctctcacgcagtgcacacggcgaggacgggcagtgggcgtggtcagttggcgaggacggcgcagggacgggcagtcggcatggacggtaagcaaggacagcgcagatggcggcgcggacggtgcggacattagtgcggagacggaggcggcggtggagctagctaggtggaggactccgactccggcaactcgttgatgcgattggcgaggtaaggacggcggcgcgcggggggcggtgggggcccgaggacgacggcggccggcgatggaggcggaggccgaccgggtgcgaggggacacgcggtgggcggcgggctcctcatcctcgtcgtgggcacacgggaacgcgcggtgggcggcgggctcctcctcggcagtggcgcgcggggatgcgtggagggacaccgccgccatcgcgggctcctcctcctcatcgtgggcgcgcggggactgcggtgggcggcgggctcctcctcatcgttgtgggcgcgcggggacgcacggtgggcggcgggctccttctcgacggtggcgcgtggggacgcgcggtgggacaccgccaccagcgcgactcctcctccgagccggcacgccgcaccccgtcccagctccccgcgcctcgctccctgtccgtcgcatgctctcctcgtccgctggtgatgcgccgccgctggcatagcgaaccgggcccaagggtgggaggaagagcgcgccgccgccgtctcgcttgcctcaccttgccgctgcagcctcgcttggcatcacctcgctccgccgccacgctcctcccctgccgccgccatcgccgctccgtgtctcccgtcgccgccgacccgtgagagagagagagaggaagagtgagacagagtgagagagagagaagagagagaggaagagggagagagaggggaagtggaagagtatgacaggcgggtcccataattttttattaacaaatgctgactagattgccatgtgtgcgccacgttggacaaaaccgctctggattgggtcgaggggggtaattcgtccggtttgcatagttggggatgaagaatgttcggttttgtggttcagggggtaatttggacaaccgcgatagttcggccggggaggggtaattcatactttttccttttaattaatatcgcgtttcttatatagactcttctttcaatattgcttttaatttcgaattttagttattttcaaattgtattcctacttgaactcttctttttttctaatttcggattttattttattttattccaaattttaattaatctcgtattgggttcttatatggactcttctttcaatattccttatttttaattccgaatttaagttatttttaaattatattactaattggactcttctttttttttctaattttggattttattttatttttattctgaattttgattaatctcgtattgggttcttatatggactcttcttttaatatgacttattcttttaatatgacttattttcaattccgaattcagctctttttaaattgtatttatatttggactcttcttttctttttctccgattaatgtggaaatttttagccccacagcgaacgtagtgacttctttcaaagctgttataatataatagatttgtgataagagccgacacatggtgcctagatcaattttgtcagcaatgagaccatccatatatttttgtacatcaaatttctgcataagcccgattgatcaaatgtatcccgattaattgttgaatagtacattctccgttcaacaaccgtattccgtctttcatgaaccaaaggcgaaaaatcggagctagaagaatgaactaaaggtgaaaacagttattgatgtccatggatcatttttggtgatggccagtgatgtatgcagtggcaggtgaggtccaatcttggtgtattatgtggtaaagcttgaaaaacagtgaacttgaggtgaaccagtcgaaagccaaatgacctgggttgaaccaacagggccatggcaatcctctccctttcctccagcatggcggcaccctctctccattccctctagcacacagcgctgctctcccttcccttcagcaggacattgttgagaagggccatgtgtgaggggcatggtaggcggcatcctaggacatggcacattcccggtcgctcatcgtggtgtccgggctggatagaagcgatgccgttactggcttattgcctgcatggcgtcgagaggccctatggatctgaggatgctagcgtggttagcgctggatttttcatattttggtccttttgaaaaacttatttcgcaaataggcccctggaaaaacttatcccagaaatggtcctttttgaagcgccggagtggctggcgccgtcgtccaacgggaggcgccgtcaccctgccaccgtggcacacgcgaaccgatgtggctggaggagggcacctgccatgttggcgtcgccccccctacccacccctcgtctccattcctgtttctctgtatgtagttgtaacggtgtcatttttgttttattttttcagatgttttttcacatttagaatcacgatacagccaaccacaaaaaaatttaaactcgaacgaaatataccacttagctaagtctgaaaataactagaataccacttagaccataactcttttagtaaaaccctttgatcagcatgttaaacataatgcactctagcaccatatgaaattacttaatctaattcaaaatataaccacatgaaatgatagccataagttaaacagtacagagagatgcaattttttattttattttatttttttgatattttttttcacacttagaagaacatatgaactaaaccatagaaaaaataaactcaaacggacaaaatatatgactcgtagaattttccaaagctctaccaaaacggacaaaatatgtcatttattaaaatatgcgtaactttctcatacggactcggaatcaagcaaataatatatccatgaatatctacagaaaaagttacatccgaattccgtttgcaagattgtgttttcgaggagagaagtttttcggtagagctttggaaaattccacaggccacatatttcgtccgtttgagtttatttttttatggttggttcttttgagttcctaagtgtgaaaaaatatcaaaaaaattaaaataaaaaaaaagttgcacatctctctcctctgcactagttcggagagagaggagaggagaggaaaaattctacatgtcacatattacgtccatttgagtttatttttttatggttggttcttgtgtgtccctaaacgtgaaaaaatatcaaacaaataaaagaaaaaaagaaaaaattttgggggggcgggggcgccacccaatctggcgcattccccccagccacctcagcatcgccccgccacgtcggcgtggggacggcgccagccactctggcgcccaaaaaaggaccatttctgggataagtttttctaaggtctatttgcgaaataagtttttcaaaaaggactaaaatgtgaaaaatccaggtggttagcgaggctagatctaggctaatgaaagagtagggatgggagtggaatccgttggaagtctccagataaacttttgtggtgcctttttgtcttttcatgttttcggtaaagaaaatattttctcaaattgctggctagccaaattgacacgtgactaaaccgccacacgtacactatataggactactgtcgctataaaatgggggttatgagggtaatttgtctggtttgaagagttcttttttttctttgggggagggggggggggggttaaatcgaactactacaaaagtagtttaggagtgtaactcgaactttttccttcttgtcaaacatgacaggttgcagatgcagtgcccccacgagtaccacctctaccgtggactttactttgtaaaaacatattcatcacctaaacaaatgtgaaagaagtaaataataaagaatctctcccccaagtagctagcaacacatttttgtatgcacctgtagcacagtactagtagttattactattgtttatcgtctttaattagcgcaaaaaaacaaagaaagatgtgcagttgtattgctgaagaaaacatgcatgcatcgatcttgagagaaagcaaagcacatagataggctaatttctcctttaccttattatctttcatgttttcggtaaagaaattattttctcaaattgctgactagccaaattggcacgtgaccaaactgccacgcgtacaccaagtagaactattgtcgctgtagaagaggttaggagggtaatttgtctagtttgaagagttctatttttgtttttggaggggggcggggtgggggtgaaatgtttagtatttgaattgaggggggtaaatcgaactaccataaaagtctaggagtgtaactcaaactttttcattcttgtaaaacatggcaggttacagatgcagtgccccatgagtaccacctctactgtgggctttactttgcaaaaacatcatcatcacctaaacaaattggaaagaagtaaagaataaagaatctctccccaggtagctagcagcacatttttgcatgcacctgtagcatattactactccatccgtccaaaaatataatcatttttggatttcaacacagtcttcgagatactactttgactaacaacatctataaaactaagatgttttaaataaaaagagttgcatattataatagtttatttaatgataaatccagtaacatcaattttacataattgatcttttttattttttttattaatagtcaaaattaaaaatgtttgacttaacactgtgctaaaaatgcttatattttgaggagtagctatgctatggtttatcgtctttaattagcataaaatcaaataaagatgtgcagttgtattgctgaagaaaacatacatcgatctttagagaaagcaaagcacatacataggctaattctcctttacctttttcttttcatgttttcagtaaaggaaaagagggaataaatcaatggaggcgagaagcaaaccaaggtgcaaagcacaaagcaaggaacccctgcgtatgctagcattagtggaagggaagcgatcgagaagataccaaaccaaacgaccaattaagctatctattcatctagctgatcgagccttctcctaacatccgtctcgtgctcgcgctcgcgcagaagcccatctatccaagcattccaattgctgctgcttccatcggtcggccagaattgctgcatgctgttgtcttaagttatttggagcattcttcagttcgtccatctagcctgacttcatacttgcttcacctggctcagggcctctggcgctctgctctatatatatactcaggtacgtattagtaataactaattatatttcttgtaacaatgcatcaacttaattaatttgcggctcgctcgatcagtgttacttagtttatttgttcatcgatctttgaaaaaaagaagaagcagttctactgattatatatcaaaacatcaattgattatatatggttgatgtaattgttgtgtatatgtgtgtaggtggcgagtggaattgatcggttgatacaatctgatacgatgggttagattaattgattttctgacgattctcctcttcctgatcaccatgattaaagctgtacaccttctaattgcactttcacattctcgaattatatagcatgtctatttctgtgtttatttccttttatttgatcaattgatttgagacgttgatggcttaacgtgcgcacataacatcaatattagtcgtccatatatatatatattcgcgattataattaagtatataagtgccggaatatatcttggcttggggagggggcttattaattagcgccaaggtgtgaaatggtttagctagcatattaaaacaaaataatatgcatgcatgatgttgtttcaatggcctaaaggaactggcatgcatcgatgtttgccaatttttatctctagtaaagaaaagcaaagtagatccccacatgctcagaacttgtttattatttttatttgaacagaacaaaattcactagcagctggtgataaaaaccagttgattacatatgcactatacctatagcatatgtatgtatgtgcaagttaaccatgtatcatcgacctatcgagcacgctgacgttaaccaagcaagatggtccgtgaatagaaaagcacagacactttattctctttttccttcaaaaataaaattcttcaaaaatgacacatagtttgttaaattcggactccactaagaccccgaatgccagaaatatttttcctacatccgaaggcatcatgattctccggtaaatgatttacaaaaaaactagatgagtgcatatctctcattagctttgttttgtaccgtgttagctagtacgcctgcttcagcaactcctgttgagtgcaggggacattgtagagcaagatagttgttggtgtcctctgtaatataaagtcaatcttacacagtctaatttctattattatggcagaatgtaaattgggatacttttgattgggctgtgcaagggatacttgaacattttgttaaaaatcagagggacacaagagttatatattttgatggctggcgtggttttggagcatcagcagtccttagagctgtagcagatgagcttacatctcgaggagcttggccagaactacacattgataaagtaatccagattgactgctctacatggaaaagtagaagggcaatgcagagggcaattgcagtggaactcaagcttgatgattcggtaattgaaattattgataagacagatgaggaggatgattttaagggagtggatgaaggctctagaagcgagataatgagtgttgcagaagtgattgatcaagtcctcagggatcacaaatttatggttgcttttcataatggaagtggtgattacattgatttaggtagctttgggttcccgcaaattacactatttcgttccaatctaatattatggacctttcggaagaggttccaaggaagggagcgttactctgagataaaagacaaagtgaagaacacccatttattcgcatttgaaacagagtattatataacaagaaacaacattctcttcccagtactgcaaaaagaggctgctgccatagctgcccattatccttgcatgcgggagatcgacccggaaaggatcgtgcattgctgtctatatggactatttctctatctttgtttgcccaaacatttggagaatgagtgggcagcccgagcatcagtgtactggatgtgtgatggcatcatacaaggtgatcaggcatgggagataagcgctgcactttcaaaagaaataaagtgggatctacaaccttctttacaagatgaggtgcgtcaagaattcatagaatcatcctcaaaaaactctgtaagtatccagagattcaaaaacagatactttgatgggcaaaagttttacccttggatcacaatcactgcatcaaataatattaatccagaaacactacaggacatccgatccaaaaatgcagaggcatcgtcttatttcttggctcctgaaagatccagtgatatcacactagtgttatctgatgggttgtttgaccaatggaacaacctccaagttctgcagttgtcatattgtgacttcagctttgcatcaccaccttttattggttgccagaatctaagatttattgggcttgaccactgtaaagataaaaaagaaggatgcaaacaaagtgacctaaggaagtggcagtttctccatagcttattagttttggatctcattgacactatctggtaccaagtattttccgaagacatggcagatctttttgttaaccttagggagctaaatatagtaggagtttattgctctcacatatggggccagctacaaaataagattgaatatgttgatttgtctaggaaaaggaatataaaacttccttccactctaagattcttcaggcttgatgaccgtcaacctacaccgcagtccacaccgggcattgaattatcgctaaaaggttgcatgggattggaaagtttattcctgagtcgaatatccaacctcacggagctggacctctccggaactgcaatcaggatacttgacttcacagctatggtggtggaagtctcaggtttgaaacgactatttctgctaggatgcaagcaactccaagcaataaaatgggacaatagtggttcaacgataaagccggacctagagttgttgtgcgttgacacaaggtctagaagtaaatatcctcagttatttgttgacaagaataaatcccccggtttcttgtcagtccatgctgttattgtggacgcgagaattgctcggtccttatgcgctctaatagagaactcatatcatgttgatatgcatatccatgtcacctcttcgaccatatatggtgaagttcaatccgaaggaacctacaaagatagcattagccaattaagtgatcatgtgaacatgcagcaacaagaccttatttcagcaggccagtaccatgatgtccaacttagcatggttggcgatgtcccaatgcagtcattcccccttcctccgacaacaatgttgagccgccatatcgagattgcacaggggagccacaacctggagagcgagctggatgatgattcaccgattcttactttagctcatctagtgcaggggaaggctgagtcactgcatgtgcatgatctctcaaccatcactcctttgcccggaggacaatggtgctgtctcaagtggtgtcgtatagagaggtgcccgaagatagaaattgtcttccctaaacacgcatggaatttctacggtctggaaaccgcctgggtgtcggatctcttgatggcccgttgcatctggagtaaaggttctctccagtacagtggttccttccaaaatctgcagcacctgcacctgcgcagctgcccaaggctccagttcgtgctcccggtgtgggcctcctccttcccggacctgaaaaccctccacgtcatccactgcagcaacctccacaacatcttcgtgctggacggagattacccagagcaaataaccgtcgaaggtgtagcattcccgaagctaaccaccatccacctgcacgacctcccgatgctgcggcagatttgcgacgtcgagttcaagatggtggctcccgcgctcgagaccatcaagatcaggggatgctggggcctgcgccggctgccggccgtcgctgcggatggaccgaagccggccgtggagatcgagaaggacgtgtgggacgcgctggagtgggacggggtggaagccgaccaccacccttccctcttccaggcgccggtgcactcgcgctactacaggaagaagctgcccaggggctccgtcctcaggtatatatacggtgcatgcatcggaccatgtacctagctagctgctccatcttgatttatttgcataatacttgttctcagttatttcatttgtttgatctgtgcttaatcaatttgctttctctgtctactgttatatttgttgcctaggtgaattgaatccctgggcttgggcggccatgatttggggattgattggcgacgaatgatggtgaatcagtgagatgcttcttgcttgcttctgttgggtgatttgtctccggtgatgttgcagcaagctttgtggtgtgagctgtgtgacgggcacggactgaccgtggctcgatcttgtcctcgtatatggccgagttggccagagagcgagattgccatggctctgaaataataagcggctttgtttgtgcgtggatgcacagaccagctgattgagtgagtgtgtgtttcttgaatttaattagcattctgggtgtggatgctcagatgcatgtgtgtgtgtggcttgatatgatgatctgctttgcgtttgaaacaataataagcagtagccatttgtgcctgcgagcatatgtatgtggctgctgcagtgtgactgtgtgagagtgcattgcttgtgtgtaactgaattctgaagattctgaacagatgagcagctggttgtgtgtgcttgcttgcatgcatgcatccaccttgctccaatgcgtgtatgtgtggtattgtaattatcagaagctatagtttgatctactttctcttctgtttcccagggaaaagagttaaccatctcttactccttgtgttaacattttctttctttttttttgacagtggagatttcattacgcaaatgaaagcatcctgcttctgcactaaagtgcactaagccaaaaacagaaccccttaccttttcccaattgcatggtatgtttgttcttttttaaaaaccttcttttttaacgaacatggcatgttttttcaaacattcagaaagctctcagagggaccagatttaagtcattagcagtgaaccgaaggtcgctctgatgattatagaggtttagaacgcaaaaggtcccgccaggattggaaacgcaaggtctgattctctttttcatcacaattttttttcctaagatgtatcttcttgttccataacaaaacacacgattacgtcgaagtagcaacatacaaactacacaagtaccaaaaccgatatatccaggattccaggtcaaatctcatacgcgtcaaatccatgttcttcacataaatcccctgtaaatccaaaattaagctaatacaacacccccgaagaatatacaaacagtaacttctttttttttaatcccaaaaatcacatagaacaaatgttccatgatttcacaatcttgaatagtaaaccacactagtcagctctgccagagaaaatgatagcctcttgttagtgacaaaaaatggcaactgtcttcccatgcatccatccatacttattattgcctagcccagcaaagcctatgtaaagaatccactggcatataatacttgtttacaaaaaaaaaagactaacaatgaccagtacttatttcatggtttcttcttttggagggccttcagcaatcttgtcacttgtttgcgtttgggcgtctttagactctatggcggtggcctgagctctcttacttgcgatttctctttgcattgctatttgatcttgcattactttcgtcatctcctttatttgcttctcttctttctccagttgcatgtccattatgatcttagcattcttatcgattggtttgaaatattcatctatggcggtttcctgtgaaataggatggaggataagttagcatgtaaggtccagaaacattaaaaaaaaaagcatatcatagaagtaaataacatgtctgattctgttacacctaaatttccatcctataaaatcatggcaaatacgtaaaccaaacaatcaattaaaccatagaagatacggtgtccttcataatacaacagcatgatggctaatccacctcttactgtcaggtacacaggggtaacttgaagcattattcatgattcaagttgtgagatggttcataaactaacatgttctttctcaaaacaacagtacacatttcctatgcaggcattgagacatcgatttggtaattttattttgtggcaggatgtcttacagcttcttcaagctgctgattgagggcttgcatctgctgaaccatttgacgaacttctgatagaataatttgttctggctgcttccgaagctcttccttcttagcttgggcctggaaaatgttcccaatatttaagtattcgtataaatgaacacagtatggcattgatcaactaatgaatgcatgaagaaaaatgatagatgttatcaccatggtccatggataaccaaccatgctaccttgaaagaattgctttcgcaacatttaaagacattggaaggctgagtacttagaacttaataatttctatgctggaattaggttaagtgagcttagcccttaccaacgccaaaactataaaaaaaacagaaaagcgtaatattttgtttctttaaaaaaaattgtttgctcccttttatttacatatcccacaaggacccacattgtcttgtactccctctgtcccaagataactcatttctagtctctaacatttgtcccaaaataagttcatatctatccctcttcataccctcggtctgcaaatcgagttttatctcctccataccctcttacttgcccacccactaatgctactttcctattaatgaggggcactttgttcttttttcctccatactaactttttttttctcgaacacacagaaaagcctccatactaatttgaatcccacttgctagaagtgaagttattttgggcggaggtacttcaaggcagtgcatcatggatcagcaggggtgtgcataataaaagctaacacaacaaccacaccgactgaacagccattacttagcatatttgctaattttatctattggctattcttcttacgaaataactattcaaaagcaggcaattattcaaagtaattgagcatgtaaaaatgctacaacaatccgtggtattttacataattgtatgcagaagtaacaatgccaagtaagcacagttaccctgtacaaaagatatggaagtaaataatcattcccaatacaacgtaaaaaaaacagttctttgtggcagtagaaattgaataaggctacaattagtgggatggcttatctgaataaaaagcagttggtaaccactactctgtaccacttgcaggacatagctgatattttcacaatcaatgaaaccagcaactgatatgcattgtgaggcacccgaaaagagcacagttgtcaattaggcacagaaccaatttaccataacaataatcccttatctgtgccatgccaaattgccaatcagctaaaggagaagattccagcctcaattaaacaaaactctactgaaaacaagataaccggtagtacattcttagcgggcaaacccatttctatttcaagcagctcatcccaaagaagacaattactagaagattaagtctcacactcaaacatggtaaagatgctttacttttgctatcacataacacaattcatagattagatatatcttcgaagaaaatggccgtggcatggttaaaaaaaaacaaaagcaaaaagcacagccttaccctcgcgatccgctgctgcatctgcagcctgtgagcacggatcctcctctcctcgtacccggacagcacccgcaccacgaaccacgccttcctcccgaactgcaccagcttatccatccccggccgcctcgcccccccacttcaccaaccccacctgctccaatccatccaagaaccaaccgatagcgtcatcaacaacatcccctttttttcccctggaaaaagcgaggtgcgttgctattcgattcgaaccgagatggatgcaggtggaaccgagctccacggccgccgcgtcgttccgtccccgcctcgaaaccttctcgccggccgcgcgcgcggcgcgaggaaggatgctgccgcgcggggaggtacggtgggtggcgactccggattgcgcggcagatcggcggcggcggcggcggcggcgagagggagtggagaggtccagagccgcagaggtgtggggaggaaggagagagagatagaaatacaagaaaagggaagggggcatttggttattcgccattttctcttctctccttttcatttcctggcaccgccaaacagccacggttccatgcaaattggtgatagaaaaatctgaaaagaaaatatatattttaaaaaaatataattgttgataatataattacattgtagcttgtatataaatataatcttgtggacccatggtcgtagcgtcaaatccccttgcgtacacatatatgttgtattcttttacttatccacctgcataaatcttggagtacatctaaccgtgtaaaattcgatatattatttccacaatttctattgataaaaatctagccattttaataaataatgggacgatcagtcattcccgcttgttgatcgagaattttctcaatagcacattctgcaagaatagggaaatataagggatgttgagaagaaacttagtatgaatatattgactaaaaaataacatatataaaaaggtacaggagaataaattagagtaaaagttaaagagccgaaaagttgctctaatcggttgagttacgggctttcgacaaataagttgttaaaaaatgaacggggcaactatttcatggtaaaactttttatatttatattattactggccacaatagccaagggggtgtcggtggtggcataaagccgatggagactgagatgggatcgccttgcttccccgcacgtggttgtgatgttgtcaagacaaaaggggaggcgtagcatgggtcgacatgtctatgcgcaagggcacgatcaaattaggagcacggagggcatgggaaatggtgcatcggctctccgaggtcgtctgttcatggctccatagcacggtggggaaaagggcagggtgcgagctgtgaggtcgtggcatagttgagctcgattcgccagcacgagttcattgtcactgaagcataattgactggcatgatgatcctcagagattcactaaggtgaggcgtaggtttcccctaaattgcctcattcggagcatggcggaagcggcacactcgttgtggtcatcatggaggagcggcggcgtaatcattgatctagagaaccgagatactatcgttggtgcagcatggaataatgcttgagaatgtgagagctggggaagagaaggaagaaggagatggagaggagggagatgagttgcccactaacatgtgagacccacgtggatcccacttatcatgtcagtcaagaccagccactatattggcatactgccgagggaataaagttgatacggtgttgttagttggtgaataggctatacttggttcaggggtaaatttcagactcagcgacgatgagggacctaaagtgaacctattcctaggtcttaagattgtttgtgcagtcttaaatgggcctttccttattggggaaaatttttcagtttgctgtagtagcttactcagctgagcgcatgagacaaaggccgagtttagttctaaattttgaaccaaaaaaacgtcacatcgaacttttctacacataaacttctaacttttctatcacatcatctcaatttcaattaaacttctaattttagcatggaataaacacatccaaagttattgttttttttttaaaaaaaattgtactatgaataggcagggagtgattgaagtatgttcagttcactggcatcctccgctgactaattatccaacggattatataaagtggattatctatttgacttgactataatataaatttaagtgatataataaatacagtagaaaaaagttcccatagaaaatgtattttaaaatatgttgagcatataattcaccgtaataatctaattaagcagggtataaaagggacagggcaatcgacccatgccgaccgacggttcatgttgttccgctcctgtaagtagtaaccaaggttgacagtatcccgatctgtattctagtatcttacgtatcttacgatactataaacttatcaagccaaaacgataccaatcccacctaccgaaatgataccaatctcacataatatccttattttcatagtatctcgattctactattcattaacacacgatcctataaaattttagttagtatcccgattctacgacccttacgttccaacaaaatattatttataataagatgatttgaaaataatgtaaataaatatgcttaggtttatattataatcagttaaatatatcaaaaccaatgtgatttgatctcttgataaatgtctctatttgcatgacatatattattactatatttttttatatagaatagctatgtgcaattaatacaaatattaattgaacttaaaaagaaaatatcataatatccgatactacaatacaatcctatgatacgatattactttgagcaaaacgatactacctagaatcccaatactgataaccttagtagtaacacggccatgcatcgtgccatcccaagggggttttagtactaagagcaggtacaatagaagactataatctagctataaacatattttaaagagataaaaaaaagagagagaagagcagcgggctacaaatctgtagccagctgtagcacggactccaagacgtaatgtgtgtatgacaggtgggaccaggtattaatagtatagtaagcaactattgtatgaattgactattacattggctatagatgatttggagctagtagttggctatactattaaacttgctctaaggttgtattcttttcccctctttcccaactcacttcccttgttttccacgcgcacgcttttcaaattgctaaacggtgtattttttgtaaaagttttctatataaaagttgctttaaaaatcatattaatccattctttaagttttttaggctaatacttaattaatctcactataatcgcgtgctttgttttccgtgtggggagctcccgaacgcagcctaagaaactaagcaaaccctcggggtccgtgaatcatctccaccaacctccaaactaaattttgggaattctagaaaaagtcgaggtacaacagactggccaaccaaccatctgactggccaaactctttcgctcactgggcagaatttgctagcaaaaatgccttgccaaattgttggccaagtgcatcctcgtggttgtgcgccatcgttatctgcggccttctcgagtcgccaccttcgcatcctcctaccatggtcagctaaagaagctgaggtgaccggcaaggagcggcacggtgagcaggagcatggccgtcgacacccccgagttgtccgttaatgagcaggggctgtcgagaacgttggtccgtgtggcagcttcggcgaggagcagagatagagatggatgaggtcggggagtaagctgaggcagtccacgctacccctgccaccgtccatctctagagctcaggcagcagcatctagatcctaagctccatgccgttgactccccttatccctggcgtcatcgattcctccttcggcacttgcccttccgtcgtcttgactgctgtcccgcctccaacttattcctgtgctgccatccctgcctccgtccctcccgatgttgtctccgcgtcgtctttccccagatgttagtttgttggacagtagaaaagaagggagaagaaggaaagtagaggctgatatatgggtcccgttgtaatattggatatgaaaatagataatatgttagagtgggtaacaagttttgcttgtcaaattagttaaggagttggctatacgagagttttgatttgggtagaccgttgaaaatgctcggaaagaaaaaacgcggccgcccaagccccaaattggtgggtgcctgggtagcatctgcctgcctcacttccaggcgtaaacaaggcggcaccccgtaaccaccagctgcatgcaaaggccccacatcacattcacatggtcgcttgcgcgcagccgccgcaaacgcacgcacgcacgcatgcgatgcgatcaatccattcctccaccgcgcgcggagttggatccaggtcaaagccgcgtacctataggccgtcatgagttggatatgatggatataactctcgggagatcggctcgatcgatcgtcgtacgctttggacggctcgcacgagcgcctgtctccatcggtttcggtatcggcagcaggtcaggtgcagcgtacggtgtgtggacgcggcggcaccggcccgggagggatgccggcctcgacgaggagggcgaggccccatgcagcgcgcgggccgcccatccgcaccgacgcgcgtacgtacgttagctaccggcgaaatcgcggagtggcacgcggtcaccgtacgtctctctctcaccgatcgatcgatggccggcgcgcgaggaaaccgggagaaacggagctgcacgcacgcacgctcgtcgtgccaagccagcgcgcatcgtacgtatacgctccactgacaccgacaccacggcgcggcggcgttggcgcgggcgcgatccaaaccacgtgctcgctcacgtggcgagccttcgacctacggcttttctgtaaccggtgggggggattgtgcatgcggtttcactttcacgcctcgtctcgtctcgtctccctttcctcgcgcgctccacgccatgagatgcgcgcatcaccgacccaaaaatggtcaactatatatctggtggaatgggaaccgaaggaatctatctcagcatagtcctgttacatttataaacgggactaaaatttctttttttaagtctcggtttttttaatgaatcaagattattatggatttttgccgatcaagtaaagatagtttctccggtagtacttatactcccttccatcctaatttaatcatcatctaagagaacgcagagatcgaaaataataaaaccttcattattaataaattaatcatcatcggttaattaagatgttctgtcgctttgtgttttatgcattacatcacattttaagtattgttccctccgttttataatgtaagactttttagtattacccatattcatataaatgttaatgaatctagacacacatatatgtctagattcactaaaatctatatgaatttgagcaatgttagaaagtcttacattatgaaacaaaagaagtacatggcatcgcaacaatagaaattaattatagttggttgcatgcagcgcattcaaagatattcacttactctttacacaattaaatgaaaagatactttgttagatgatgattattttgagaatgtctcaaaaaatttaggggataattaaaattggatgaatggagtatattcctacgtgtgttttgcatcgtcggtgaaaccatctctttctttaagtagaatcaccgtggatccaatattttattctcaattatctttttctagtccatccctaattatataggtgtagcttattataaactacatgcatgttaaagtagagtaaatgtaacggtgatttgtctaaaagcagttatgtgtgtttcttttataaaaaaaaaattgctgacacgttttggtaacagacggaaggtgtcactggcggaactttgaaatgcctctttccaggaagagtttgacttcttgcatgtcttttatttgagcatattatattaaatagaaatgattatggccatgctattataataaagagacatataagtacttaagtactgatgagggcatgactaagatataatcatacttatcttacatataataagctttgctttagcttgttgacatgtaagataaagtataattatatttgagccaacgatggctttgctttagcttgttgacatgtaagataaagtataattatatttgagccaacgatggcctcatcagtacttatatgcctatttattttatgttttctatattatttttttattgtatgttcaaacaaacgttaaatactgcatcataagttttgtatcttctcgtttgcagaaatatttgtgcgggtgaaggaaagaatatcggcctatacagaaggattcttgaggttcataagtacgtgttggaaagcttatgaaatttactttcatatggtttcgatcccacgtcaaaatttctcctaagcagttgggaatctgcaaaacaagtcacataccttattcatttcgagtctaatttaggtcttgggcttttataattatgtcgtgggctaagcgccagagatgggctaaccttaggatgttcttaatcatatttatttagtagctgtcatagtttagagtcagggtttcgcttatattattctatcgttgtagtttcgccgcttagttcggtctgaggaaccttaacttgtgagcttcattgtatatttgcaatatattcagattgattcttctattctcttgcttgtcttctcgattcgcttgcaggagatagccttatcggcgaggtcaaccatgtttcgattcaggtgataaccaacggaggggtggtgtaatgattgtgaggggttagaacgtcctgttcggagcttttgtgttagcaacatcaagtctccacagtcggcttatccggtacctagtcctcattaagagctaaaaacatatacagcaaatattaaaacatcgtaagagatgcaagcacaactacaatattaatcaacttctgacacacaaaagcatatgaacgagcatcgaccattgtctctattcttccggtagatctttaaaccaatattatcaaataaaccattggcatgtactctaaagatgttacagccatctggaacatcaacaatccaataggtaagactctttaggtcttttattagggatggtgttgccatttggaacatcaacaatccaataggtaaactccttaggtcttttattggggatggtgttgtcgattgaaccattgataacccgataggcaagactctctagtgctttatcgtgggcatcgtggagaaagaaaagataaaatattttagacaaattaagtttttaataagcaccatgaaagacaaaacctaaacttttataataaaaaaaataaaaaccctaaaactgacttaagttaaagcaaagacgggatctcatttcccctcattgtcagtgttgatcccaagatggaggagcggggatcacttttgaaaatttcatagagttcgacttgtcacatgtctcaaaattttgcatggcttattttgattttggtgagaactagccaaatttattggtgacgaataggctagatatattttattaatatacaaccatgtatcatataaaccttttccatgtttanattttataaaatttgggtttttcttatactttcatagttgttctttaatacatgttatattaacttaaacctctatatcgtgcatctaacatggtcaacattgatacgacatgctccattgaaattatgccagcatattacagtaaatgactaaaataaaaataagaattaacacatggattaattacttgcattttgcggactggtagactggtaatagtaccatgcctaccgtggttatgataaaatgagcaacttagggtttgctaatccggaccgggctcactttttgtgaagcctgcctccattgtgctcgagacccgactggcctacgagcgacagtgagaatttttccgtttcctagttattatacttcaatttgtgtgataacgggttagaatgatttattatgttacaccatcaaacaaaattaatagccaaatatataatttaatatcaattgcatcctctatacggtcttagttacaaaattaatagccaaatatataatttaaaaatcaattgcatcctctatacggtcttagtatcatgaaaatacaatctattaacttattaaaataataaaaagaagctccacgttcgctgtctggcctataaattctcatataaatcagagaaaaagaataacagagtccatataaaaatacaattaaaaaaagcttaatttcgaaattaaaaaataaggaatatttggaggaggagattatggcccatacatatatacaatttagagctaagtgaaattcgaaatcaaaaaataagaaaaaaaataaatttaaatgttagagtccatataaaatacaatttagaaataaaaaataaaattaaaagaataagggatattagaaaaagtgcctatagtacatatatgaatataatttaaaaataactgaaattcagaattaaaaaaaatattgaaagatgagtttagagtccatatacaaatacaattacaaataataaaaattcaatattagaaataaggtatattagatgaagagcgagtccatatagaaatctagaactaatcaaagttcagaattaaaaaaagagtagattttagagttcatatagaaatacaatttagaaaaaaaaataaaattcgaaaataaaaaaaaatagaagattgggagaagaatctatagtacatataggaatataataatataatagtaacgaaaattaaaattttttaaaaaataaatattagaagaatattatagagccatataggaatacaacttaaagataaccgaaattcagaattaaaaataaaggaatattaaaagaatggtgtaaagtatatatagaaatacaatttagaaataattaaaattagaacttaaaagataactactatctatcgcgtatatacaatacaataagaatattacacattgctaagtttgaagtttgctcagctaacacagaatttaaaattatattattattttaatatatcttttaatagaataagtaaatatgtatgctatcatacgaggaaaatgaaaattcaacctctgtaaagaagaacgtatctggacatgaaattgggtttttacaattttggacggaagatgcacacgcacaaggaccttaccacgtgaatcgaacggttaaaataacaaaaccgcccaaaacaaacaaacaaacagataaataatcagaagcacgcaaaatcataccacgtcataatctaatcaagcaaaaaaaaaagaaaaagaaaaaagaattccaccccgatcctcactactgtgtcactgactcactgtagcagcaacagcagcagagtgtgagtgctcatcaatccagcccatccccctgctgctgctgctgctgcttcgctgagacgacgagaggaagaagacgagcccccaagccaagcagacgcctcctccttcttaagcttcccaattctttctctttccctcctcctccgcctccgcctacgccttccccgctagtcccacacatccggcgaagattccggaagtttcgtcgatcctccgatcgatcaagcggcgagcggcgggaggcatggagaggtacgagctgctcaaggacatcggcgccgggaacttcggggtggcgcggctgatgcggaacaaggagaccaaggagctggtcgccatgaagtacatccctcggggcctcaaggcgagccttcttcgcttcttcttcttcttcttcttgtcccttttcgtccgctctgttttcctgatcgatcgatgggtgtggggcgttttttttgctcattcgggtggtgatctgatctctgcagattgacgagaatgtggcgagggagatcatcaaccaccggtcgctgcggcaccccaacatcatccgcttcaaggaggtgaggccgtggcggggggcaaattgggtgttcgcccctgttcgtcgcgtcggtggcgaagaatctgtttgtttttttttcttcttgtgtgtgtgtgtgatggaagaatcgtgccttgcgatgcaggtggtggtcacgccgacgcacctggcgatcgtgatggagtacgctgccggcggcgagttgttcgaccggatctgcaacgccgggaggttcagcgaggacgaggttcagcgatgctcgaatcgactctaatcaactccatttcttggtgagttcttgtgctaatccgcgtgagaatggtgggcttttgcaggccaggtatttcttccagcagctcatctgcggcgtgagctactgccacttcatggtaagaacagaaaaacgatcccagtaaacattgcattctttttttaaaaaaaaaaggatgggaaagtgttcaaatgtgaaattattattcgtgatggattcgcagcaaatttgccaccgggatttgaagctggagaacacgctgctggacggcagcccggcgccccgcctcaagatctgcgacttcggttactccaaggtagggagaaggccttctttaaccttttcttgaatacagtaatcttttccctcgaaacctgcctcaacacctcttttccctgcccggatttcttctagaaatggacaagcttttcttttttcccttgtcaaaaagcactctatttttaaatgatctatagtcgatttaattacctataaatatatattacactagtaatatttgatcttacctgttatacatacattttaatacatacattttaatatatgctacagctaactataaataaaatttatagccggttacttttctcttttatcatttatcttcggtttatagttacctagtctcaaaagatcaaaactttttcttcactgtttcaattcactcccccaagaaacgccattgcttgcaaacgttttcttctacaaatgctaaaaaaaaaaaaaactcctatgtgctttcttgcctaattttctcccccttttcttacgcgcaactgcctaaaagaagcaacattttcgctttgatcgcaacatgacgccttttttgtttcttctcctcgtcgcagtcgtcgctgctgcactcgaagcccaagtcgacggtcgggacgccggcgtacatcgcgccggaggtgctatcccgccgggagtacgacggcaaggtcagtcacgcccattcgcccatcacttccccttgtcatctgtggcatggtggtggggcccactggcagtggcggtagcgtggggcccacctgctcctggtcctcagcgctgagcacgtgccgtcccctgggagtccacgtatcgcggttctcaaggcaaacactaccttggaccgtagacccggcctatgggcgagctgggcagcatcggaaagtgggtcccatgtgtctgtgagtgttgggtctatgggctactatgggctagggtccatgggggggggggacaggtgcctctgggtggtggatttgggatttgtcctctaggagagcggtggagatttgcttgcctgcggccggacagacgcccactgggctgtgggcccgggattgtttttagcccgggcccacacactgcctcgtgattcgtgacagtagtagtactagtacatgctagacagtgtgtagtagtacgcgctaaacaggctgtgtgaaggggccctgagaccatatgctgctgactgtcactctcagttcagctgagtgtgttttgctcaaaaaaaatagaagaagaagaagaagaagaagaagcttgagtgtgtgtttcttgctgcagctgagctgagctgctactgtagtgcattagattcccagctaatgatgctccctccagtagtggtagtagaactccagtgttttttgttgaaaaatctcttctgtaaaagcaagggagggattattcaaaaggacaggttccttccttttgtgtgtgtgtgatgtcgatctagacattcacattctctctcggtttttttttcggtaatcaactaatcacacatcacgcttgatggggatgctcgcttcgacgaggcgtggcggctgctttaacagcacgccagacacaaaagaggagggggggagaaaagacgggttgatcgaattcgagacggttttagtggtcaagagtttgcaccctgtagcttgttacgtgcccccacttgttgctttattaaaatgtggtggcctgaggtaaagtgagattagccggtgatggcatgagattctccagggtacagatgcgagatattttgcttctcgcccgatttgggcagggttaaaagttcggattctttgtatgtttggttgtccagtgtgttttggcgagtgaagtaacggagtgtgattttgtctttagttacatgcaacgctaagaaaggaatgatttttcatcgtttgggattgaaatggaacagacgtgtagggattaggtgaattgtgacaggatccatgaggtagacgcacccctcagtctgtatttgcagttatgcatgtcattcggttggacagcttgcaatttttgttgacatctttttgggttcacctcatactttatgtccttttctgagcttttttttccatcatggttctagtgctacatattagctaattgacgttatcacaatgggccctcggacccaatccttttcaggtagacatgttagactgaacttctctttggccttttctgtggttattaattttctctctctccttggtgtcagttactgccgtcatatcttatgaacgattttcttcaggacagtgattgcattttgttccttccctatataatacatctactcaggctgcttagatttttcacgctgcaaaattggttgcttttgattgacaaagtggacactgccatagataatttgtagatggaatatcaagaaacattttatcatttgcatctagatgttctttttttacaaccataatgtgcccttgatttcaacaacctataatgcttatttccgagttatagagttatgtatttttcagctgatttgttcccgtcatctttagactgccctcaaccacctgttttttatttgaattaatgctggaataatctattgcataaagaaaaaaaaccactgttgtaccgctttccaaaagattactggatgcgtatgtcctataacagtcatggttgttagcctacttagccattaggtgagaaagcacaaagtgccccacagcaggtaaatgtctgtggggggaatatgtaattaccgaaggacatggatcctctgagatcatcttttctatgttctcatgataacgccaccaccctaataacgaatgtcaatacttatgcttaccataggtgtgttctgtcattacctgtttttatctttgctttagtacataagcgtagcactgatgcttgtctgccttttgaatttaggttcatggaagtgcacgtcatctttcctatcattcagtttattttgtacagaagttagcatccattgtgaacatagctgaaatttgcgtacttcggagagttttgatatttccacgcttctatttggaactttgagcgtactaaacataagtgacagcatgctgtgcagaaaataaaaggagccaatcaaatagatgtgctaaatggtgtaatagagcctttgatttttgtttcttggaccattttaaattacagagattattctgaaatgttttgatgatcgaaacaagcacgattaatgttctacaggctgttctgccttaatattctactagaaagaagtgtactttcatacatcctgttcttgcttgtatttatcctttcatttgtttctatcttatctcctgaattcatttacttgtctcctaacatttttggattggatggttgatgcttcagacagccgatgtgtggtcttgtggagtgactctttatgtgatgcttgttggtgcttacccctttgaggaccctgatgaccccaagaatttcagaaagaccattggggtaacaatttaagaacttttcagctaagcattatcagatcacaacttctagtctcttatgctttgtgcattttttgttctcagagaataatgtcaattcagtacaaaatacccgagtacgtccatgtatcccaggactgcaggcaactcctttctagaatttttgttgcaaaccctgcaaaggtactactctatttaaactcagatcaacttactagacctattcatgatttttttaaaaaaaaaatcattcccaaacttcatacagagaataacaataagggagatcaggaaccacccatggttcctgaagaacctgccaagagagctcacagaagctgcacaggcaatgtactacaagaaggataacagtgccccgacctactccgtccagtcggtcgaggagatcatgaagattgtcgaggaagcgcggacgccgcctcggtcctccacccccgtggccggctttggctggcaagaggaggatgagcaggaggacaacagcaagaagccagaggaagaacaggaggaagaggaagatgctgaggatgagtacgacaagcaggtgaaacaagtccatgccagtggtgagtttcagctcagctgagtatttctgtccagcagcacaggaagattgcaaactggagatattgtcataatgtggcagctgatggtcacactcccattctgtagtttgcagtcttgtttttcttttttcagtttcattttttcttttcttctctttgatgctgcaacagtgtaaattaccaaagtggttctgtcactgtctttgtaatgactgatttaagttagcatgcagaaacataatgtattgaataaaaccatctcattgagcatcttctttctcagagttgcagtccctctatccttgccatcctgttactgctattgtccatgtattcggttcatcgcttgggttgggacagagaggtgagattgcagctcttcagaaaggaaaattttgtcagtaaccggaatggtgaaattacaccctccttaagacaaacgaacaataatggattgtggaactaacaaaatggaccaatgtacatgatcaggggcataatgttgagtccaaggtgtacataggaaacataagtgacaataatagaaaatggaacaatgctttgctgaagaccaaatttagggggttggagtgtgcattgtagttaactgaacacagtttgccactcccactgatgtggttacattcagaatgtgacagcaagagaaaatcctaaacagaccaaagcaagaaccaacctcatcagggtattccgccatcaaaatctgcaacgcaatcggcaattccaccatcaaaatctctgtttgcacaaccaaatcttacacctgaatgatgattcgttcttctatacatatgctgacaatcagaaagtaaatacaatatgatagtgtaattccattttaatatacaatgtaacttctatataactttcatataatttggaaccgttagatttacttcaaagtttgtatgcatccgcatgggtgagatgatttggttccccccaccccccgacctccacctcgtggaaatagcgtcacaccgggagttttgaaaattacgtacaaattatgctgcagttacatacaagttatactacgattgtactatatttacatctgacaaatttagggaaaaaattatcggcaaatgtatagatagcccatgaaataattgcccagcgtaaccacgcctctaggctctagacgccacagcccacagctgcttgcttttgacggcgcttggttgattcttggtcgctaattagtcagggctgatgagtgatgagtgacgagacaagatacaggccaagcccagacagaggccaaagcacaaaccctccagcaaaatttggccaaaataatttgaaatttgaatagcccgataaattttgctaaccactagtaaaagaaaaacattttggtatcatcgtgtcgaccgcatgccactatcttctgtgagatataatagccactgggaatttacatcgcttattatttaaagaataattaacaataaatacaagcatatgagttaaaccttgtaggttccatagttccattcattaaccagctgagctcagttcaccacctgcgaaggaaaattgattaaaagtggataagaaaatatgtgattttgtttgggaaaaagaagaagaagaaaagaccagtgatttgcagcgacagcctagacctgtaatcatttaccgaatacaaaagcctcacagctagcagcattgttcttcgatcgatcagtgcgatgaattagtatctccgcatataattaactaacaggtatacacacattcacacaggaattgacagatcaagatgctcgaacaaaaaatgtacaaatctgacccacagatacctcattgttcaatctaatttttttttccatcgattcgatctcctttccaaatcaataaacctccacaggagtagtactcctatacccaatccaagagggcaatgtgtccatcgaaagcaacacgcgtttgtttgatgctgccctagaaattatcaggagctccatttcctgtcactgattctcgtcagagcaaaacgcagagagctgattaaccaagtcgctgtcgcgtgcttgattccacactgggatatcccagatcgagctgccgatcgatcgatcgtttctgcaagcgagaagccaatcaagaaaaagcttcacgcgaacgcatgcatcgatcgacagcgacaagaaccgtgggactttggagagaaatcacgggcgaaagcgatggatcgaaaattcgaaatatcgaatcgaatcaaaagccggcgatgccggataattctatttgcatcgtctcgttgatagctgctcatcaattgctaagaagctagcttggcatgtggtgcattttcatgtccacctgccaaaatggaatctcccatttggggggtgtttggactcatgcagtgtctgaaactctgaatgcgacctgcgttttctgaaactctgaatgtgacctgaactttttgtccactccttggagaaagaggatggaaatatacgttccttacattgacctgaaaaactctgaattctgagagattgcagaacaagtaattaagcagagtttggtgagattcgatggaaaacatggagcaaaagaacatctttaattgctcggtcatcggaggtaaaaaaacaattcgcatctggttagcgtcgtctggatctggccggggtgagggaattcagcgttcctgcctgtggaatttggaagagtctttgctcctgaatttaagaattccggccaagatttggagcatcttgaataagtcaaaaaagatagttcttgtgaatcgagtgctagtttcacacgtactggttgatcacaaagagaaatcgtacgtgtcgctattcttcaaaagacatagaacggtggatgaatgggcacgcttctcgagcttctaacaatgctgtttcttataagaaccttgcatttatgaatttattagaaatattgttgaaatccattttcaactttataatattcaatttcattcttatgtacttgctctgttccaaaataactcaaactatagggatgaattatatattttggaaaagagggagtacactcggataattatcccaaaccattggactattcaaccatttagtacaaaaaatatattttagtgtcagttacttatgttgttttttcaccttaattatcagctgagctggcgcctagtccaccatggcttttcttttacatgtttgcatgcaaatatggacttttatcgtagtacttcttttaaagtttcaacatgattttgcgtttcgaaatggctgtatggtttacacctttctacacgcaaaagaacacgattttaatgctagggtgaatcatggtgtcgatctgggggaccgaattcctattgtttttcagtacggatcatcctgtttccttttctttttcagatgctatgaagaagaagcaaattagtatgtctcatccatagaattatatcgattctcattcacacgcatgaacgatcgatgctaattgagaaagtcagatcgaagtgggggccattgtgcagatgattaattctaagtagatcactgtctatgatgatctctatcctctatcctcacactgttcataaaaggagattaaaagtgattaattaactttgctcggaagagatcggcacaaatggcagcatttcaacaatgctatctgcccagcaaatctttattaggtgcagaccaacagtttggtgaaccactcctgcatggtgcctacttgtcctactatatgtgtattatctcctttctaaatgcatgtgttgacgcctttttgtaaattcttgatgattttacctttgcagttaaggtaacttccttgcattgtcagtgttgaaatgtgattggagtactacaaagtaactgctagatcagcttgtttactgtatgtctgaatctaagaatctaaggctgtgtttagttggatccaaagtttagattttggttgaaattggagatgatgtgactgaaaagttgtgtgtgtatgacaggttgatgtgatggaaaaggactgaagtttggatccaaactttggatctaaacacggcctaagatatgaaactcagtttgattttgacttagcatgaggtcaattggacagtaggaactttactgttctgtaggagaaaaaaaagataaaagaaaattttcaggatacaattaagctagctttaactctgaggattacttagttagctgatcatgcatatatctaactatgtattaactgaaaattatcatgccttgcttattattatgtactcatgtgtatataattcttttcaatctagtaaatctagtatacatgtatgaactatcaaagtataagagaataagaacaaaattgaatttgaatcaagcatcgcaaatcaagaataaatgaacaaaaactaattagaggcgatcctaagaaataggagaatgaactcatagacgatctctttttttttgtatgtatgtatgaactattaaatttcctgtactgtatatgtttgagattttctctgctgctgtcaccgacatcgccgccgccgccgtcgccgccgccacaaggtcgccgtagccagagccatgtcacgccacgccagcgacatggccatgccgccgtcgccctccacgacgcggaacccgccgccgccgcagccgctcttcatcttgagcagcagcttcgcctggctcaccgtcctcgagctcagcttcacgccgtcgagcccggcgccctccatggccgccttccagttccagctagctgctgcgtgatcgccgccgccgccgccgccgccatggcggcggcggtgttggtggtctagcgaggccacggcgtcggcgatctccctcccgaggtggtccctctcgatggcgagcctctcggcgctgtccgccgggaggcactcgtggagcgagtcgaacacggcggcgaagtatcggaggttggcggcgaaccgcgggagcaagctcgcgcttcttcctgtagtggtgttgtcgccgccggtgagcccgccgccgccgtcgtgtttctcgatcaagaacaccatggacgggttcagggagttgatgtaagccattcttgtggcggcgcacgcttctcttgagctcgccgggaacaccaggttgacgacccccgtcgcgtcgtcgtcgatcctggtgcaatcatggcgggtgttcgatccgttgttcaggatgccctcg

SEQ ID NO: 16089 - DNA, 816 bp, Oryza sativa
cgccaccatccgacgacgtcgccgccattccattttcatggtcaaactcctccgccttcttgaccatccgatctctcaccctgctaccccgatcgccgccacaaatggcgctgctgccgacgccatcgacgacgacggcgccgccccccaccaccttactcttcttggccaccgccgccgccgcatcaccaccaccaccaccatcgatggcaagactcaacttcaagttcatctactcctcgtcaccttgaaatcccaatcgatctccaacctccaagagaaacggattgatgcaatatatcttcttcgtctgttctccaagctctctcgcatgcggcaatggagatcaatggcggaggaggaggaggaggaggaagaggaatgggtggaggcgaaggcgagggatatatatataagcgcgggaattggaggggaatctggcgcgaaatctctcgatcggcgtagctttggatgcaagaaatgcctatgcttcgcggacgttttggctggactcgccattggattccaagaaatggatatgcggttgggtcgtttggctttcctctttgtcctctgcaaaaggatctatctgtctctctctctatgtgtacctgtcatctgtcgatattgtaccggttccactgctaggctaggctaggctagctatctccctctctgaccctctctttctctggtctacatgtagcttggaaagaaattgttcattattagtgtttgtgttaacaatgtgtgtgatagatgttgacaattagttattactcatatatagtagtataattccagtgtcttagtata

SEQ ID NO: 16090 - DNA, 2505 bp, Oryza sativa
ccttttattacagtgagccaatgaggtcagggagaggaattatatgatgagatgtgcaggagacactacagctgcacaatatctcatttcatgagtaggtgttattccttgtacgttaaaacaaggggagacaccatacctctggctttcttatcaattctttcagaacagcatcaagtgttacgcgaagttgcttgaataggacagcagtctgtgcagcagctgccagccttaaccatccatctatgataaccactcctgtctgttaaaaaaaaagacaataagtttccccactgattacaattagctaaagataccatttaatagttaatgcacaaaaatatacacgataagttaataaccaacagtttctaaatgaatttcccttaaacaagaacatgggaggaaaaattgcctaactgatttaaacagatcgatgtgaaactgaaagccctaaaattgatgcaatttttcacttttcacatatattactcacaaaaactaataatttatactgagtagtttctcttttgattgacaagtgccaatatctaacatgtgatgtgagcacaagaaaaggcacaggcactgcatcccttatagaaataagaggatgggggttcggtatcttaagcctaatagtctaggattggatagagaccacaatacctgatgttggataaccatggtaccaccaaacagaaggagcgagtaaggagaaataacactagtatcacgtagaaataccttacttgtctcaacctgaatatagggaatagagagaatcaaaagtatcagagattcaaaaatacaatattttttcctcagatcaccatcgtaaatacttttttatatggtatatcattccacatttctacaagtgtatcttatgcaacataatgataatggtgcaccccattcatgttcaagtcaaaaggataccttctcaagaaacaccaaaaatggatattgaccagctttcaagctgtggttcatagatgatgggtgtatgtgaacttctcgtcgtccatcataccatcgaggacggtcctttccagacagaaaatcagatggcttcctgccacctagagctcctggatcaacaccctctaaagtagctgcaacattagggtatagacctgcgcatatgactgactgcaaatgccacataagcattttccagaaatgaaccatattagcgtcaaattgaactaagtgaaacaacagcttatacagattactaaaggtaaacaagcattacactaggatattaatctcatcaacatgatcatatttattttgtactttggcacatgttaaaaaaagtcaaaaatgtttagcaatcatgccattaccttgacaactgaggagtaacgagcatataagttaaatggaagagacatattcgcaaaccaactctcaagagtatttttcctcgttccatccacaggcctctgaaaaatattaggattaattgacattagaagatcgattatgatgtctgtccccgttcaaattagaaatagaggactttggcagcatttggctgggaaagtacattaccaatttaagttagggtacccttttaaagttcccaaaaagaaactaacttgctccctcaaatttagtccttttttaacattatctaatttttagtcttcatgtgactttgaccattgcatttataacttttcattggtataaattagtcaattgtaatatatgaagtgattgactgaactagtcataaggttgtcactaaggtgctaagagctacaggagcctatgtttccaactacaactctatatgtactgtagcatttagctgtccaatcatgtgatgattatatattgctagtcatcatatacttagcttgtaggacaaaaggactagagatacaaaattgtcactgttatgactcagtcaactaaagaaaatgaacaacatgatataagtctgcattccagtaaagatgatatccctagtgcaattctccataatgaaaagacataccaggctatctttaggaatatccaaaagtccaatgtctgctaataatgtcccatactgtagtcgcatgtctctgaaagggtaaaaaagtgttattgtgaaatttagttactccctctgtccattaatataaggacttttacccttcattggagagactaaggatgagagaaaaggatatatgcccctcattaaatgagtattagttagggagggaagggtggttctggattttttgcaatttggtccttttcgaaaacttattttacaaatagacccctagaaaaatttattccatgaatggtcctttttggggcgccagagacgctagtgctgtggtccaactggacggtgccagcatctttggcgctgtccccgtgccaccacgtggctgccatgcgctaacgtggcaggaggacaacgctagccatactggcgccacccctcccctcatggctccagccataatggtgcactctccccagggggccggc

SEQ ID NO: 16091 - DNA, 2835 bp, Oryza sativa
ctccaaataagcgtagcatcaacgagcacattgcacacatttaacactacaatcaacaaatcccaatttgcaacggtcaaaatcacgaaatttgcaaaaaataaaaaattggttctaagggttaccctccgatctacaaaattccaccaatcaaaacgaaaaaaaagaggccacaatggaggagaataccttgctcttcgattagcccaaaaaatctcatgaaaaacggctccaaagtgagtggatttgaggaggtaagggaggggggagagagagaaagcgcaacagccctgctcaggctggggaggggccgaatgggtgggtagggggagggggtggggcccgcgcagttaagtgttgcccaccccccgaggggagcgcgccggtatggctggcgccaggggggtggggggtgggtggacggggcgctgtcctcctaccacatcagcgcagggcggccacgtggtgccatagtggcacggggacgacgccaaagatgttggtgccgtccagttggaccacggcggcagcgcctctggtgccacaaaaagaactattcctggaataagtttttccaagggtctctttgtaaaataagttttagaaaaggaccaaatcgtaaaaaatctagaagggtggttgggggtaaaattagttgaaaattaaatgaggtggttggtaagagaagtatagtactctatacattgttatattcaaggacaaatttcaaaagcttgaagtccttatatttgtcgacggagagagtagctttatatttcatactaaatatgaataaactttagaaacaatggttgcacgtagacagttgctgaaccgactctagcagatctggaggaaaaaaaaaagaaaacttaacacacctaaacttgactctaacaatggttgcacttatagaatcagtagtcactcgagaaacagtttgtgacttcttgtagcatacacacatagggggaatttacccacctaaacttagtctttctaagttcacacatttaatttgagaccataggatttgaagtgttattaagaccatgctgaatagtgcactaccacggttaaatatttttgcagaaaaaatccattaatgaatgaaactttctgaaaatcataacacaagtatactgattctctcttactagattagtggtggtgacatatatgtagttaaagaaggtgcccttgattgataacccaaaaaattagtctaacatttgaaaatataaacgctgtaactgaaattcggataagcccttaagaaaatcttattcttttgcatcaagcttttgtataaagtataaactgactaactgaggtagtccaacctgaccatatacatcactgtactgttcaagtagaatgaacggcaaaactgatgggcagatctagctccattctgcaattgaaaatcacatattagaaaaccttggaactgatgttcttttttctttttacaggctgacatatactgcaaaattactctgatagtagtctaatataaaggaacacatgatactaagtacacatgagcacgtaacaaatgtatctaatgtcacaaaattgtattcgagtagatgaaataagttttatgacctctcttagtatgcgagaccacttattgtatgcaataaccattaacaggtggtcagattgtttattatctgctgtagaagcagatccatcaaggttttcattcatcaatgaagcctttgccttctccacattttgcttctgcattatcaatgaaacaatgtcatgatagtgcatatccagattatataaattattgaccacgataatatcataatacctcatcttttggagagatgaatggggatttataactcagaaaagcagcaacagaaagaatgggagataagcagccaaagatagcaccatagagcatcatctgcagtcgcacagaagacaaatcaaagcaaaacattaaataggtaaagtactacaaatgctccacaaatcgatggaacaaacataacaattactgtcattatttgttaataacatgcagaaactatttatttctatgaaccctgaattatctgtatagaactataataccattgggaatgctcaaagggccacagatatgaaaaataagtggtaaaactcttactgttagtcaattacagaggtgtgaaaaaatacagtattgcctacaaaaattactgtgcactagagttaagtacataaaaggtaggaaataaagacattccaaagggacatgaagaacataatagagttgtgatgtactgtaggttcttctttctttaatggaatgacatgcagttcccatgggcgttctcggaaaaaatggaacataataaagctcactgaagtttattgtgaatagggcactgtagtgaagaactgaagattaaagttgtagttaaggaatggaatgaaaaaaaggtatttcatatggaattttttttatgtacataagaatatagattaggcatgaaaagggctgggctgtctttgtttgcacgcagattgaagaaaagaaacaacattaacaactatctgctacttcgccatttaacatgacaaacaaaatctccaatgcaaatgtgaggttagatacagcaagctatcttttcttatttggaatataaaaagttatacaactctaatgcctacaactaactcatatatttacatacattgaagaatttatggtgatattgccacacagccatgcacagacaaatgctagcaaacaacaacatgtagctagttactatgctgaaatgtatgcattaaatatctatgtcacttttgatgaatgagccagaa

SEQ ID NO: 16092 - DNA, 6359 bp, Oryza sativa
cgtcgcctatcaccgtctaccactgaaagcacaacgccgataaattctgaaaaattcgtcccataaagagtcgaacccaacacctcaggtgctattgatgctcttgtaaccactaggctacaggccctttcgcagttgtgggtttcattgtagagcatttgaccgtttgtcttatttgaattttttgattgttagtatttttatgattattagataataaaacgtgaatagtaatttatgtgtgacttattttttttcttaattattttataaatttttaaaataaaacggatggtcagtatgttgattttctttggaaatttgttgacgaatcaatgcttctagttagtagaagcgggttacatacttctctcacgtatgacgaccgggtggaatttattagaaaaaaaattgacagtttcaacttaggttagcaacttttggtgcaacttccttgtcgatcgtacttttgtgatgacgtatactgccgattcttggatgtctcaaacaacttcaacacgagccatttatttttatgcaggaggcacgagccattcttttagttagattcagtactttgagcagagtcggcgagagctctcccagagaaaaagaaagtgctctttctgccgctccaatggcttcggttaccggtaactggaggtggagtatatatcgtctcgtagtagggtttatccaattcttctttagagtgtgtttattttacgctaaaattagaagtttaattgaaattgaaacgatgtgacgaaaatgttggaagtttatgtgtgtcaaaaagtttttatgtgatgaaaaagttaaaagttctaaaaaaaagttagaaactaatccatgccttagttatttgccggttcctgcgtggtgcaagagattgtcggcatcgtgttgtcatgtcccatcatcaagccatggattcctgctatttactttcgtggcttttgggctacagattgctcagattataggtatcccatacccacataacatggttatccgactagttacaggggataacttatatctatggaatatgtaataaatcatgacttgggtaatacgtttccttatatattatggaatggcctttattcctggtttgataatattgtaaagtaaatttaggaaactgataccgtattggttaaggtttctatcttgtaatcctgcccccatcctatataaggtgggcaggatgctctctagggggcagatgacatacaatcagatcgtcagatctataatacactcggcggattcaaatccccaaataggagtagggtattaattctcattgagagggcctgaacctttctaaatcctttgtctttgcatccctccacttttaggtctcgtgcgctaccctctttatattgctgaaatattgtttcgacagttggcgcgccaggtaagggcttcgccgagtttctgtcacggtctcgaattcgtaggagagattcggtcgagtagagaaggaaagagattgagagagatggcttgaggaagaagaagaaggagaagatcataacagaattgaacaggacagagatggaattgaatttgagtttgtttgattacatgatttgatccccttcctctcaatcgtgccggcttatatagcatcgaactacacagtctctctcactcactgacagttgcctagccaattactactgggtccacacacttgcagggaaacgggagttgggctgcttctcccttctaggccgattcacaggctgggccactggcttctgctttgaactccctgctacagatgctgccgccgtgacatcccctcctcctgcggtcgaagcttgtccccaagcttcagagtcaggaaaacgacgacgaagttcttgatcattttcccaagtgaccacatgcggatcgtctccagaccaccgaaccagcaagtgctccaccatcttggatcctttccaaatgaagcaacgatccaacacttgcgatggaacaactgatgtaccagcagtggactgaattctgggcaattgagaatacaccaccttacttggcaccaatgctttcttaagctgtgagacatggaccaccgggtatataagactggtagctggtaaagccaacttgtaagccacttcaccaactagagagagaacctgaaaaggaccataaaaacgaaaagccaacctgcgattagcgcgagtgacaactgactgctacacaaacggctgtaatttgagataaacccagtcgccgacagaaaatgttctctcagagcgatgttaatcagcctgaaattcatacgagcttgagcacgcaacaaatgatcccgaatcaaactctgaatctgctccctttcatgtaaccagtcaattaactcagtcgactcatgtcacaccctaaaaatcttaaatttataaattgttgtttaaatggaattattagaaatgattttaaaagccttgaagaaaagatctaattttaaataataaattccaatataaaagtgggctagataaaattttattaaatacttcacttgattctatagttcctagatttttctgggatttatttgagccaaggaagtatttttaataaatgaaattgcatttcatgaataatttaaaaagaaaaaggttttaaaatctcccttttggcttcgggccgaaagtcggcccaagtttttttccctttccttcagcctactcgcgcccggcccaagtcagcccgccaagccgagccgcccgccctctctcctctctcccgctgacaggtggggcccacctatcagggccgtcttcctcctctcgccgtagccgcgccctagcgcgcgcaagccgctgccgcccccttccaaattccatcgcctctttcccaatccggccgaattgatagaggggaaatgatcctcgggatctcttcttccttttctcttttggaatcttgggctaatattgtttggaaatcggtggatttcagcccgattcggatcatctctttcctcataaccctaaaccttccatcgccgccgccggccaccgtgggcctccaccgccgccccctagcccctatataaggacctccgagacctcctccgtccgccgccaccctcgccttatcttctcgccgctcgtagcaccctagccactagagcccgtgcgccgccgtcgccgccgcgagtccagccatatgctgccgccgctccggtcatcgtcgtcactcgggaaggccgccgtcgggatcgccaagtcgtcgccgtcctcgtcccgtcctctgtttccaccgaagaccgccggggcattgccgtcatcgtcgacccgaacgcctccaccgcttcgacctcgccgccgttgccatccgttgccgtccgtcgtcgtccgagccctcggtgagttcgccgcgtcgccgtctatgtgtagatgccctccgtttgcggcgctgcaccgtcgttcgccggcgagcgcgaggtgctgagccgccgccggtgatgacgtcatcgtcgacgtcagcgccgcgtcatccgtagaccgcggtggatcgaatcgatctcagccgtttattccgtagaccgttcccgtgcaccaagtccaccgtgaacccgagcccgctgacacaataaatcctttttccttttcaaaaatgattctttattgctcataattcaattaaaatctatataaatgatttaatccggtttaatctttaaaaattcataactaattcatcttagctcagatttagttggttcaagtctttaaatttttctaaaattgagatctacatgttaaaaatgtccacatgtgctgtttatgattgtttatgtactgttttagtgattttgctcttttatgcttagattccgacgttcccggagagaccgattttgtaggagaagattttgaagagttccaaggccagcaaggcaagtcacacagatcccaaacaaccctttgagcatgttgatcccgtttaaagctattgtttctattcaactattgcatttattcttgaatgtcattgggtgggaataacctattgcctttgctatagccttttgattattgattacctattctttgtcacctgtttaataatttgatttgctagaacattatatggttttagctaaagtaattaggatgcttagccatgcttagagacactagctcatatgaatggataactaatgattcactattacttaatgatggataatgatagctcatgatggttaatcatgataggttgattaattaagatgccaactaaaatatggtaatggtgggttgtgagcacatggttttgatggtcgtgctcataacaattaaggaacggttcacgattttcggttgtgaaacattaaccctgccaaccacaagccagcgtgggcaacggctttaccttttgtatactgtggttcattgtagagcaccagactgtgaagtggcagagataagcccacgggggtcgctggggagtctatgccttgtttataaggggggtgattatgatccaggaatggtgcactgctttgaattatgttatgcagagggtattgtcacaatctctattcgggtacttgttaagtatcgcgacgcatggttgacgtgatgttgaggttgtgtcttgtgggtacagtggtacacctctggccagagtaaactattcgaatagccatgcccgcggttatgggcgggtcgaacaatgtctttcgtgattagtctcatacctctcaccctaataaatgatgctgtaattggtaataacttgtttaactcctggtttggaatggtatattcctggtttggagatagaactgtgcagccgggaatggttgtttagaatggtgggcctatgcaacgggtatgttgtatagcattggattaatattgtttaattaaatactttactgttttattaaattctaaagtatttattaaatgccatttatgcaaatgagactatattgtgccttcctttcttatcccctgcacttgcatatttgctgcgtggtttgttgagtatgtcatatactcaccttgcaatcattcatcagaggaggagttctatagtgatgctgaaggtgtggaggattaggcgtagccctggtcaagctgcttgtggaatggagtcgcctacgctgtttattttattttccgctgcttagaactttattgtttgagaggaactatctacctctgtaatgactttatattcgcttattaattagagtaataattgcactctattatcaatttgttattgtgtgcctcgggtgattcctggacgagggtttacacacatgtaagcgtttggaattttggatagaaattctgggcgtgacaactgacaagctgcatttgctgacaaaccaaaatatcgtggcttatgtccatataatacttcaaatggagtagttcccaaggctgaatggaaggaagtattataccaatactctgctagagccagccatcgactccactgagaaggacaagcatgctacaaagcagtgaaggaaagtctcaagacattgattcactcgctccgtctgtccatcagtttgaggatagtaagaagaactcaaccggagttgtgtactagccaatttgaatagagtagtccacagggtgcttgtgaagatcctatcacggtcagaaatgagtgactgaggtaatccatgcaatttatgaataaactgcatataagcttcggccacgtccatagctgtgaaagggtgagaaagaggaacaaaatggctatacttggaaaacttgtcgactaccaccaggatacaattgaaggtagctgactttggtaagccctcaataaaatccaaagaaacaacttgccaagcatgttcaggtacaggcagtggttgcaacattcctagatacttgacatgttctgatttggcttgttgacaaacagaacaagcagtaacaaactgcataactgtagtgcgcaagtgaggccaagcaaatagttgtttcaccctttgataagtgacatgaatgcctgaatgacccccaactggtgcagtatgcaagttagccaaaatcttttgttgaagtaaagtattgttacctatccacatcctgttcttgaaatatagcactcctttaagagtaaagtttggaaccgcagctgcactgatgcaaagagtctgaactttacttaaagcatcagggtcaaaatcataaccagcaatgacttcctgaatccaatctggaacaactgaagaaacagctacaagttcaagaacagaatgaggtggatgtagatgattttataacgcaaaccaagcaattttgttaaagccttatgctgccatggggtggtaagccgttgatcatcca

SEQ ID NO: 16093 - DNA, 6136 bp, Oryza sativa
  unsure (1)..(6136): unsure at all n locations
tcttccatatggacttttcgtaactgaccagttgataggtagatatttgggcgattgagttgctctgtttataaatggagagccttaggtgctgcccatgcatggcatctaggcctgtttggcacagctccagctccagctccacccctcctggagctggagcttagccaaacagtttcagctccaccaaaactaggagtggagttggatggagctctctcacaaaatgtactagagttgtggagctgggttttggcagctccacaactccactccagactcaactcctggagttatatttaggagttggagctgtaccaaacaggctataaggctacgttctaaactctcgtttcccaacttctacctcatttatttccgcacgtttgcttttctgaactgccaaatggtatattttttataaaatattacatagaatagttgtttcaaaatatcatattaatctatttcaaaatttattttaactaatacttgactaatcatgcgctaaccgtttcttcattttacgtgctgggagtgaagtttcactactagacatgcgattttcatggacgccggcccctttaggttccaggcgggccgtaagtggctctgccttgaaccaggtgatcccggcgccgagctgtgggccgcacaggataatcgattatcccgtgcggtccacttaagacaaccgcacgggataatccttttatcctgtgtggtcgttaggcgaccgcctacgatggtgagggagctatacaagtcccagcccgaccgttgcaatggcatgccggtgatttctctctcctaaaactccacaaattatgggagaatgttttcgatctcaaatctttgattgggttccatataaaaggtgtagagcttgttctcctccttcatttgcagccatttttgtcagttttcatcggtgcaatacgaagaaacttgcacttttataaatggtatattgtagttacttttttatttttttcttattttttagcaaatacataatgattccattacatgtttataaaagtatttagtacctaaattgaaaagttgggtttgcctctattaaatttattttcattcggataaaaggacgatttttttcatttgtaagaaatggacaatattttattaatgcttaaaattgttgtgtggctgtttaaatagtccgtaaaactttaatttactatgtgattagttccctccaatttaaatacattcttttttaccatcgggcatggatgtattaatgacaagctttattgtaggtcatggatgtacagcaagaaaagagctcatccaacgttcttgaaggaagcagccaaatttgttgaggtcgcaaaggcacatgctgtgagggagaatttgaggagcgttttttgcccatgcaaagtgtgtaagaacgaaatttgctgcaagatccgaatgaagtattgtcgcacatcgtagagcaaggatttaaggagggccacaaaatatggacttttcatggggaagtcggtggtcgtaacgaagtgatggatgatttctgctttgatgatgcagaaaattttataatcaaagacatgtcacagggaaacatcccggaatgtggtggctctggtatagtgtcacgtcccaaaacgactctaaaatacatcctctaaattatgcctagaataattaaaatccgtgtgaaagcctccaacaattaaaatgtgcaaagttaaaagtcaaataaggcttagaggatttttgtatatttcctaaaagcctaaaatgtgtaaataaattttagtggaattttctgagcacaaatagtaattattaagaaataaacaaagttgaaaaggttttataaaaagaaaaaccctaaaaatcccccttccctctcttgggccgaatccggcccatctccctccccctctctcctctccccctcgcggcccatccggcctctccccgcgcgcgcgccgctgacgggcgggcctgcccgccaccctcgctgacgggtggggcccacccgtcatccccttcctcccgccgctcccgccgctccgcccgcgccaagcgccgccgccgccgccgaatccgccgcatcccgtcctccccacgtgcaatcaatagggggaattattctccgtgattccctctccctttccccccaaatttccctccctttctcccttggattcgtttggaaaccctcccctaatcccgccggcgccattgatggagcccgagagcgccgcgccggtttccttcccctccggccgccctctcccccttccaaccctatataaaccctccccgcgcctccctcgcccgtttccgcccttgccgcaccgtctccccaccggaatcgagttcgtgccgtcgccctctctctcctccgtcgtcgacgacctccggctggccttctccgctcgccgggaccgtctcctgccccggcgtcgcctcctccggcttcgccgcaccgccgtcgaccccgtccaccccctcgccgagcccgcggaccgccggaatgccgtcgaccccgttgacccgagccgcgccgccgccttcctccgctccggccgcctttttcgtcgtcgctgtcgacctagggtgagccgaggaccgccgcctcttttcccccttcccttcccctctctcggccgccgctccgccgtgcctatggccgccgccggcgaccataggggcgcgggcgccgtctcccgccggccgcgccgagtggccgccgcgtggggcccggccgtcagccgcccacgtcctcgggtgcggctgacgcgtggggcccacgacgccggccggtgcgagcccgggtgcgcccggtccaccgtggaccgtgaggctgtctcgtgggccccactcccgtggacccagtccgcgcgccccctcccctcggctgacgcaataaagcttttttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcccttttattttccgttggtcgtgtagacgttgcagcttcggaagatccgctcttcgtggaggttgaagccgacgtttgggaaagtgagcaaggcaagtcacatcatccttgaacatattgaatcctagtttataaaattattttgatttaaattattgtattatcgctttatttaaattcccgcgttatcactgttttatctagccatgcctatgtacccttgttatgaccttattattgttattgttattattaccttgttcaccctagaataaacaaaacacaaactagtggacactctactcatggtaccactagtatgattttaggtagatgcttcgctggttaattaggcaacattaggtggttttacaactctagactttgggaatattcatatcacctggatactatggaatggttggattattggggaattagattcacaccgccccctctattcaaaatccccaaaagggttttaggctgtgcttggggtgcatggtttgaatagtagcacctcggccatataaggaccggtcttcgggcctgtgttgcaaagcactaccgtacttccacatgtctaatgggtaagggttagtttgtggctcaatctggttataaacaaaagtacacggatggagatggacaagttcgggggtcgatggacatctccagggcaaatgaaggctacacgagctgcggcccggtagtcgaagatgtcatggcacagggccggtgttctgctgctaggggctcaatcatgcatacctgtcctggaggttccggctgtaggtgggattgggtcggtactcttgtttatggataggatgggttgggaactatgtcacgtcttctgtccgtatacagtggtggtatgtggcacgtggttacacgtgaggaagatgtgtcttgtgggtaaagatgtacacctctgatcagggtataatctattcgaatagccgcgccctcggttatgggcaagccgagcaatgtacccaagttagtgttttaattcttaaaatttgctcaacaacgaaaatgtggaatggttggcctgggttggcttgggacgagctgggacccagggtcgggttgccagttcggtctgaatcatcgtaggccttgggttaaggcaggttcatgtgggttcacggccttgattaataatcttgtatagctctaggaccgtgtttacaaagtagctttgagcaactaagtgacttttaatgctgtttactgcaaaccctaaccctttatattatgacccccttgtactcccttgcatttattctgcacttatgcgtgtgtcttgttgactacggtggttgtattcagtcttgctcaatttttcccaaacccagaagaggagttcctggaagatgtaggctttggcgtctagctcgtgcctgccgtcaagcgcctgtggtcgtcgccctagtcttccgctgtttcccgtttgtctttgtgtgtgctgggccttcgccgcccatgtaataaagtaactatttacgcttccgcttgataaactctgaaatgtatcaacttttggtgttccttgcctcctgggacaaggaataatacatgcacataaggaacgcccgttgggttatttccggtcgtgacatatagagaatgaaggcattgaatttgatctggaagatatgttgtggcacgttgaaccagaggtcctaactggtagaagatgagggttggacaattgggaagcgttggagaaagcagcgaaggaccttctgtatgacgaagcgaaaggatgcgacaaggactattcgatgctgcgctcggtgcttgaacttctcagattgaaggccagaaatgaattntgggcacnaanttcaannatttnatgcatnttttgagggnnagccgtgnnaaacnnaacctnntaccaangaacacatatcaagtgtagaaattgatatgtccattttctttaggtgttcagaagtccattcatgtgaaaatttttaaaatttgtttggggggccccaaatttaaaanccttggtnaaccaaggcaaagaaaatttcgcgggatttaggactcttgcccaacatgtgggacgagtcggtacaagacgggtaacggagcctccgatggagaggtggtcgacaaagatgatgcaccggtggatgagaaaaaaaagattcctaggatggtggtgtggtacctaccagtgaaagatcgcctaaagcggctatattccaaccgtgatgatgccaagttgatgggatggcactaggagggtaagaaaaatgacggtaagattcgacaccctgccgatgctcgactgtggaaaaactttgaagcactacacctggaatttgcaaaggacccgaaaaatgtaaggtttgcattgagcacggacggaatgaacccgttcggtgacttaagccgcacacacagcacttggcaagtgctgctaaaccgtgtacaacttgcctacctggatttgccagaagccaaagtatatttttttggctatcgttatacaaggtccaagacagcctgggattaacatagatgtgtttctggaaccattgatggaggacatgcaagaactgtgggaggaagggttatgaatgtgggacaagtaccgtagggaacattttactctgcatgccatcatattcgttacgatcaacgacttaccggctaacttttcgctctcgggccagtttaagggaaagttcagatgtctcatatgtatcgacaagatgtcgtacaagtacctcacctcgtcaaccaagggtgtgtacatgcgtcatcgtcggttcttacctcagaggcataggtgccatgtgaaggccagattattcgacaatacagtagagaacgatctagctccggaaacacgaactggtggctctgtcttcgagctgacaaaggatattaaggttgtgttcggcaagccaaagaagaagcccatcaagaggaagaaacggacggatcaggaaaatactgatgcacctgtagaggaaagtaacttacttttaagaagc

SEQ ID NO: 16094 - DNA, 4986 bp, Oryza sativa
tggtggtatgaccaaccaaccatgtaggcaaagacaccagtttgcagcgacggaggcaagccgatagtgatgttgaagatgcccatcaatggtggtgtgacgaaccaaccgtataggtggaaacaccagtcggcggcgacggaggcaagccggcagtgatgatgaagatggccatcaacggtagtatgaccaaccaaccatataggaagaaacacacgtcggcggcggcgaaggcagccgatcggtgaagatgtagacgcccaacaacggtggtgtgaccatccaaccgtataggcgaaaacactagttggcggtgacggaggcaagctggtggtgatgatgaagatgcccatcaacggtagtgtgaccaaccaaccgtataggcggaaacaccagtcggcggcggcgaaggcagccggtcggtgaagatgtagatgcccaacaacggtggtgtgaccatccaaccatataggcgaaaacaccagtcggcggcgacggaggcaagccggcggtgatgatgaagatgcccatcaacggtggtgtggccatctaattgtttaggcggaaacaccggtcggcggcggcgaaggcagccggtcggtgaagatgtagacgcccaacaacggtggtgtgaccatccaaccgtataggcggaaacaccattcggtggtaccaaatgcagctggtcggtaaagatgtattcgcccacaacggtggtgtgaccattccaccgtctaggccaaaacactaatccgcggcgaccgaggccaacccgcggttatgttatgactgatccattcctaaagcgtaagggataatgctaaagccatgaatccctattatgcatatgtatatctagatcctgcccaataaacaaacatataggatgggtagtatctgatgtaaatacactacttgatgaaagtttaagtattttaagatgtttataaatatgtatatctcctcttgtcaattttgatttccctgagaagatgactctttacgtgtaaacactctgcccgactagtcatagtccccaagcaccggcagtcggccaatgcacttcccaaacatgcatatgagtgacatgagttcgtcattaatggaactgagtttcatggatcagaatttactacccgggtacttttgcaattgttaagagcagaaaataaattatcttatctctatgcttttgatttcttccaagtaatacttagcaccttgcgttactcggtctatccaacgagtccccgggtgctaggaatcggcccaaaggcaactatccatagacaaaccaaacggaaagcataggaagatagaactccataactcgatagttactttatttttacttggatcatttcgcaagcaatcaagataaatattatgaaaaattgttgaaaaatatgatataacatccgtagccctcgactcactaatcaatggagaaccaattggtgtagtgaggcagcggaaaaaaatatcaaataaagaagaaaaataaatggtgacttagctttttagtgttcccccggtaatagcagatgtagccgatgtgtggagaaagtcgtccatcaatcccaataaaaacaccagtcggcggcgatggcagccgccggaagtgaagacatggtcgccatcaacaacggcagcggattacaccaaccgtggaggcgaagaaaccggtcggcagtgatgacggcggccagcgatgaaggtgtagatgcccaacaacggtggtgtgaccaaccaaccgtgtaggcgaggacactagttgacagtggacgaggcggccggtcagtgaagacgatgatgtccatcagcagcggcgcaatatgccagccgtgaaggcgaagaggcttgtcgacggaagatgaggcagctggcagtgtagaatatgtcattatcagccatggcgataaagacaacatgtttggataaatccaatacacggtatggtaggcggagcctgcagcttgattaatgtcatcggctgtcaccacagcatttgataaacaaaggtgctggtgatctccgttcccgtgcgtgccatcggctggcacggcatggcttgacctcaatccgtccgatatatgcaaacacaaaaaataccaggatggtcaatttattagtaataaaaaagatatatgccttacagtctgattagagaaatcatgcatgttaattgatctctatattgatctcatagaggcttggacgtcagatcagatgcatccatgttgtccctgtaatgcacgaagcgttgttgaaggactcggcatcccaggaggcagctagcttgatctcaattgccgtcgatatatgcgtgtcaaacaaaaatatgacgaagatcaatatgtgtgattaaagatcaatctaacaaatatgtattgaaacaacaaacccggttattctcacgatgtcaaaatccagctgaagcgaaggaccatgccggagatgaacatgatactggtagcactagatattaattccatcacactttgttgatgggaaactgtcacggcagcaacatctgtagcagggagttcaaagcagaagccagtgacccagcctatgaatcggcctagacgggagaagcagcccaactcccatttccctgcaagtgtgtggaccaaatagtaattggctgggccactgtcagtgagtgagagaggctgtgtagtgcgatgctatataagccggcaggattgagaggaaggggatcaaatcatgtaatcgaacaaactcaaattcaattccatctctctcctgttcaattctgttctgttcttctccttcttcttcttcctcaagccatctctctcaatctctttccttctctactcgaccgaatctctcctatgaattcgagaccgtgacaatttggtatccagagcaatttcgatcctggagaagccacgatatacttcccgtttgcaacttcaagtcgaagcgatggaggagcagaacattgatttcggcaaggtgttgatggagatccaggagtccttggtgacgctgaatcgtgctcaaggcgaaactcaagcagcgctcgtcaagctagatcacggagtaagcagttggagacctcaagtagaagcagcagttcaggagctacatgaggaagtcggcgatcttcgtcagcaactggatctcgtcggcaaaatgaagcaggcttctccggtgatgtcttcccctcgagttccgttgatggacgaggaaaggaaggcgccgccgctgcctacgccgccaacttcatctcaagctgccacggcggaaggtggaagcaaagtggccggtggctgactgcatgctcatgaacaccggggaagggtactggggatgaacacaaccctaggcccgactgcggtcaagggtgcgtatgaatctccttccacatctctgaaaaattttgatcaatttgagtttgggggtggggaatatgatggggatcagtttgggcgtcagtataatcacagggttcctaagttagatttccctaagtttgatggaacagacccagaggattggacaatgagatgttgacatccatttgatgtgaattaaactttttcagggttgtggattagaaatgccaccatttatttttcgggtagggcagctttctggttacgattttttaagggttatgttagatttcctgtgtgggagaatttttgtattgctgtgtcacacaaatttgatagggaccaacatgaaactctcattaggcagatggatagtattaagcagacaggaatagtttgggagtattatgagagatttgatgaattaatgaatcaattgctgacatatgatcctcttctgaatatgcgatatctaacacatcgttttactgagggactgtgtcgagaaatcaggaatacagtgctgctgcaacgtcctaaagatttggagaatgctttggcagtagcaatgttgcaggaagaagtgatttccgaggcaacgacagggtcagttccaaatctgaagaaaagtgatggtggaaatttgcagattcggccaaatgttgcattcaagggagcattaccattaccctcgcctccaaatcgtggaagtggctctggtgttttgaatcgatcagaggatcgtaagtttcttcacaataccgagactggtaacagtaatgataaaatttctacactgaaggctcagcgtagagctcaggtgttatgttacatatgtgcagtgaagtggtctccaacacataagtgtgcaaacactatacaactgcatgcagttaaagaattgctcacagttttgcaatctgatttgctctctgatccggatattttgcaaaggaaatgacggtctggacattcctggattgatgtcaatttcagttcaagctatacaaaggctttgaaacagtgggctgtatgagaatgttgggctatgttcagggtaaagaagtgctcatattggttgattcaggtagtgcaactagctttattacctctaagattgctcaaaccttgcaaggcgttgtaactcttgaaccacctgtacaagtgaaagtagcaaatggttccatacttacttgtctttcttcagtactaaggtgtgaatggatgactcaaggatgggtgttttatactgacttaaaggtgttaaatctgggaagctatgacataattttaggcatggattggttgatggctcatagtcctatgcaggttgattgggttaacaagctcttgacagcttcctggagaaaggcatccgatacgttacagggtattttgtcagaaactgaacagtgtttccacttttttttcccaccgtttttggagttgaaggaaagacaggccatttttcacctgaatcagttgggccacatcagattttcagacaaggagcaaattccagtggaaattcaacaagcgctagcagagtttgcacaggtgtttgaaaaaccttttggattaccaccggtcagggtttttgatcatacaattccactca

SEQ ID NO: 16095 - DNA, 625 bp, Oryza sativa
ttcctgcagcccgggttgccgaggaacgggacgcagcgacaacctcagatcggttcgtgggatttgtcgatgttgaccccgacgagtcacccgtgttgcatattttggaagaccaagagtcctctccgtcgatttcaccgcgagacgtcaacgtgatcaatacagctgagaccagcacgtccgcggcagctaggacgcctgctcaatagctacaagccctcaactcgatattgagagagccctttcgatcctgccctgaaccctgatgttgattagtaggcagtacgactataagagaccatggccaacctcaatagcgcatttgtagaggcagcaactgagcccccgctgcgagatccaccacgaggaaatagagaactagctaatgggaacgcagaagtataaatccctactggtgaacgttccccctatgctcaatcgccacgagcaacctgagatcccactccaccacctcgcgaaaatcacgatcttcgtgagcatctggacgaccgacggagagaacgtcgggatcagaacaacactgatcgccatcgacatcgttctccctcacgacgaagagagaacaccaattgacaccaacatcagcgtcattctccttcgcgac

SEQ ID NO: 16096 - DNA, 1337 bp, Oryza sativa
gagatgcctgcctctgcctgtcaccactgccggtctgaccgccgccttgccaccggtctgaccgccggtgagtcgtcggttagaccgccgaaacccagtgaaacacaaatcgaagaactcttaaaatagatgacgactttattgattatctctgtgtttgcaaagtgcaccaacagcactccttacaaaaatttcgactaaactcgaaaccctaactcaaaactcaactcaattgctctcaaaagcaatacagggaagcctcacgctccccctttatttatacccaaggtaggcagcctaaagccacggaacaaactcatactagaagtcctaaacaccttaggaaaccctctagtacaagacacaaactttacataaccaatcatatcaaatttggactccttccaaattcgactccgcatcccatacacacacaatacctccatcgtatgccatatggaatctacatcacccacgtgcatcaactctagcctaagtatcccgcatgatctctgaccaccacggacgtcgtcttatccccaagctgactcccggtccatcaccgcaaatactctcccgaggcatcgagtcacctacacatgaaatctatacctaaataaaaaatacataaggcttccggaaattattttggtacatttttttttgttatcgccgtttcgcttgatcgcggtgcccctaccccacccctcccgatctctttttattttcctttttatttccaaaaaataaataaacaatctaacttcctaatctctatctctactattataaaaattaaagatatttttgccggtattttggtaagtcatctatgtatgagtcggttttttaagttcgttcgcttttgaaaatgcatatctgtatttgagtcagtttttaagatcgttcacttttggtaatacagaaggaatcatataagaaatctgtagctcatgaattttgaaaaatatatatatccaagtgaactcccacagtgaatttcatcttaactaaaccatataacaataataagattaaaataaacttcacccgttgcaacgcacgggtatttttctagtaaacaaagaaaccatattccgagaccaagctatctctaacttgactcattagtagcaaacaacagtattacatacgtatagtatccatctagaagccataatcataaaacaatcacggatatccaaacaaacaacccggaaccgaaaccgacacagcgtcggccggtcagaccgcgggctgcaccggtctgactgcgcaatgcacgccggtctgaccagcagcacatgcccggtctgaccggtccatataaaataaca

SEQ ID NO: 16097 - DNA, 716 bp, Oryza sativa
atttattcagcatccgtcatcgtttagatttgggtgttgcttagattaatctgtcaagaacagtttcaccgctagatcggtttgtggaaccctaagttcgagtgcttaatcattcatatgcaattgtgttgcaatctatcttgttattacttgtgttcttcgattcacatgcagggattagccttcttggtgaggtcaaccgggtttcggcacggttgataactagaggagacatggtgctgcaattgcggggcttagtagcgtgtacattcagaagccggatcgagttgtgtcgcgactccgcctatatcgactatttatcagtacctatcggaagatcgggacaaaacatctctcatcaacaagtcttcccatgaggagattgagtggggcggaagatgaaccagccatgaacgagcagatcctttcaacgtggctggtaagtaatttgccaacgcgttgtcatctgcaccagcagtgtacaggatcgtggggtagacctgaagaaattcttcggggtccgtgcttccaccgtacttctcgattgctcctggtcggaactccttgggccgccgcacgtctcgcaatgtaggggtggacgctctacacccgccacctagagcgaagggttgttcgcgcccgtggtgtcatcaaggaggtctgcctgatgaagaggatggcgaggatgatgaaccaggggttgcttgggtcaggag

SEQ ID NO: 16098 - DNA, 6441 bp, Oryza sativa
tgcccctgctttcttcatgaactttatgaataaggtgtttatggaatacctagacaagttcgtggtggtctttattgatgacattcttatctactcccgaaccaaagaagagcatgaagaacatcttcgccttacactagagaagctacgagaacatcaactgtatgctaagtttagcaagtgtgaattttggttgtctgaagtgaagttccttgggcacgtcatctcagcaggaggagttgccgtcgatcctagtaatgtggaatccgtaaccaactggaaataaccaaagacagtttcagagattcgctgtttcctaggcctcgcaggatattaccggaggtttatagagaatttttccaagattgctaagcccatgacacgactgcttcagaaagatgtgaagtacaagtggtcggaagaatgtgagcagagttttcaagagttgaagaatcgcttgatatcagctcctattttgattttacctgatccaaagaagggtttccaagtgtattgcgatgcatccaaacttgggttaggttgtgttctgatgcaagatgggaaggtggttgcctatgcatctcgtcagttacatccgcatgagaagaactaccctactcatgatattgagttagctgcagtggttcatgcattgaagatttggcgtcattatctttttggtactcgtacagaggtgtacactgatcacaagagtttaaagtatatctttactcagccagatctgaacatgagacaaaggagatggttggaattaattaaggattatgacatgggaattcattatcacccgggaaaggctaatgttgtagcagacgctcttagcaggaaaggctattgcaatgctacagaaggacgacagttgccattggaattatgcaaggaatttgaaagattaaatttgggaattgtcagtagaggttttgttgcagccttagaaacgaagcccactctaattgatcaagttagagaagctcaaattaatgatcctgatattcaagagatcaagaagaatatgagaagaggaaaagctatcggtttcttggaagatgagcaaggaactgtatggttaggtgagagaatttgcgtccccgacaacaaagatttaaaagatgcaattctgaaagaagctcatgatactttatactccattcaccctggtagtaccaaaatgtaccaggatctcaaggaacgattttggtgggcaagtatgaagcgtgaaatcgcagaatacgtagcagtatgtgatgtttgtcagcgcgtcaaggcagaacatcagaaacccaccggtttattgcagcctttgaagattcctgaatggaaatgggaagaaataggtatggattttatcactggtttacccagaacgtcatcaggccatgactctatttgggtgatagtcgacagacttaccaaagtggctcatttcattccggtaaagacaacttattctggaagtcggttggcggaattgtatatggccaggattgtgtgtttgcatggcgtccctaagaagatagtgtctgatcgaggcagtcagtttacttcaaatttttggaagaagcttcaggaagagatgggttctaagctgaactttagtactgcttatcatccgcagacagacggacaaaccgaaagggtgaatcagattttggaagatatgttgagagcttgtgctttagatttcggtggaagttgggataagaatctaccttatgcagaattttcgtacaacaacagttatcaagctagtcttcagatggctccttacgaagcactgtatggtcggaagtgccgcactccgcttttgtgggatcaaacgggagaacgtcaggttttcgggactgatatcctgagggaagcagaagaaaaggtaaaggtcattcaagaaagattgcgagtggcccagtcccgacataagagttatgccgacaatcaccgcagagatttgagttttgaagaaggagattatgtgtatcttcgtgtcacgcctcttcgaggggttcatcgttttcacaccaaaggaaaattggcaccgcgttttgtgggaccttataagatcgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaacagatgagagaagaaccaggaatcgagttatccatttttgtaaagttcaatggagtaatcactcggaagaagaatcaacttgggaacgagaagatgaattgaagttagctcatccgcatctgttcgccagttcttccgaatctcgaggacgagattctgtttaaggggggtaggtttgtcacaccctgaaaatcataaatatataaattgttgtttaaatggaattttttttgaaataattttaaaagccttgaagagaagatctaattttaattaataaattccaatataaaatggggccagataaaattttattaaatactttgcttaattctataattcctagatttttctgggattcatttgagctaaggaagtatttttaataaatggaattgcatttaagaaataatttaaattgaaaaaggttttaaaaagtcttcttttggctttgggccgaaagtcggcccaaaacctctcttctctctctcctcggcccagtccggcccagtccgccgccgcgcgcgcgcgccctcgctcgctgacaggtggggttcgtcttccccgagccgccgtcgcccggccgaaaccctagcgcgccgccgccgccgttcacttccaaatccggccgttcctttccttctccggccgaatcaaaagaggggaaatgatctccgggatctcctctaccttttctccgttggaatcatcggctaaaacgttttggaagttcgtggaatcgagttcgattcggatcggcctctttccttcaagccacgaagtttccttctcgtcaccggccgccgtgggccttcgccgccgcctcctagcccctttaaaaggctccccggtgtctcctctacccgccgccaccctcgccttcgcctctcgtcgcccgtagagctctagcgccgtgtgccctagcgccgccgtcgccgccgtcgctccagcagtgcgccgccgccgttccagacgtcgccgtcactcgggaaggtcgtcgtcgtggtcgccaagtcgtcgccgtccttgtccgccgcttcgtcaccgtcggaaaccgccggagcatcgtcgccgtcgtcaagccgcagtccgccgccgttccttcgtcgtcgccgtcgccgtctgttggtcttccgccgctcccttggtcgccggtgagttcgccgtgccgtccgctacctgttggtgccctccgttcgtgccgtagtgccgccgttcgccggcgagcttgcgccgtccgagctgtcgagccgccgagccgccgccgccggtggtgacgtcatcgctgacgtcatcgtccccgtttcccgtgagccgccgtggacccgatcgatctcggccgtccgttttggatcaagtcgatctcggccgtccgttcccgtgaaccgccgccgtgcgcccggtccaccgcgaaaccctagcccgctgacgcaataaatcccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatatacatattaaaaatatccacatgtactgttcatgcttgttttgtgctgttttggtgattttgctcttttttgcttagattccgtcgtttccgaagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcctttttgttcttgattactttattccttgataccttgggttattataatttgactagttgagctttgtttatattggttcaactagacgtattagatataattgcttagccctgcttagaaacattagcacactattgggataacttatgactcactattatttaaagatggcttaatgatagttcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaactgtgccaaccacaagccagcgtgggtaacggctttatcttttgtatagcatggttcattgcggggcaccagactgagaagtggcggagataagcccacgggggtcgctggggagtccatgccttgtttataagggggtgattatgatccaggaaaggtgcgctgtaatggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacttttcaccatagtaaatgatgctataattggtaataatttgattagctcctggtttggaatggtatattcctggtttggagatagaactgtgcagccggggtggttgttcagaatggttgggcctatacaacagggtacgttgtatagtgttggattaatattgtttaattattacttaacagttttattaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttttacagtgaagctgatggtgtggaggattaggtgtagccctggtcaagctgcttgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgtttggaattttggatagaaattccgggcgtgacagtagacgacgacgccggccggaacggacggcggacaacagcggcgagcggcggagcgaaccacggcgatacaggcaaaagcgagcacaccgggtggttgcacgagaagaggggagacgagccaatggctccgattcgccggagggagcttgacggcggcgaatcgcggcggcggcaaccggcggcgggagaagggggaaacgacgacgaggtcacgaggggccgattcccggcggcaagagcatctacacggctacgggaatccgatgctagcgtcggattgggcggagctacgccgagcgaggccggcgacgagcgggtgctacggagcacgggcggtgagcacatggcgagcggcggcaacggtcggggcggtgccggctagctacggggaggctactcgtgctactaccgaaaactaagggggagagatggagcgaggaggaagaacggagggaggcactaccgtgcggacggggcgcagtgacgagaggccgacggcgcgggagtaatctctctggcctcgggcctgggaagaggaaggagacgagcgcccggagtccccttccgcgtcctcgctcgtgccggctcctccgacgcgcgcaacgacgaacggcgacggcgaaacagagggacggcaacaatatagtggaggcgatgggacaacgagaggagaagagagggagggcgcccggggctttaaagggtggcaatgtcggtttggaaaccgactttggtcggtcaaggcgcgagctggcgctcggcgctcgcgtccaaatcggcgacagggcggagggaggatgacgccggcgggaggaaaaaggggaaaaggagggagagaaagggggcttgcctccttgccgctttggggaaaaggaggagggggagagagagcgacgcggcagagggaggagggctctgcctccgtcccttggcggcttgcgcgcggagtggcggggccgaggcgatgacgacggcgatgacggcggggcagtttggagc

SEQ ID NO: 16099 - DNA, 774 bp, Oryza sativa
gagggggaaatgggccaaaaaagaattcggcccatcgaacccgggggaggcaaaatagacttttgcggaggaatttgatttggaaggatttggattcggaattgaactcgacaatagatcggggatttgagatcttgagatggcacggacactagacaataagcaaagaaacaaatttcgcaattagggtttttaagagataattttcccacttggcgccacgacggaatcatgtcgtcgtctcccgctgttgtcttggcgccggtctccgtcatcattgtcgttatggcgacgtcctcgaccagtattgtctggcacccgtcgttcgcgatcgttgtgatcgtggtggttgtcctggtctcggtcctcatttgagcggtctcctcgattttcgttatcatggtgccataaagagatatgacatcgagaacgattcacatcgagaacgataaaggggtagctcactgaggcgattccctccgttccgggttttcaccattggcatcgccagttggtggctgctccgggtgcgctgtggtagcggcctcttcgaacgcattgctgaggttggtcactgattccggtagtcgttctgtccaacgcgcgaggtcatcgttcagaacgggatcgtatgggggtttccctcagtatagcgtggatggctctgatgtgctgggctggagtagtcaattgattctccgcttctgcgttggtgcgtgctgacgtgccaacgtcatcgatagccaatacctcccgcggcgcgctcgttgtcga

SEQ ID NO: 16100 - DNA, 1707 bp, Oryza sativa
cctcgattttcgttatcatggtgccataaagagatatgacatcgagaacgattcacatcgagaacgataaaggggtagctcactgaggcgattccctccgttccgggttttcaccattggcatcgccagttggtggctgctccgggtgcgctgtggtagcggcctcttcgaacgcattgctgaggttggtcactgattcccgtagtcgttctgtccaacgcgcgaggtcatcgttcagaacgggatcgtatgggggtttccctcagtatagcgtggatggctctgatgtgctgggctggagtagtcaattgattctccgcttctgcgttggtgcgtgctgacgtgccaacgtcatcgatagccaatacctcccgcggcgcgctcgttgtcgatgacccatagtcttcgagaagctataagactgatggttcgtgaggatcgatatcgattaccccaacaaatcgatctgaagttggcgtcgctccttattccttgtcgttatccctgatggggacgtgtgactgttggaccttaggagatggagctttcatgtcgctgagaaagaccttgcagcttgagaggtcgtgattatttgtcttgtgaataggacaatagacatcacgagttggagagatacgctgaattccacgctctttgcaggcgcgaatttcatcgcggacgttgaggaaaacctagcaggcttgcaaagttttgtggataggacaccaggaccttgccgcttcggaagtcatcttcgtcggctcgtggttcatgtcggaatgacaaggtttggccgcatcagaatccttctcgagcttggatgtcatcgatgctccgttctccgtctcagcgggaggatttttcgacatggattcgccttggtttgtagcaactgcgttctcgtttccggtcattgagggaccggttgagatcggcgtcgtggtgtaaaccgggaagacgatttcgccgactttagtccacaccagcatcgttgaagcagggattacttggctgaggttggtgttgacgctgttgtcgacgaggctggatgacatagtagtagaaccttgaataccaagtgcccctacctggcgcgccactgttgacgggtggtacccgtagaccggatatagagggtattggggtacgttggtataaggatctacgtaatacgacatcaagcaaacaaaagacgaggattatactggttcagtccccttgataggtaatagccctaatccagttgatatgggattatatggtggaaaatacaggttacaaaggaaacaatggaacttgacggatccgacgagatcgtggtcgagttggttcgactagatcccggcgagttggctccttgcaggctccgacttcgtagactgtgagggttgtgttggctctgagattcgatgccccatgtcctctccgaggggtcccttttatatcgcagatcagggggtttccaagtagaactcggagatatcagaccttatacgacatattgacgacccagtcttgtccgagtaggactcttcccatccgtagactccgtgaaggatttccttagagtacgcaggaaatatccgtatgcgcatgggaataccataccgatatgtgacgtatatcgaagggtaaagggtatgcctaacccataaccctgacaccacgttagatgaagaccgggtcaatttagccacgtaagctagg

SEQ ID NO: 16101 - DNA, 4337 bp, Oryza sativa
  unsure (1)..(4337): unsure at all n locations
tagttttcttgttgaaggatgaaaatcggattcgttaacaagttaagggaccttgggtgaacttattccaaacgaaaatgcttctgaaacctgatgggctgttgttagttgatacatgttgaagcgtgttatctttgtggatgtctttttcccaaagcctagaaacacataacaaatttatagatgcaaaacatcaatagttgatcaattttgtaactgaagttgcacaaactgaaagagcatccatagaattgcaaaaaaaaaaaggaaaaagaaaaagaaaagaaatatgagctgaggccacccatgtgtacgtatgtgttccctgaatatttgatccatattctttcactacatgaacaaaagaatgttgaatctctgtgtgttccaaggtaattgtgacaaaagaaattgttaaaaaggtagattcctcgggatgtttccccagaaccatctgaaacggaattaatcctttcaaagagagtgagggtacatagaagtaggggcaattccttacatacccctaaaagtttgctccatcccttgcatgcccttgaattttgtcacatcccttgtatacccctgagatttcgtcttgatcccgtttatacccataccgttagttcaccgttatcttttttccaaaatggccatgttgccctttttatagtcatgtgatcacttcaaaaggctaaataaagcttaatgtgaactttttaaattttgtatagatagttgagcctaaatttcaaaaccaatatttattttttgaaatatttttaatagattttcaagcaagctttaacaaaattaatgaaactcatatagaagtttcaccgaacatttagaaattaaaactatatttaacttgaatttaaatataaataagaatgttttatgaaatttgatctaaatttttaaaattttaaatttaacttttcaaactttgaggtcaaataaacacattctttttgttgtttactaataaaatatttttcaactcgaaaattatgttggtgaaaaagctagcgcataggtactctaagtaggggtaatatagtcattttgaaaataacttaatagttaactgatggtcaactaacggtatgggcttggaggggatcaaaatgaaaactcgggtgcatataagagatacgtcaaaactcaagggcacagaagggatggagcgaaatttcaggggcatacaaggaattttctctaagaagtatgctgagtctataagaattaccttgaaggccaagcatgaaaaaaacacacccaataggtaatttgggccggtttgctgaatttaaatgtgtggatttgtagtcttctagacatcatatcaaagtcaccttagcaaaggattattcttaattacatgaccaaggtttggcataattggtttcaaacatcacgccaaaacaagtcggacaatatcaaccataggggctatacaattactatctgtatagaatagtgttccaagatcgttctcggacggaagagaaaaacaagttgcctagaaagttgttataggagattaatcggaggaaccggccttgtattgaatcggtacgtttttcatggttggcctgttgggtacctggcgaccttggttatgtatagtttatcttttctatatgtaatctcttaaagtactacctccgtttcaaattagtattcgctttgactattttcttgtaactttggccattcgtattattcgaaaaattaatacaaatagaaaaaaatgataaatcatacttaaagtaaatagttgataataaagcatgtcacaaacaaaataaataataattttataattttttgaataagacgaacgatcaacaattgtaaataaaaactcaaagcgataagtattttgggaaggaggtaagtattttgggaaggaggtagtatttattttcgttcttctcaatatacagtataaccaaatgaactcctgccgttcggattaattaaaaataagaaaaagaaaaagagaattaaggttttaactgccgacaaggaatatcgatcttttggtcagcgcgaactactgtagtaacaggatgaccatcaaccactaccttcatgtatcttgttactacaagcaatggaggctttcttctgaagcatgcatgctgactcagacgagaaaaaggtacagcatgcaaagttatgcaagtaactatactcgacatgggaaataacaaaataattgttgagcgaggtttctcacaagttgatcaagttaatttttttctcgctaagtgagcacataactaggtagattttttttttaattttggggggggttttggggggggnaaattnnttcnaaggnccccaactnnaaattttgaanttcgaaagactgaatttaaaggaaaaatatcctattatagtgaatcgtacgtattgatattgcttgtatagaaaaagttagtgggtttcgtaactaagtgagcagcagctcgtagaccacctgaaaaaatatttattatttgagccgtgctcgtatcgatggctaataatgttttcagtgataaacaacgtaccaatcgaagtgaagtgtccgtggtgattcatcaatctcaagatatacctacttagtctttcgaaaattctcatagggtagagtgcgtgtgattatagggtgagtgtgcacgtgttatgagcgcctgtgtttatacggtgtcttttaaagaaaagttaatttctttgtcagaactagttgtgctgcttacatttctctgtgacttcattgccaattgcacagacatctcacttgtactgcttatacattactctaggacttcacctgtcaatttcacacacagctcgcttggcatctccataaatgtattttagatttctgttggatatataattcaatgcaaatgaatattatctcgtaaggaacgttactaaatactcctatataatctagtcataaatatatgacaacatctggtactgaaacctccaagattttgactatcaatgaattttactccttcaggtcccaaaattaagtattttgattttttttcttgagtcaaaactatcctaaatttgagtgagttaatagagaggggtattaatatttactattacatcaaacaagtaaactaggaaaatatgttgcgtaacatatgtaatgatgcccatttgatatcgtcgtaaatattattttttctatgaaattgatcaagtttaagtttttttaagaagggtattttttttacccggcctctacatctaatcagatatatgcggtccttttaaattaggaacttagccctcaactaatccaatctgaaattcgctcccacgaagattttgaattcaagatcttggggtgctaattaagtttaagatagcttgacttaaggataaaataaaaaaatgcttatgttttgggatgaatgaagtagactactttgaacatataaatggtgtatgtggacctgtgtattgaaaagtacgttcataagctcataaacttattacatttataaacttattatagtaaaagttatgatcaaaatcaaataccatatataaaaatatcaaacagtgcatatttttaaagagagggaatatgaaataagtagtaaaaatcagattgacttttctttacgatgaaaatcagtttgacttctgtttgcttgggcaagtagattgcttgccgtattcttatattttgacatataattttctctttccacagtcaatgatttgtgatgaacgaaataacacattatgtagacatcccctttttccattttaacatgcgacaatcacatggagaaatgtgttgaaatttgaagcccgtacactgtacaccaaagaagaaaatttttttgagggaaactacggcaggtgtgaacaccaacctgaactttattcatatggtaaaaatctttacaaagagggagctttattcatatggtaaaaatctttacaaaaagggaggtacagagggacagggagaagaaactaaaaattaggatttagcgcccaagagtagagttgttgtttgcctacggcgtcgttacatcggtttgaccacaactcgatatagctggcgcagcgacgaaggactagcgtgttggtttcatcgatggagttgaagatcttgttgttgcagcgtttccatatgttccaaactgcggcgagtaagatgatgcaccagacctgtggggtcagagcattgccgggggtgggaggccccataggtcttcgagttgtgctaggaggtaacttgctgttcatcaaatccataggagtgccaaatggctgccactccggagcagcgaaggaagaga

SEQ ID NO: 16102 - DNA, 1978 bp, Oryza sativa
ttggtaaataaattccaaataataaaaccaataatttccgatgccaattgttcatcacataataataatcaaaaacatctttgattttacaatgtcccccttgatgaacccattggcaaacacataaaaaatattttggtgtttggaaaaataaaaacaaaagtggtaaaaagcacacttcgtacaaatgtacacatcgtgctcgaaaatccaaaagaaaacttctctcacttttaaaagaaaagaaattcccaatcgaaccaaaaacaacatgctcttcaactcatttgcttctccaaaaattttcacttttcaccttgcttctcccaaaactcatctcttcttccccttttgacaatgatttcatcaagaataggaattatgttcattaatgttcaagagcttagcatacatatagcatatcaagtcatgtgttgtaataaaaagaagatgaacccatctataatacagcaagcgtgtattaaagtataaccatgaaccaaagattttacaattaaacttgaatcaacaatcaaaattcatgatttcatacgatttataatgcaacatcttaacaagcacataggttgaagaataaacccttaacacatatacatattgcattactctttttcaaataacctttagcacaaaataaccaagagaattttttaaccttttcttttcttgagcctttttgctcatatttttctcttttattccaggtacgtccctgtcgtcaagactgtttccagggattcggcacacattattttgctcacatcgaatacgtccttgtcgttaagactgtttccaaggattcggtattcattttttttttcatatttttattctcttttcacaatgagcaattaaagctatttgaggaataacaattcaataaagcatatatataaagcatttagaaatcaaaccatatgctagcatcaacattgcatatttgcataattcaagtagaatttaagtgtcatgcatcatctcccttaaaagcaaaatctaaatctcatgaaaagactagaataaagctatgctagagacaaataaaccttcaaagtattgctagcatgcaaaagaaaatgccatatgcataaacaaagctctcttttatcaatttttctcattgtcatactattgcttgataaaaccatgaggtacaaactccctctcaaaacatgccaaaaggatgaattattcccaattcaccacaaaaagaaaaacaaatcgattagaatccaaaggtttagtgaaaatatcagcaagttgcaactttgtatcaaaaaaactgcaattcaacatctcccttctcaacatgatccatcaaaaagtaaaaacgaatatcaatatgctttgtgcgtgagtgttgaacatgattcttagcaatgttagtagcactaatattatcacaaaagagtggtactttctcaaaagtaagaccataatctttcaaagtagataaaagacaaagaatctgtgaacaacaactagcagcagcaacatattcaaattcagtagttgattaagcaacactagattgtttcctagaagaccacgctaaaacctttcccattgtaaaacctttcgcaagcaaaaagttcttaagcctatcataccatgccgtaggagcttgtttcaaaccatacaaagttttagacaatttaaaaacatggttgggaaaattaggattttcaaaacctagtggtttgacataaacttcctcctgtataaaaccatttagaaaagcacttttcacatccatttgatacaatttaaaaccttttgaagcaacaaaagccaacaaaagtctaattgcctcaattctagcaacaggagcaaaagtttcatcaaaatccaaaccctccacctagctaaaaccttgagcaacaagtctagctttatttctcacaatcaaaccatcctcattttatttatttttgaaaacccacttgggctgcaggaa

SEQ ID NO: 16103 - DNA, 1259 bp, Oryza sativa
  unsure (1)..(1259): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttacttgactacttacctttttactttgattttgtaactttattcaaattaatccaaaaacttgtgctattaattggataaatgtcttaactccctcctttcacttgtctttagatgccgcgctacaagcctgagtacttgtttggtgttgagggatttgtccaggagttacgtacgatgtcctttgtcattggatttgggactgcccctttttatgctcagattcctcatgatcttcatgaagagaagtgccgagtcaaagtcaccttgaacagtaatagtgaagatatcccctcagtgatgttcgaagctggaggaagaaactacatccatgcatgtcaggaggtggcaaggatcgccataggagagcttcagtgatcagttggccgacactgagtatcgctaccatcctcgccaaccccagggaagtgaccgtggcagttaccttgagactgaaggaattgagaatgatgctaccacaaggcatttggttgagatgctgtgggctatggatgaaagtcgtgcggagactgtgttagcagctcaagatcgtgaagaccggaatcgtggtaagatttgcaagctagaagacaaggtggatcgtttggagaaggaactagctgcattaaagggagaagcaccgccacagaaggccaggattcgtctcaccgcaaggaagagagctctatttgtccctcgctaccaattggcgccaaaggtccgtgtggtggagaaagaagttgccccagccctagcggatcctccggtcattatcataagtgatgatgaaggagaagaatcaaagcgcacccattccaagattgagtgggtagcaactcaagatgatgaagacgagccgaacgagccttcaatcgacctccgatgctcggaagaactagagtgacttgttaagtcgttgtcttagatcgttgtgttagtttgcttgctttagtttggttgtgtgtgtctcgcatgtgatttacatcagtggtgggatgtaagtgcatgcgtttgtttgctttccagtgttagggagttggtgagtttagtggtgtgagagtcttcagttctgtaataatgaacctcagttaagatcaataaaagttaaagtaattctctgtcctaagtagtttcccccggtttct

SEQ ID NO: 16104 - DNA, 741 bp, Oryza sativa
agaagctcaagacgctccagatgtgattttgggtacgttccttgttaactcagttcctgcaacagtgcttttcgattctggtgctacacattcatttttatctatgagttttgcgggaaatcatgggatggaagtagaagatcttagacgtcctttgatggttagtaccccaagtaatcaagcactctctttgcaacgtagcccctctgtcagaatagaaattaaaggagtaccatttctggccaatcttatcttgttagaacccaaagaccttgatgtcatcctagggatggactggttagccagacataaaggtgtgatagactgtgctaacagaaaagtaactctcaccagcaatgatggtcgagttgtaactgttcatgcattgtcttctgagtctttaaggtcaagactgaaccagataactttggaagagattcctatagtccgggagtatcccgatgtgttcccagatgatttacctggtatgccgcctaaaagggatatagagttcagaatagatttggtacctggaacaactccgatccataagagaccttatagaatggcagccaacgagttggcagaagtcaaaaggcaagtagatgatttgcttcagaaaggatacatcagaccgagttcatcaccatggggagctccggttatttttgtgggaaagaaagatcatacccagaggatgtgtgtggactatcgtgcactaaacgatgtgactatcaagaa

SEQ ID NO: 16105 - DNA, 969 bp, Oryza sativa
tagcttttgggtttagttctcagaaaggaaatgtttatttcttcatttattagttccatgcagtatttcagtattgtaataagttcattgatcaagtgtgtgatggatgttgtgcgtttctctaaggaggtcatcttgtaatattaatcgggaggtttccataataaaatgaatggatttccttaatgtcatattccacgagggaaaattggggtgaaatttaaattatttgcatcctgctcgtcaagcttcgtgatttgtacatccatatactccatctctagttctgttagaataggtgtcgaatacactagtcctatttggttacagttggacttggagctgtaataggtgtgacggagcgtggggctcctcaccgggagaccgcgcaggcccccctttgccggttcggccgggggcgctaagtgaggttcttcaccctcgatctgtggaatgttcgcgagagagcaaatgcacaagacacgggcgatgtagataggttcgggccgctgaaaagcgtaataccctactcctgtgttctggtggatctgtgtgtgaaagagttacagagagccggagagcaagaaagttcaggctttaaaacccctcttcctcttttttttctctacgagctcaggtattctcagagtcgtctgagagtctcttccttttttttctcgtccccttgcttccgtgggccagggccttcttttatatttcaaggggataccacatgccccatttttacctactcttcttttggatgggaacccaccctattttgaccaaaacttggcttgcgccttcgcctggaagcttaatcacaacttgtcctttaatgaaggcttgcgccgtcactcgcctgacacaagggatacccctgtcattccttcattaatgggtggagatttgccatggccgctgtcccaatgacccttccatgggatgggtcatacctaccttcacttc

SEQ ID NO: 16106 - DNA, 717 bp, Oryza sativa
tttcacaaatagcaaaggatttttatttttgataatattgctaaggcttgggatctacggctcgtcctagggtcaagggggctctgataccaacttgtcacgaccggaattaacccaacgggcgttcctttcgtgcgtgtattattccttgtcccaggaggcaaggtacaccaagagttcatacaattcagagtttaacaagcggaagcgtaaatagataatttattacatgggcgacgaaggcccagcacacacaaagacaaacgagaaacagcggaagactagggcgacgacaacaggcgcttgacggcaggcacgagctagacaccaaagccttcatcatccaggggctcctcttctgggttgggaaaaattgagcaagactcagtacaaccaccgtactcaacaagacacacccacaagtgcataatatatgcaagggagtacaagggagttataatataaagggttagggttgcagtaaacagcatttaaagatgcttagttgctcaaagctattttgtaaacacgattctagaactatgcaatattatttatcaaggccgtgaacccacacgaacctgccttaaccccaggcctacgatgattcagaccaaaccggcaacccgaccctgggtcccagctcgtcccaagccaacccaggccaaccattccacattttagttgttaagcatgttttaagaattcaaacactaa

SEQ ID NO: 16107 - DNA, 2732 bp, Oryza sativa
taagtagacaaaaccaaactcaccagacttgtatgaagagaaccactccttccttggcgtcacatgaaacgagctagctgaatctaatatccacgcttctgcatccttagactgtgcacttgacatcgtgagaagatcacaaccatcgctatctgagtcatttgaagaagtcactgtattagcctttgcttttcccttcagtgttggacactccctgcttatatgcccccactcatcacatctgaagcactgcaccatcttcttctttttgttcttctttaccttatgcccagcatgatcttctttgactagcaaaccctccgcttgagatgtttcaccctctttgttctttctcatctgatcacgagccagcaacgcagaagtgatatctttagttttgatggtctccttgccgtacgtcaaagtagtcaccacatgctcatacgattcaggtaaagaacacaaaaaaactatggccttgtcttcatcgtcaacttccacatccatcttcacaagatctgtgactagttgattgaaaacgttcacatgtactgtcagatccgccccttcctgcatctttagcccatacaacttctacttcagatacagtttattggttagaatcttggacataaactgagcttccaacttttcccaaattatctttggtgaggtctccaccatcacatggtacatgacctgatctgagagacatagccttattgtcgcagccgcctgcaactgcatctcctcccaatcgtcatcctccatcttggccggtttgacacccttcaaagcctttgaacctccttgttgagctaacaaatctttgaccctagtctaccacaagccaaaatttccggagccgtcaaacttcaccaaatcaaatttcatacctgtcggcgccatcttgccaacccacgacctgactggtctgtcgccaccagaatactcgccctgctcagaaccgtctgtattcgtcttcacaatcccgtcttgtgatccgatctcagacattcaatagcaaaccgtgttcgctataatccgatgtgaccaatcttccaccctcgatgtgcctctactccgcatgatctcgtcggcctggcttggtcgacccatacgcgcgcactttgtcacgagcctctgcacagcaagcctattgagccccttgtaccatgtttgaccaatgtcctgccgagccgcccaaaaatcgctgccgctttgttgctttggttcggctctctcttcggctgcctatttaaagggcaagcaatacgagtctgatgcgatcacgagtccatatccatacataactctgaatccgactccatagcaactgcggtcgagtcggccttgtccgactccgacaagtcattttatcatccaactcctctactcgatttcttttttggctcatcaatctgtcagactcccacggtacaaaagtttccatatgtatgaagcattagtactcaagggcgtgcctacgttatactacccggtgtcataggacaccgggtagattattcaaatcctatataaattacactatattaattaatatattagtcaataattagataattagtatgtattggacccccggtaatttttgttctgggttcgccactgttggtactgctgccccttgatcccttgtgcacgcacgatatgcatgccctgcatgctcatgttcacgtgaatatgctcaagccatgcacgagttccaaagctgcagcttccctgcccttgtttgcatgcaattgctcgatttggttttgcttcttgcctttgctcgttagtctttgcacgccatacgtataagacagcacctgtgctatctgtccgtgcctatgcacgcaccgcagtcgcagccctcgtgttcaccgtccatgaccccgtcgtcccggccctccacgtccgccgcgccgcgccacgctcgccggtttcgccctttcatcactggcctcctgccgccgcggatccgcgatcaccacgtgcgtcgggcgcgccgtccatggcgctacccctcagatctctccagtcgccttcggccacgcccggccccgtcttccggtcattttccgccatcgccggtctgatcgcgagcgaggtcaccgcctccgcaacatcctcgttgtcgccatcgatctcatcgccacggctgacgatctcatgtcgatgcgtgatccccacctcgtgtttcctcctccacatgtcttcttgatctaatgctgaaaccttctgctctgataccacttgttataaaagttagccgatatagcggaacgacgactaaccttcccgatcgcttcaatcattgatcacccaagacacgccagatgacgacacaggaacacacgatatttgttaacaaggttcagctgaagcctacatccccggggctctgattatgggtgctcctcctcaaccaatatagctcctagccactacgagtccatggccacgctgtcatcatctccctgcgtgtctacgctacattgtagtcgccatggttatattgtggtgcccccctctctatttaagagagttgccgggttacagagtccgactctaactccaccccctaacaccttgtcggtgacatggggccgagggtatcgtgactagaggcttgggtagccgcggtcacccacgtgccctgacccccacgggggggggtcgggcccgagggtgacgtggccacccttccctgtgtctccccgaggggt

SEQ ID NO: 16108 - DNA, 11205 bp, Oryza sativa
  unsure (1)..(11205): unsure at all n locations
ggtgcgcgaagatggccaacgtcattaccgcgttgggggtgaggtgcgccatctggagatcataaaactccagaatatccagaaaaaagaagagaatggggcccggggggggggggaaaanccccccccaaaagggnccccnctggncccattgcgngaaaagaaaaggaagaangacggaccgccccgggtagtgtggcgccgggcgtccctcacccagcgcgaccacctcccggccggtgacagattccggcatgaatcggcgcggcagcccggcctgcctctcgctcacgatgcgggaaggcggcagcacgctaccgtcgagcggtgcggagccccgtgccatgatgccggcggaggaggagcttgagagcgagtgagtgcggcaagggtagggcacaggaaacgaagagttagtgctcaagtggcgaaggcaaggggaagaatggcgagaggaaggaagcaaatctcttcctcggcgtctttatacccttgccaacgctattcccggctcctcgtttcccgcgcccactacctcgccccctggtttctcgcgcccacgcctccactaacccaactcgcccgtttgcggcacacgagacggatgtgcggccgtagcagttgagatgggacagatcaagcgcgcattaaccatgctcgccagacgcgaaaagcgccatcatcacgtctccaggcgaaacgaaccggctcgtcccgattcgcgcactgctcgagtaatgtagcggtcttaaagaggccgctcattattgtcggtcggttttcccttgccgatgcgcgcaacttgcgaccgctgggttcctgcccgcctgtagggacctgccccacctgtcaccgggcctaaggagtggcgtcacgtccgagcgcttccctcgaagggggcaatcgccctggcgtaacgccgggggctactgtcggtgacatggggccgagggtatcgtgactagaggcttgggtagccgcggtcacccacgtggcctgaccccctcgggggggtcaggcccgagggtgacgtggccacacctccctctgtctccccgaggggtcgggccgctcccgcttcggccccgagggctggggcgccccgaccccctgtggttttggcaccacgtgtgtgggttaggtgagcacagcggcgctcacctaaccgcacttatagcggattgacgagcgcgtcacgccgcatttaatgcggcgcagtgcgcgcttatccggtccgtgaccagttgcagtgtgtaaccggtcacagaccggtcagatcgcgggttaggtggcaacaggcggcctgtcacacgcctcgccccgtcccgtcgaaatgatgagagcctccaggcactcgtctctagccggagctggcgtgctagctcctggagtgggtatgtcagtcccggccagattcataccaggcttcatcgcaaccattacaaggaagtaattgtatgaagaagggcagacgtgtggcatgctaaactgacacgtggtagacaagaatgaccggtttgtgactggtctgacgccggtcacgtcatcggcagacaaccgtgctcccacattgcatctgcttccggcggagtggaggtaggtatgacccatcccatcggagggtcattcggacagcggccattgcaaatctccacccattaatgaaggaatgacagggctatcccctgtgtcaggcgagtgacggcgcaaggcctcactcaaggacaagctgtgatttagcttccaggcgaaggcgcgagccaagttttggtcaagatagggtgggtccccatccaaaagaagagtaggtaaaaatggtgcatgtggtatccccttgagatataaaaggaggaccttgcccaccgaagcaaggggacgagaaaaaaaagggagagactctcagacgactctgagaatacctgagctcgtagaggagagaaagaagaagagtggttctagagcctgaactctcttgctctccggctctctgtaactctttcacacacagatccaccagaacacaggagtagggtattacgcttctcagcggcccgaacctatctacatcgcccgtgtcttgtgcatttgctctctcacgaacattccacagatcgagggtgaagaacctcacttagcgcccccggccgaaccggcaaaggggggcatgcgcggtctcccggtgaggagccccacgctccgtcatctggcgcgccaggtagggggcgcgtgtgtctttctaagccctcgtcctctttcgtgtgcgccaagcttccctcgctcagcccaatggccgaacaggcagtggcgcacaacctctctccgagcgctagcggtgacgacggggagcagaacccgcgccgtcgagctcgtactccaccgtccccctctcgccgaagtcttgggcgggaggaggcgttcgaggaggtcgaaagatccgcgacttcaccgcccacgggcgatggagaaggacggcgagacggggagcgtcgcctcctcgtctacggcgatggcagcacgccccagggcgcgctccaggctgcgggcgcgctcctgcgtcccccgcccgtcgtccccgatccagagactccagcccgacgttggctggatgacgtggccaacttggtcatgacggcgcagcagcgcctaggcgccggcgggcggtcctccgccaccaaggcctctggcgctgctaccgccggctccgtgtcgtcgaggcggagggcgcggcgagcggcggccgttacccgccgttcgtccgccattccttcgtcaacgcctccgacccaagaagatgtgcgtggggggccagatgcccacctcaatatcgagcgccggcgcaatggtcgtcgtgctgcccacgcaacggagggcgcttcctcatctggagcgccacttcggtccgggcacgggggccaggcccccgtgtccccggttggcggtgccggctgtcgagcctttgtggcgagccttcgaaacgtccgttggcccctaaggttccggcctaccatcaccgaaaaatacgacggaagcgttaaccccgccgagtttctccagatctacacgactgggatcgaagccgccgggggtgacgacagggtcatggcgaatttcttccccatggccctgaaaggtcaggcgcggggttggctaatgaacttgccacccgcatcggtccactcttgggaggatttgtgccagcagttcaccatgaactccagggcacatatccgcgcccaggtgaagaagcggacttgcatgcgggacagcgaagggacgatgagtctcttcgctcgtacattcaacggttctgtcaagtccgcaacaccataccatgcatccccgcacacgcggtgatatacgcgttcaggggggcgtgcggcacaaccgcatgctcgagaagatcgcctccatggagccccagaccaccgcggagcttttttagctcgcggaccgtgtggctcgcaaggaggaggcctggacctggaactcctccggttccggtgtggcagcttcggccgcccctgggtccgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgactggcaagtggtgcactgtgcacaacacctccctccacgacctcgcggactgccgcgcagtcaaaagtttggctgagcggatgaggaagtgggaggaggagaggaggcaggagcgccgtgagggcaaggccccggcggctcccgccggcaaccggcgaggtgaggccaagcagaaggccaccgccggggacgtcgacgatggcgacgatgacctggggttccaggagcctgaggccaccgtcgccaccgtcgatgggggagcgtgcgctcacgcttctcgccggagcctcaaggccaagaagcgagagcttctggccgcggcccctacccatgaggcgacgcggcgggcgtggtggtcggaggttgccctcaccttcgaccagaccgaccacccgccgtgcgttgcccggggagtacagatcgcgatggtggttttccccactgtttgcaacgtgaagttggggcgtgtcctcatacacgggggtgcagccctcaacatcctttcccccgcagcctttgacgccatcaaggccctggggatggtgctccggccgtcccagccgatcatcgatgtgacgccggggcacacttggccgctaggtcatatcgacctcccggtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgaagatgccgggtcccggtggccccatctccgtccatggcgaccacaaagtcgcgctcgcttgtatggagcagcgcgcggaccacctcgccgcggcgtccaagcccgagggtggcgacgagaggctcagcacctccgtccctgccgccccgaggcagcggatgatcacgtgtgacgaggtcccggtcaaggaggttgccctgggcgacggcccgtccaagaccacacgaatcggtggtcttctagacgacaaataggaagacgcgctcgtctccttcctgcgggcaaacgccgatgtcttcgcctggagaccggcggacatgcccggggtccccagggaggtgattgagcaccgtctcgccgtgcggccgggcgcaaggccggtccggcagaaagtgcggcggcaggccccgaaacgtcaagccttcatccgtgaggaggtggcgcgacttctggaggccggattcatccgtgaggtcatccatccgaagtggctggcgaacccggtcgtcgttcccaaggcgaacggcaagcttcggatgtgcatcgactacaccgaccttaacaaggcatgtcctaaggacccttaccccctgcctcgcatagatcagattgtcgactccaccgcggggtgtgaccttttgtgttttctagatgcatactctggttatcatcagattcgcatggctagggaggatgaggaaaacactgcattcattacccccataggaacttattgttatatgacaatgcctttcgggttaaagaatgcaggtcctacttttcaacgtactactcgaatttctttgggtaaccaaatagaacgtaatgttgaggcgtatgttgatgacttggttgtgaagacacgcaaccaagagaccttactctcggatctagcggaaactttcgaaagtctccgctccgcccgcataaagctgaaccgcgataagtgtgtgttcggcgtgcctgcgagcaagcttctcgggttcttggtctctgcccgaggcatcgaggccaaccccgagaagatacgagctatagagcggatgcggcccccagcaagcttagggacgtgcaatgcgtcaccggctgcatgactgccctaagtcggttcatatcgaggctgggagagaaggcgctacccctatttaagctcctcaaacactccgggccgtttacctagacggaggaggctgagcgggccttcactcagttgaaggcgtacctcagttctcccccagtcctggtcgccccggagccagatgagctgttgctactctacttggcggcaaccccgcaggtggtcagcgcggcgttggtagtggagtgcgacgaggacaaccctcactccgcgcatccccaccctgtgtcgactcgacccgggagagagcagggaggagaggcccccgagccgaacagcggcccgaggcccccgacggccggagcaggccctccgcccgcttgtccgacggtgccaggcgcccccgacccccaggatggcctcggggccactgcgggaaggccgcgcctgtcgccctctgaccccgaggtcgtcggcccaaaagtcgagtgcgcccctggtggcctctcggacgaagagcgccccggagatgtggcccctggcgaagaggatcggccccgccgaaaggtgcagcggcccgtctacttcattagtgaggccctccgggacgccaagacccgataccctcaggcccagaagatgctttatgctattctgatggcctcaaggaaattgcgccattatttccaggcgcatcgggtcacggtggttacatcttaccccctcggccaaatcttgcataaccgagagggtactggacgggtggtgaaatgggcaatcgaactctctgagttcgatttgcactttgaaccacaccacgcgatcaagagccaggccctcgctgactttgtggcagagtggaccccagctcctgagcccgtctccgtccccgaggccagctcggacccctcgcagctgcctcacaccgcctactgggtgatgcagtccgacggctccctgtctcttcagggcgccggtgcgggggtcacgttgacctcgccgagcggagacgtcctcagatacatggttcgcctcgactttcgggcaaccaataatatggcggagtacgagggactccttgcgggacttagggtggcagctggactggggatccgccgcctcctggtgttaggcgactcccagctggtcgttaaccaggtctgtaaggagtaccggtgctctgacccgcagatggacgcttacgtgcgccaggtgcggcgtatgaagcgccatttcgacgggatagagcttcggcacgtgcccagacgggataacgcggtcgccgatgaactctcaaggctcgcttcctcgcgagcccagaccccaccgggcgcctttgaagaaaggcttgcccagccgtcggcgcgacccgaccccctaggggagacggatgcgcctgaacggcccccgtggcccgtcggagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctttatcggcgcgcggctaacggagtcctcctgaagtgcattcctcgggaacaaggcgtcgagcttcttgccgatgtccatgaaggcgagtgcggagcccactccgcctcacgcaccttggttggcaaggcctttcgctagggtttctattggccgacggctctcaacgatgcggtcgacctggtccggcggtgcagggcgtgccagttccacgccaggcaaacccatcagccggcccaggccctgcagaccatacctctttcgtggccgtttgttgtctgggggctcgatatcctgggtccgtttaggcgggccccgggcgggttcgagtatctgtatgtcgctgtcgacaagttcactaagtggcccgaggcttatccggtcgtcaagatcgataagcactccgcgctaaaattcatcaggggcatcactgctcggtttggggtgcctaaccatatcattacggataacggcacccagttcactagtgagctcttcggtgactactgcgaagacatgggcatcaagctctgcttcgcctcccccgcccaccccagaagcaatggccaagtgtagcgcgccaacgcggaaatcctcaaaggcctcaaaaccaagaccttcaacatcctcaagaagcacggcgactcgtggatcgaggagctgccagcagtgctctaggcaaaccgaaccacgccaagccgagcaaccggggaaacgcctttcttcctcgtctacggcgcggaggcggtcctcccatctgagctcaccctgaggtcccctcgggccaccatgtactgcgaggctgatcaagatcagcttcgcagagacgacctcgactacttggaagagcgaaggcggcgcgcggccctccgagccgcgcgctaccagcagagcctgcggcgctaccatcagcgccacgtccgagcccgatcactctgcgtcgacgacctcgtcctacgccgcgtccaaacgcgtgctggactgagcaagctctcaccaatgcgggagggtccgtatcgagtgatcggcgtcccccggccgggctccgttcggctggccacgggcgacggcacagagctgcctaacccatggaacatcgaacaccttcgtcgcttctacccctagtgggggtcgggtgtcaggtctcgggctcaggccaaccccgcacccccccgggcgtgcagggttggccgggggctaccacatgcatatacttatcttttttctcttccgtatttcaataaaagctttttcgatttcctaaggactgtgtctgtgccattgtttccttttgaagaatcttggcttgaattagcacgctcgtgctcgatcctgccctcggtgtcccgggccggctaaaatcgccaaaaggggcccagaaccgagccgtgccccggggcgtggtgaactccgggggggaattggcaaaggcccacaatcgggtcatccataaccctcggtcaccacgctcccggcttggacagtctcgacacgtggatctccccaggcactagccccgacccgcgccgtttgaggctgggacctgggcacgagcccttgttcaagccaagacacagaaggaccgcggcacagaccatcctcgtctcatacacacaacaaacagaattgacacagaaatttcctctttatttgattgcagattaaattagtctatacaagaagggggcccgaaggcctcggaagaggaaagaaaaaactattaagatagacgggggcctgggggctcactccgacgcgcccgggtcgccggcctcgtcgtcgctgtcgtccacaccgtcgtcaccgccctcctcgtcagagtcgagggcgaacgcgagccgaggggccgtaccctcgaagctgtggacgatgtggtcggcggcgtcccggacccgcgcgcgcgtgccgtcctcggttccgggagggaactcttccagcgttgcccacggggagaagtcagggtccctggcctggtaacttgccagtacgagctccaccgccccccgggcgagatccctcgaggatgacttgatcgtctcctcgagctcctcggggagccgcttgaggaccccggccatctctgagaggcgctgggcgaggcccccctggttggcggcgtacttcgcggttcggccgccccagagacccgcttgccgcccggcgtggtatagacgggagacggcgtcccgaagcatgccgggccccacctcgctcgccaagcggagggcctcgacctcccctgcggacgagtccagcgcgccctgcagcttggcgatggtgtgttcggcggctgcgaggagggcggctgggtcgccatggcccgcggccgccccgccgctgtgcgctctcgcgtccaactccttcgctcgctcctcgagctcagcggcacgctgatccagtgcggccctctcggcgcgggcgctttccagatcgcggcgcgcttactcctcccgcgctgccacgcggagggactgtccgccagccgctgcgccgcggcctcggcctcctcgagagctcgctcccgctcggtgagcgcgtcctcgcggaggcggagtgcggactcctcttcggcgcaggcggcctcgtgcgccgccagtgttgcctcccgggtggcgacggcggcctcgcggtccgccaggtccctctccttcgcgcgggcgcgctcctccagcaccgtggcgcgagcctcaagggcctcttcgcgctgccgggacgccgcctcgatctccgctgcccgccgttcccgggcagcgacggcgtcaaggactccccgggtggcgtcgagcttcttctctagctccgccgcccgactcccgtattggaggcggaggtcgtcccgcacctcgtcgagcacggcggtggcgatgagggcagtctcccactcctcctccacctccctggcgatctccgccaggtccctgcgacgggcctcgagctcggaagcgtgccggcggtgtgccttgcggcccgcctccaccatggcctccaccgagcgccgcccctcctcgacgcgcgcccacgccgcgtcgagctccgcccgctccgcctgcaggacctccatctgggcacttaacccgtctaacaccgtagtattcgcggcggccaaggcctgcagaaggggctctgcgctcggtggggcagcggaaggcagaggggagagccgtctcggtgagggtgccgcacggctcggcccgccgatcgacgtgccggacgcggtgtactcccaggtgccccgggcgcgccgttggagcggcgcgatccggcgacgaaggtagtcgccgaacaccatggcccccgtaagcccctgggatcgcagacccgccaggcggtcaagaatggcgtcgtagccgtctcccagatctaccgtcgcccgccagctggaggcctgcgccgggggctggctcggaagtcggaggcgcgcttcgtcggcgaggagggtgtagaaccaatcgctcttccagtcgtcccactttttgcggaggacgcagggaatgtagcggttcagcacctgcccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaaactccagaatatccatgaaaaaagaagagaatggcgggaccagccctgccattgcgaaagagaggaagaagacggaccgccccgggtagtgtggcgccgggcgtccctcacccagcgcgaccacctcccggccggtgacagattccggcatgaatcggcgcggcagcccggcctgcctctcgctcacgatgcgggaaggcggcagcacgctaccgtcgagcggtgcggagccccgtgccatgatgccggcggaggaggagcttgagagcgagtgagtgcggcaagggtagggcacaggaaacgaagagttagtgctcaagtggcgaaggcaaggggaagaatggcgacaggacagaagcaaatctcttcctcggcgtctttatacccttg

SEQ ID NO: 16109 - DNA, 6450 bp, Oryza sativa
tgacattaaggaaatccattcattttattatggaaacctcccgattaatattacaagatgacctccttagagaaacgcacaacatccatcacacacttgatcaatgaacttattacaatactgaaatactgcatggaactaataaatgaagaaataaacatttcctttctgagaactaaacccaaaagctatggaatctcagcaatgatcatctagcactgtggcaagtccgatggtggtggcggtaacgatgtctcctgcgttggaccgttctgaacctcaaacaccatgccaagcccgaactctagatgagcatcgaagtggcagtgcatgaaccaaacccctgcatcaaacacacaaatgtcaaatttgatttcacaatagtcaagtcaacgaaatgatcagaagaaaagaaattctgggttgtagctagttacgggtcatcttccctatgataactaaaaacgtgcaattttagatgtcgacagtctttggaattcaccgttgactattatcaaaaacacaaactctgataaaaatcgtatattgtgacatattttcaagcaaaaattactgcaatcatctgcatatgcgtataatttaaactgtttgaatatttacattgaaagttttaacgagacattaatttggcattaccacgcgtgtgatacacttataattataattaatagtactccctctattccataatataaagttttaaaaactaatatttcactaataattataaccatatgaaagtaaattcaaattttaatctataatattattttcagcaaataaaatttagttcatattatattgattgttgatcgtgctttaaaagttgaatcttgaaccacatgtgtgtcttatatgatgggatggagagagtatatgattttgtgcaaatatatacctgggttgtctgcaacgaagcggatgacggcccagccgccggtggggacggcgacggtgttgcgctcctgcggatcgacgaggttgaacttggccgggtccgtcgtctcgttgtagttgccgaagccctgtgcgaggacgaagaagttgaagccatggaggtgcatcgggtggctctccttggacaccagcctcgtgttctgcagcaccatctgcaccgtcgagttgtacttgagcgtcttcaccttggtcgacttgaacgtgtgcttcagcgtcgcgttatcgtccgatgcgtcagcggtgtagtcgaagacgatcggcggcgtgtcggggaagtcgcgggtgtagacgccgtcgatggagcccttgtacatggcctcgagcatggaggttgtgttcgggaggatgaaggaggcgttgttcatgctcgacgcgaagatggtccctttgtcgtctggcatgcacatcgtctgctccggtccgcagaaggtgtctcccatggagacggtgacgaacatgtgggtgtcgacggcgagcggcacacggttcggcaccagcgccgtcatattggagagaaaccggtgcgcggtggccgtgtcgttgtactccggcatgtccggcaccatgggtggcgaggtcgccgggccgccgccgtactcgacgatggccgtgctgttggtcaggctgtacagaaaacttgggtcggcagcattaacggcgctgttgtacgggatgaccgccatgtagtagcgccctccgacggccgcggcgacgccggcgtccggtaccaggagcgcgtccaccgtctgccccggcgagatgaccaccacgtcggtcttgtacggcttggtgtagcacgcgtcggcggccaccacgttgaagctgtggttggccaccttgaagaagagcggcgtgttgagcgcagcgttgatgatccggagcatgtacgtcttgttctgcttcagctcgaacttgtgcgtttctgccagcaaaaaaaaacacatcaaaattcatccaagacacatctcgattgccatgaatattgcatgtgatcgatcagcaacttacggttgggggcagagcagttgtagaaatcgccgggcttgccgttgatggtgtacgcgtcggcgtggggcgccggattgccagtaacgagggagcgctgctgcaggtcgtacacgttcgtcttccaccactcaccgaggatgaccaccacctcctcatcgggcacggggaacgggtaggccttggcgccgccgcgaggtttgatgatgagcgcgccatagacggtggcgcggaggaaggaaaaatgggagtgccaccacagcgtgccctcctgcccggtgacgttgaaccggtaagtgtagttgcctccgggacggaccggacactgcgtgaccatagccggtccatccgcccatggcgtaccgcgctggaagataccatgcctgcatccaagacacaattgatgataatccttcgttcaccgtggatgaacgtagatattaattttaccgttcttgagaagataaaatattaccagtggatggtcatgttgtagggtgactcgttgaccatatgaacaaccaccgtgtcgccctcagtggcaacgatcgtcgggccggggagctgaccattcactgcagttatgatcatttcctgctggcatagctgactaatggagaggttacctacctgctcagttcaaaaatgtaagattaagacatggtttagttcgatcacctttgacaagtaacccctccttgaacacaaatgaagttctactccctccggtcaaaagaatatatttttttttcttgtgcaattttgcacccattttttttatcgtaacaactaacgagtacataaaatctaatatgttaatgtgaagaatcttgtcacaccagttttgcagtttcaaactaaaattcttaaacatattaataatagtccatatttggaaactgcaggaaatagtattaaaatttatgtatttgattccaggagagttttttttatgccatgtctacgtcttgagccaaaagccctatctcatgaattaaagataacagtgttcatgcatgttgcgatatatatgcgataaaatagaagaaaaaaaactgcatgcataaatggaagtatatgaaaactagatagaatattacattgaaagtgtactccacaacagcagcttgagcaacggaagcaaccaaagcaagcgcaaatggaagaagaagaagcgaccatgatctcgccatattatccttaactatttgtgtaccaaatggatgttcgagatggacaggtgacttcatttgattttggatgaagtaaattatggttcaagatgaactatttatagagatgttggggctgactggttcaatcatcaaggaagacaattaaacagacttgaaatttcatgcttaactacagagaaagaagacgtgcttagattcttttctgctgcttcagaagttttatttctctgcaagtaattatggaggcagttaaaaattcctatatattccttcccaagcttagctttacttgctagctagttacgcacatgcttatgttgcttttctttggaaaaggttgactaatcaatgcttctagtttagtactcatgtatgacgatagcaatatagtagaaaaaaaattgacagtttcatggttagtttggtgtggtgcagattccatatatatggtgctgatgtgatgacataattatagaaaagtatgtgcaaaacttttggccgtcgagcacatctgatatccctgacagttcttggacatctcaaacaacttcgacacaggcgatttttacgcaggagctaacccatacagtttctcatttagatgtatactccctccaaatttataattcttactgtaacacttttaatatggacatggtctccaaaacatatattaacaacgattttttaataatatataataaaagaaaaattttattttattaaagtacactgtctctacttccttcggttccgtaattacagatattttagttaaggatgagaggtgaaacaattagaattttaccaatcaataactttaaaattatttactccaggtatgtatttaacgtgaaaattgtgtggcaccgtgtatggatttacattaaaatatgatatatttttttgggtttttttagcccgaaaaatcaactcatggacgcgcggctggaatcaacgtgtgtgatgatccacatcatagaggctttttatccgtgtaagtgataacccacataacagacgtagatacagagacgttgtctctcgtgtttgtgttacgtgcccgtaatattgggggcatgttgaatgattaaaatgtagttgttgcttagggccggtatcgttatgctttttgtagccttgccaattttcggcaatggtagaattgactattgcagatgtttagattgttactccctccgtttcagtttataagactttctagtattgctcacatttacatatatattaatgaatttagacatatatatgtgtcaagatttattaatatatatatgaatgttggtaatgttagaaattcttataacctaaaacggaggtagtaccatttttttttaagtaagagttgctagctaggctagctagtgtttagtttcctactaaagagtatttcgtcgtggactaactaaaatcaaccaaaccaaaaaataggcagtcaaaaatttggctacaaacaaaataaggcataaaattttcagcaacaccattattttcgtatggttaagtttgtgaggcaaagaaccaaacaactagatcttaatgtgatataatttgggtaaaacaagaaatacgacagggaacatatcctatgcacataacatttccatgcgcgccaactagcaaatgtcatgaaaagttctaacatatactcttaatagtattacacatatatacatatatatatatatatagcaaagtctcatattcaaatttattatattttagcctaaaaattgagaaatttaacaattttaagagtagaaatctatcagaattttatcttccttttgtcacggctaaaatataataaatttgaagatcagatttcacacatgggccggtgtaatactattgaaagtacgtgtctatttttttctaaaattttctgtgacatttgttacttggtgtgcacaggaatattatgtgcataggatatattcacacctatataacgttggatatatagatgaaaacgatacgaaaactttatggagttcggactttttcggaaacggaaattgttgctcggatttttttggagtcttttagaaacggaaatgaatttgaatttttatatcggaaacggaaatgaatgtgataagaacagttttcgtcgaaactcggaattggttgagaactttctatacaatttctcgaaatttctagagttacaaaggcccgtactatagtccataaccataataatagcctagcccaatccaagttagcatcctattgattgtattgattgtgttttctgatataccgttgactactgagactagagatagtaattggacatgataaagttttaacctcagtttgagggggtcttgtattcagataaatttacgtaaccgtatccatgtcagttcttattcgctacattttttttcaacaatattcgattccatttttattctgggtttccgattttgattaaaaaaatagaaacggaaactatagaaatgatttccgatccgttttcatccatagtgggagtgcatccatatattggtagtcattctcacattattgtaaggcaaaatttactacagggcatcgaaaaaacgtgtaattagcttgtggacatcgcaagaatgagaatttgctgttggtcatcacaaaaaaaaacgtgtaattagctcctggacactctgagccttattttattatttaatgtgaatttggagagagaaacacgatgagagtacgattttgcccctgccctcacactggccagagcaccgccgccaccacctccgcatggcggccggagcccacgcaggccaccaacgcacgccatcgcatgcacttctgcaccgccgccgccagccaacgcacgtgcatgccgccaccgccggcggcagccgacgcacgcgcgcgctgctgccttttcccccatctgcgccgccacgccggaagacgaggaagacgacagcgacaaggacaacaggaaggaggaggccgtggggcttgagatgctgcgcatcgaccgcgcgtggaagtccgtgaagcccacaagctctgccagcggcagccgcgggctgatgccggtggagctgctccggcctgtggtcgccgccgtcgcatcgctggctcgctgcgtgcgtgcatgtgctgaggaatcgaatcgaatcgagggaggaagtggctggtgcgtggcggcgatggacggggacgccagggtgaggagtggctatggcgcgagggcgggtcctggtgctactactagtgctacgacgtcgtc

SEQ ID NO: 16110 - DNA, 1915 bp, Oryza sativa
gccggccaacccaatgtgttgtctcactgtccaggtcgagacccaagggcaaacttgtctttatttagtgtttctctctccaaatttacaggaaataataaaataaggtcccgagtgtccaggagctaattacacgtttttttatgcccgacagcaaattctcgattttgcggtgtccacgagctaattacacattttttcgatgccctgtagcaaattttgcgttattgtaaaagaagggccatcatgatgtatgcaaagtggtcacctttgtcacatgctgttcaagtggaactagaagtaaagaaagacaagtattgtataacttattccgggcttctgagaaaaggttgaactacgaatgtcataactttctcatatgaactgcacctacgatcgcaagttatccagatgtgatagattggagcctaatcatgaaaactatcttccggacaatcattgagttcattgagtacgtaaaagtgattactacctccgtcccaaaataattacagttgtaggtatctgtatacaacgtttaaccgtccgtattatttaaaaaaattatgaaaaaattgaaaaaaaaatagtcacacgtaaagtactattcatgttttatcatctaataacaataaaaatattaatcataaaaatttcaaataagataaacggtcaaacattagacatgaacagtgtaaaactgtacttattttaggacggagcgagtacttatgtggtcttcaaagaataacatctagatctcctaaaacatgtggtgccaaacatcgaactcttaaaccattaattaattattaaaaattaggacttccatatgtgaaaataatattagtgaaaacgcaatttttttttctttggaacccaacatttgaatgtgtgaaagagagaaagcacatcttccttgggcagtcagccatcaaccttttcttcggtgtgctcagctgtcattatgtttatcggatgttacaactgcaaagtcatgcatacttagcaaaggtcattttattctatagtagcatatatcattctcaatttgaagaaaacataaaagtaaagttcatgtctaaatcaagattaacgtgtgagttaagtccttagaatttaatcacacgcttagctgaaattttaccggaagcatattaacatatatatgcgcacctccaattaccaaataatgttgtatatgtgtgagtactgtttgacctatgtatacttttcaagagtttgacagagaaaaaaaattaatggatcgatttgggcaaatatcctacagctattttccttagagagtctgcaatacagctcatatggctgtcatcacgtctctggtaaacctaatccttatcctttacggaactgtccacacccttctctttcatccttgtattggataatgggatagcatatcgtcacaccttgccaacaaaccgccctttcactaccaaagctacctatgatctaagcttttccaagttatcggatgatctatttgttggacccactttgggcaaccatgctcaaaccaaatgcaagatcttcctttggacaacgcacaagtgacgtgcaaaatcaaaggtgtttttgattattattctgtgatgaacaattggcataggagattatttgtttttttatttagaatttatttacgaagtggttttggagatgattggattttacaggtgaatctacaggatactgctgttattttttgtagacctgtcagaccgggcatgtgctgctggtcagaccggcgtgtattgcgcggtcagagccttgttttcttctttggatttttatcgatctagagtttttgccatggctactcctgttaggttttcaactaagcctcatgttttcgatggaacggatttttcttattggtgtagtaggatgc

SEQ ID NO: 16111 - DNA, 606 bp, Oryza sativa
cctattggatcttctagtcgtgtgtctcagtactggattcctaaatttttgttatcatctaaccccagtactgaggcttcgacttctgcttgtgtgtaggctttggtggcgcggaaggagaacatgtggatcgtagattccggttgttcacggcacatgaccggtgataaaaattggttctcctccctcaaaaaggcatccaagactaaatcgattatctttggtgatgcttctacaagtctcgctacaggtttggttaaggtaaatgaaaattttgaattgaagaatgtagctttggttgaggacttaaagtacaatttgctttcagttttacaaattgttgatgaagattttgaggttcactttaagaaaactggaagtaaagtttttgattcttgtggtgattctgtgttgaatatttctcgatatggaagagtgtttaaagctgattttgataatcctgtttcacctgtgataatatgtttggtagctaagtttgataaagatatgatgttttggcatcgtagacttggacatgttggttttgatcatctcactaggttaagtggtttggatcttgttcgtggtttgcctccacttaagaaa

SEQ ID NO: 16112 - DNA, 546 bp, Oryza sativa
gatggagtatttgcatgagtttaacaacttggcccggtacgccccggaggatgtgcgggaagatgaggagaagcaagagaagttcttggcaggaatggacccggagctgtctgtccgtctagtctccggtgactatccggatttccaacgtctggtggacaaaagcatccgcttggaagccaagcacaaggaactggagtcgcacaagcgtcgcttggcgaatttccgcaaccaacagggtgctaaccaaaggatccgctacaccaatccctatccagggggatcttcctcgcagcagcagcaacctcgctccgcgcctcgacctcaattcgtggtgcgcgtcccacagccgcagcaacagcagagccagcaagggacccatgcgccccgtcctcctacgccagccgcgcagtctggtcaaggccgcagggacgttcaaggtccgcagcgtctgtgcttcaactgcttcgagcccgggcactttgcggataaatgcccgaagtcgaggcgccagcaaggccaagcgcctccctgctccaacaacgg

SEQ ID NO: 16113 - DNA, 838 bp, Oryza sativa
caaccaacgttcaagtacctacagtccagcaacagtgcaagttatcagaatttctcaaaactgagactccaacctttgccattgtcgtcgaacctatggaagccagtgattggttgcgcacagtcgagaagaagctggggttgattcagtgcacagaccaggagcgggttgtcttcgcaactcatcagttggttggactggcttcagaatggtgggatagctacgaagcatcacggccagaaggacataccatcacctgggacgagttttcatctgtattcaagagatcccatgttcccgcaggaatgatcacactgagaaaacgagagttccgctacctgaagcaagaagatttgaccgtcacagagtacctgcacgagttccatcgtttggctcactatgcaccagaagatgtggaaaatgatgaagacaaacaagagaagtatctccaggggttaaaagatgagatcgcagtgcaactactcctagaggaatatgaagattttgagaaacttgtggacaaagccatacaactcgaaagtgagcataatcggatgaagaactgtaagagaaggattgtcagcatcccagtattcccatgtggtaaccaaagacagcgcacggagccacttcagatcaccggatcttctgttgcgcatcaagagtttccgccccaagaagatggacacaatgcagacaacaacattagcaatactaatgatgatgataccaccaacaaccatgcttcttgccccattagtgaccactcaaatcaagcgtgcaatgtcaacatcattcaccaaggtgtcgacgatagtatcaatgatggcacccaaaa

SEQ ID NO: 16114 - DNA, 2495 bp, Oryza sativa
acctttccttttaggcagtgcttagtattcatgtaatgagggagaaatgtgtaatacagacaagttctatgaggattcttttggaagatgcggatatgtgattatgtgtataattgcttgctgataaaggagacctagggtctcatttcagaggaactatgttcgaaccttgagttaataaccaacctgatgatggaaaagaaaatcaagtgattaaccaaagagacatatgtttggactaagtgtttcagatgtgtcttctttggatcaaaggcaacaatcgtcagtctagcttttgacgaactacttcaaggtttctctgaaagacagcacgcccaaggacctcattgccccagaagcatcctcaacacccggagcgaagagtacctggttgagaaaggtcgaaaggtgattaatggaagagatcggaaaagatgtttggttactgggaaaagaagtaggacgaaaggtgattgataaaggataacgagaaccatgatttgtgtcactcgaggaagactcccgatagcaatcaaccctacaacagttgccctgtcattaaagtaggtgaattcacgagtaagagagatgaccacaggtagaagtacttctatggggacaaggatggaaacttttgtgacatgaccaagaagtcaagaagtaaaaccggaacagtggaatctaaagctcggttcaaccttgggctttgtatcagatgctactagaataaaagcacttgcactagtatcgttcaacgcactttcctagcaatcgatccatcgagaaagaacacatcaaggctgaaggtgtaaaggaatacgttgaatgctaaatgatgacaacatgaagagaatagtggaaagtaaactgaacataaagaaagtgaatccgagttgcttgttcgtgagagctattcccagttatgaatcaagtgatatgttcgaagataatctacagaggtcagattaaaatcacatctaacaacgaagcctcagatttggcaggataatgattagacaataacaaatccagcagtaaagccatttgggaagacgtcaaagtatgtcaagtgggataagttggttctcttgggaagcataattcaaaggcaaagttatcgacccttgcatcaaatagcagaagtagctatcacccggagaccaggaaagctaatatgaggcagttggtggcaggttagaagtaaatgacaagcatgatattcttatgatgacaaacatggtatcctagtaatgacaagctagtgttgacgcatgacatgaagtggtaacttgtatgaggttgactccgaagatatgaatcatgagaagttctggaacggaagcatcattaaactaccgcaacctagtctgagtcagctaaaaggtgcaccctggttcaagtcaggtgaagagaagattccatccgcaacagaaggtcaagccaagcagttccgagtggtgaagttttgctgaaagtttgtgaagacggagcggaagaagtcaaacaagaagagaagactgcccaacctatcttcttgctagcctcctcgaatctcggggacgagattcttgtaaggggggtggatttgtcacgtcctgataaattcatcccgaaataaaaatcattttctaaaaggaataatataattaattaaaattcgaaaagaaattggcaaacactaaaatacgtacaagaaaaattcaaaggtggcccggagaatttttgttaaattctccttggtctaaaaagagccctcaaattttagtggaattttcagagcacaaataataattattaagaaataaacaaagttaaaatgattttataaaacgaaaagctctaaaaagtcctttttccccctcctccccctcttggaccggctcggcccatccctccccctctctctcctcttccccgcggcccattcggccctctctccgcgcgcgcgccgctgacgggcgggcccgcccgccaccctcgctgacgggtggggcccacctgtcatccctgtcctcccgccgctcccgccgcctcgcccgcgccctagcgccgccgccgtcgccgaatccgccgcatcccgtcgtccccgcgtgcaatcaataggggggaattattccccgtgattccctctctctttccccccatttttccctccctctctccctcggattcgtttggaaacctctcccctaacctcgccggcgccatcaatggcggccggatcttccgcgccgtttccccctcgtccggccgctctgtccccctcccgaccctatataaaccctccccgtgcctccctccaccgttttcgccactcgccgctctctctccccgccggaatcgagctcgcgccgtcgccctctctctccgtcgtcgccgccgagctccggtccgccgccgttgtcgccccggaccacctttcccctcggcgccgcctccttccgcttcgccgaatccccggcgaccttgtccacccgtccgtttcgctcgccgac

SEQ ID NO: 16115 - DNA, 11831 bp, Oryza sativa
tgacctattattgtgtattgttattataccctgttcaccctagattaacaaaaccccaactagtggacactctactcatggtcccactagtatgattttaggtagatgcttcgctggttaattaggcaacattaggtggttttacaactctagactttgggaatattcatatcacctggatactttggaatggttggtttattgtggaattggattgacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtttatggctaggatgggttggaaactatgtcatgtcttccgtccgtataccgtggtggtatgtggcacgtggttacacgtgaggaagatgtgtcttgtgggtaaagatgtacacctctgatcagagtataatctattcgaatagctgcgccctcggttatgggcaagccaagcaatgtacccaagttagtgttttaattcttaaaatttgctcaacaacgaaaatgtggaatggttggcctgggttggcttgggacgagctgggacccagggtcgggttgccagttcggtctgaatcatcgtaggccttgggttaaggcaggttcgtgcaggttcacgaccttgattgataatactgtgtagctctaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttacaccccagttgagcgcctgtgaagatgaagccgtaggaccgctagtccgctgctgtttatttttgattgtcaggccttaagtgcctttgtaataatgtaaatattatcgatataataaagatgtgtcttttatatcatgtttgtatggtgtaccccggcttttcctgggacagggattaatacactagcgttcgggaaaatgcaagtttctcggtcgcgacatttcccaacccagaagaggagcccctggatgatgaaggctttggtgtctagctcgtgcctgccgtcaagcgcctgtggtcgtcgccctagtcttacgctgtttctcgtttgtctttgtgtgtgctgggccttcgtcgcccatgtaataaattatctatttacgcttccgcttgttaaactctgaattgtatcaactcttggtgtaccttgcctcctgggacaaggaataatacacgcacgaaaggaacgcccgttgggttaattccggtcgtgacaagttggtatcagagcccccttgaccctaggatgagccgtagatcccaagccttagcaatattatcaaaaataaaaatcctttgctatttgtgaaaactctctagtctctctctgtcctgctgcttcatttatcgccaaaatctgacttttaaatgttgcttttctttttgtttttgtttgtagatggccggcagcgtcagtcgtcgtggtctggacatgactggtttcgtcttggagctgcggggtatgtgcgttgtcctggggtatccgcatggactggactaccagggcaggccgcttccggagcaggagggtgacgatgcagagccccacgcttcttgggaggttactgcagtgatcctcactggctcacccgagcggacttcgttggcagtcaccgcgggtggagattctttctccgccgcttgccagagcgccgctctcctcgccatcggcactcttcaccagcgctacccggacgagctgcagcactcgccctaccgctaccaccctcgtcgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacctgaagatcctagagctgcgtcaggagaatctgcagctgaagaaggacctagacgcagtggaggcacagctgcatcagctcaagatcgcccagggagaggtctgtcaccccaagcgtcgccgcgtctgccgcagccagaagatcaccgcccgaaagagcacctccaggcccgagcttgttcgtcagtccctggcgtggacttgcttcgtggagacccctcgtgccgagcccgcgcccgtggttcctcaggagggggaagcctccggcgtcggtagcacggaggatgcgctgttgctcaccttccgtcctggcccgtcgcagcggtagacgagcagttagtaggcttgcgcgtgtgttctttctcgtttgtcttcttgttgggatcttgtggggcatggttatgccggtgtgtggcataactgtgtcggagcctgtctttattttatttgcttaagcaacttgaactttaatgaaccaatttaatagcagtaataaattcaagagttatggtagtcgtggatggttagctttaattgtcagctctctctgtttgctggttctgtgtggggttttcagatggtgacgaccaggagaaatgctgccaccagtgatggcaaccaacttgaaggcagcaaccacaacaaccatggcagcccacctccacctcctccaccgcctccaccaccaccaccagacaccaacgccattctcacccaaatcctcacccagcaggccaacatgatggctgctttcctccaccacatccaaaatccgccacaacataatgctccaccaccacccccacaacactctaaactcgccgagttcctacgcatccgtccacctaccttctctagctccaacaaccccgtggatgtgttggattggttgcatgccgtggggaaaaagctagacactgtgcagtgcagcgatgaggagaaagtcgtcttcgccgcccaccaactgcagggacccgcatctctatggtgggatcatttccaggctacgcagccagaggggcagcctattacttgggcccgcttcaccgccgccttccggaggacccatgtgcccgccggagtcatggcccttaagaaaagggagttccgagagttgaagcaaggcaaccgctccgtgatggagtatttgcatgagtttaacaacttggcccggtacgccccggaggatgtgcgggaagatgaggagaagcaagagaagttcttggcaggaatggacccggagctgtctgtccgtctagtctccggtgactatccggatttccaacgtctggtggacaaaagcatccgcttggaagccaagcacaaggaactggagtcgcacaagcgtcgcttggcgaatttccgcaaccaacagggtgctaaccaaaggatccgctacaccaatccctatccagggggatcttcctcgcagcagcagcaacctcgctccgcgcctcgacctcaattcgtggtgcgcgtcccacagccgcagcaacagcagagccagcaagggacccatgcgccccgtcctcctacgccagccgcgcagtctggtcaaggccgcagggacgttcaaggtccgcagcgtctgtgcttcaactgcttcgagcccgggcactttgcggataaatgcccgaagtcgaggcgccagcaaggccaagcgcctccagacgtcatcgttggtacgttcctcatccattccatccctgctaccattttgttcgactctggagcttcccactcgtttatatctgtgccattcgtggggagaaatcagttgggggtagaaaggcttaggaaccctctactcatcaccacccctggaggggttatgacagcaaagtattatagtcctgccgtccctatagaaattcaggggattccttttccctcggatctgattcttctagacaccaagaacttggatgtgatccttgggatgaattggttggctcaattccaaggagtagtggattgtgcaagacgcactgtcactctgtaccgagggccgaaacaaccggttgttttctttgcacccccaacctctgtcagtagttcagaacttcatcagataggactgtcagaaatccccattgtcagagagttcggagacgtgtttccggaagaactacccggtatgccgcccaagcgagagattgagttccggatagatcttgctccaggaaccactcctctgtacaagcgaccctaccgtatggcagcaaatgaactggccgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccacggtattctccaagattgatcttcgttctggatatcaccagttgcgcatccgtgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgttgtggttttcattgatgacattctggtatactcacaatcagaggaagaccatcagcaccatctccgtctggtgttgggaaagttgcgggaacatcaattgtacgccaaacttagcaagtgtgagttctggttgtccgaagtcaaattcttagggcacgtgatatccgctaaaggagttgctgtggatcccgaaacagtgaccgccgtcaccgattggaagcaacccaagacagtcactcaaattcgcagtttcttaggtttggcaggatactaccggaggttcatcgagaacttctccaaaatcgctcgacccatgacacagttgttgaagaaagaggagaaatttgtgtggagcccgcaatgcgagaaggcgttcaaaactctcaaagaaaagctggtttcctcactagtgttaatcttgccggatactcgcaaggacttcatggtgtattgtgacgcttcgcgccaaggattggggtgcgtgctcatgcaggacggtcatgtggtggcctatgcctcacgctagctacggcctcatgaaggcaactaccctacccatgatttggagttacccgcggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggtcgccgatgctcaaagtcgaaaaagccattgcaacactcttaacgtccgtggcattccacccgaacttaatcaacagatggaagccctgaatctaagcatagtgggtcgcggattcttggctgcgttggaagccaagcccaccttgctcgatcaaatccgcgaggctcagaagaacgatccggacatgcatggactcctcaagaatatgaaacaaggtaaagccgctggtttcacagaggatgaacacggaaccctatggaacggaaatcgggtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcctaagaaaattgtatccgataggggaagctaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccttatgaagcgttgtatgggcgcaaatgccggacaccgctattgtgggaccaagttggggaaagccaagtgttcgggaccgatatcctgagagaagctgaagctaaagtcagaaccattcgggataatctaaaggtggcccagtctcggcagaagagttatgcagacaaccgacgccgtgacctggaattcgcagtggatgactttgtgtatcttcgggtcacgcccttgcgaggtgtacacaggtttcagacaaaggggaagctcgcacctcggtttgtgggtcctttccgtatcattgctcggcgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacctacgtggagaggccagtgaaaatcctggacaccatggagcgaaagaccaggaaccgggtaatccgtttttgcaaggtccaatggagcaaccacgccgaggaagaagctacttgggagcgtgaagacgagctgaaggcagcccatcccgatctcttcgtcagttcttccgaatctcggggtcgagattccgtttaagggggggtaggtttgtcgcgtcccaaaatgactctaaaatacatcctcgaaattatgcctagaataattaaaatccttgtgaaagcctcccacaattaagatgtgcaaagttaaaagtcaaataagacttggaggatttttgtatatttcctaaaagcctaaaatgcgtaaataaattttagtggaattttcagagcacaaataataattattaagaaataaacaaagttaaaatgattttataaaaagaaaaatcctaaaaagtctttccccccctccccctcttgagccggctcggcccatctccttccctctctctcctcctccccgcggcccattcggcctcctccccgcgcgcgcgccgctgacgggcgggcccgcccgccaccctcgctgacgggtggggcccacccgtcatccccttcctcccgccgctcccgccgcctcgcccgtgccctagcgccgccgccgccgcaaatcccgccgctcccgtccgccccgcgtgcaatcaagaggggggaaatattccccgtgattccctccctctttccccccattttttccctccctctctccctcggattcgttcggaatctttccccctaaacctcgccggcgcatcaatggcggccggatcttccgcgcccgtttccccctcatccggccgccctctctcactcccaaccctatataaacactccccgtgcctccctccaccgtttccgccactcgctgctctctctctccgccggaatcgagctcgcgccatcgctctctctctccgccgtcaccgccgagctccagtccgccgccgtcgtcgccccggaccttctcccgcttcggcgccgcctccttcggtttcgccgcaacctcgccgacctcgtccacccctccgtttcgctcgccgaccgccggaacgccgccgtccccgtctacccgagccgcgccgccaccttcctccgctccggtcgccgttcccgtcgtcgccgtcgacccggggtgagctgtggaccgccgattcgtttcccccttccctcccctctctcgggcgccgctccgccgcgccggtggtcgccggcggcgaccatcggggcgcgggtgcgccccctcccgtcggctgtgccggcgtggccgccttcgggcgcgccccgcggctgccatgtggggcccggccgtcagccgcccgcgccctcgggtgcggctgacgcgtgggacccacggcgccggccggtgtgagccgggtgcacccggtccaccgtagaccgtgaggctgccgcgtgggccccactcccatggacccggtccgcgcgcccctcccctcggctgacgcaataaatccaaattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattgttattgttattatttccttgttcaccctagattaaacaaaaccccaactagtggacactctactcatggtaccactagtatgatgttaggtagatgcttcgctatttaattaggtaacattaggcggttttacaactctagactttgggatattcatatcacctggacactttggaattgttggagtattgtggaattagattcacaccgccccctctattcaaaatccccaaaatggttttaggctgtgcttggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcgtggcacagggccggtgtcctgctgctaggggctcagtcctgcctgcctgtcccgggggttccggccgtaggtgggattgggtcgatactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagtgggacccagggtcgggttgccggttcggtctgaatcatcgtaggcctggggttaaggcaggtttgtgtgggttcacggccttgataaataatattgcatagttctagaatcgtgtttacaaaatagctttgagcaactaagcatctttaaatgctgtttactgcaaccctaaccctttatattataactcccttgtactcccttgcatttattatgcacttgtgggtgtgtcttgttgagtacggtggttgtactcagtcttgctcaatttttcccaacccagaagaggagcccctggatgatgaaggctttggtgtctagctcgtgcctgccgtcaagtgcctgttgtcgtcgccctagtcttccgctgtttctcgtttgtctttgtgtgtgctgggccttcgtcgcccatgtaataaattatctatttacgcttccgcttgttaaactttgaattgtatcaactcttggtgtaccttgcctcctgggacaaggaataatacacgcacgaaaggaacgcccggtgggttaattccggtcatgacaggaactctcctagatggttatagatgtcgcaacgaatgaaccggcacaagtccgcgcacaagttgataagcgttttctgatcgaatcggcttgcattataatggatgctcgggagctatggaaagtaaaagacaaatgatttgtgttacaatcgacttaaatgaaatatttgcaacatctaaggagcaagatgacttacatttgtaaactcagttctgtatctcccgcagaccattatttgcaatatcgaagggtcattcacatagaaaacctgagcaacacactcaacaagaaaccacggatcatccttgtgtcctagcttgctacgatccacaatcatcaggccgtagttatcgatggatacgcctgttgtgtctctgacccattagcatcgtagcactgggatcggtatgtttaggccatagtcaagctcccaaatgtcttgtatgatcacatagcaagacttcttcttacctgatgcgtcaaacgcctccacccgaactccgctattctaagctgtgcttttcttgtccttgaacatcgtgtaaaacctatatccgccgatgtcgtatccttgccatgaggtcacaaggctagttgggccatttgctagcctgcgcaaagtttttcctccagcgattcacccaacggcagatctttctccttcaaccattcaggaaatttccgtttctattcttaacatatccaaatggccattcttctagggttgcaggctcttatcttgttcatgtgttcctgaatgtacggctcgacgatggcgaactattgcaaaacgctgctatgtgcttccgctacatctttgaagtcctcatcataaaaccttttctttcctatgatccccgtcccgactaaccggcccttgtgtaaaggggggttacaccgatcgattcggcgtccttcatgtaatcaatgcagcattctaccacctcctcagttgtgtacccctctatcattgatacctccggatgagctcggttacggacataccctttcaggacggacatgtacctctcgtacgctcacatctggtgtaggtacaggggaccaatctcgaaaatttgaggtacgatgtggataatcagatgctccatcatgttaaagtaagctggagggaaaaacatctcaagctggcacgctgtctcgattgcaaatttttggaggggtcctaactcttcaggatcaaaaaccttctgtgatactcgattgaaaaagtagcacaacttggttatcactaaccgagtgtgaactggcttgaccgctcttatagcaatcggcaggaagactgttaacatcttgtgacaat

SEQ ID NO: 16116 - DNA, 2285 bp, Oryza sativa
agtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtttatggctaggatgggttggaaactatgtcatgtcttccgtccgtataccgtggtggtatgtggcacgtggttacacgtgaggaagatgtgtcttgtgggtaaagatgtacacctctgatcagggtataatctattcgaatagctgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcatgtgggttcacggccttgattaataatattgcatagttctagaatcgtgtttacaaaatagctttgagcaactaagcatctttaaatgctgtttactgcaaccctaaccctttatattataactcccttgtactcccttgtatttattatgcacttgtgggtgtgtcttgttgagtacggtggttgtactcagtcttgctcaattttttcccaacacagaagaggagcccctggatgatgaaggctttggtgtctagctcgtgcctgccgtcaagtgcctgtggtcgtcgccctagtcttccgctgtttctcgtttgtctttgtgtgtgctgggccttcgtcgcccatgtaataaattatctatttacgcttccgcttgttaaactctgaattgtatcaactcttggtgtaccttgcctcctgggacaaggaataatacacgcacgaaaggaacgcccgttgggttaattccggtcgtgacaagaaccgccgaagatgtgtgtgacgtcgaggtcatagtccgggaatgtggagtcgaagtcaggagtggctgcttcggtattcgcttcgacaaccgcatactcgcttccccttctcgattcctatatgtcgcgcaagctccttcttgaagacgtgacaatcctccaaggagtggtcgttcattttgtgtatagggcaacattgttttcgtgagtcatcgttttgggggtttggacgcttgggtgggtctgtttgatcagtagcgagaacctctcccgaagatttgcgcttcccactcttatgacttctcctcttgcttgattccagtgcgtctttattggctggcttcttcttttcgcctgtcttgctctttcattcttttcgtctaaaggcatcgtctgcatgagcgcatctgtcgataatttcaaacagcttgcgagcagacataatccatcgtgtcgccagttcctaggtgatgtaacgatctcagacgctcgacttgaatgcgtggataacagaagcatcggtgatttcggggatcgtattcctgtactcattgaaacaccggatatagtccctcaatgattcacctgggttctgagttagagcgtgcaggtcgtcctcgattgcgtgacgcttgtatgtcccttggaaattggtgatgaattgctgccacaagtgatgaggacacaactagctcagatataaccatgactaccttatgtattaatcaaccaaaggtgcatatattctctattagatttatttgttatatatttgaacaacattgctacacaatgagtttcgtgtgttttcgtttgcagaggtacttgcttgggcgaaagaaaagggaccaagcgtaaggaatatatggatgattaaaaaagttgattggggaccaaaccaagatcttctccaagtccacttacatctcaccatgtcacttttggtccatatatagaagataagagataaagttctacacgttttggattcggattcgggccttttgacagcaccaacttcaaacggacctagccactgatcgagaaggaattttggggcccattagacttgttggaaagcatatggagtctactttcagatggttttggtcccacgtcaaaattccaaccgagctgccgggaatctgcaaaacaagcaacgtatctcatccagtccgaatctgatttgtgttttgggccttgtaattgtgtcgtggccttagcccaagggggtgtgcgccctacggcaacccta

SEQ ID NO: 16117 - DNA, 518 bp, Oryza sativa
cttgcaccccctccacgggggtcccttttataccgtggatcatcttgatctccaagtaagacttggagacatcggatcccgtacaacacaatagaagctgtatcccctccgtgtaggactttgtaaatcacccggcccgtagagatattttctataattcgtaacagattcctacaacgcatacggaaacaacctgtgtacgtaaaggtataccatactcgtatattctataagtcgtaggataggagactttcataggtcataaactgccctcacagaccaacacatgtcttttctgcaacactttgtcctcactcgtgtgcacccggaaagaatttctcggtcggccacccatcccaaattgctccaggccaagcacgcttaaccctagagttctttggagattggcttcccgaaaagaagttgcaacttgttgatataagcattccattaatcttattaagccctaggccgggatgttacattacatatatatttttttttttcaaaaaacctgg

SEQ ID NO: 16118 - DNA, 4525 bp, Oryza sativa
tttactgcaaccctaaccctttatattataactcccttgtactcccttgcatttattatgcacttgtgggtgtgtcttgttgagtacggtggttgtactcagtcttgctcaatttttcccaacctagaagaggagcccctggatgatgaaggctttggtgtctagctcgtgcctgccgtcaagtgcctgtggtcgtcgccctagtcttccgctgtttctcgtttgtctttgtgtgtgctgggccttcgtcgcccatgtaataaattatctatttacgcttccgcttgttaaactctgaattgtatcaactcttggtgtaccttgcctcctgggacaaggaataatacacgcacgaaaggaacgcccgttgggttaattccggtcatgacaggaactctcctagatggttatagatgtcgcaacgaatgaaccggcacaagtccgcgcacaagttgataagcgttttctgatcgaatcggcttgcattataatggatgctcgggagctatggaaagtaaaagacaaatgatttgtgttacaatcgacttaaatgaaatatttgcaacatctaaggagcaagatgacttacatttgtaaactcagttctgtatctcccgcagaccattatttgcaatatcgaagggtcattcacatagaaaacctgagcaacacactcaacaagaaaccacggatcatccttgtgtcctagcttgctacgatccacaatcatcaggccgtagttatcgatggatacgcctgttgtgtctctgacccattagcatcgtagcactgggatcggtatgtttaggccatagtcaagctcccaaatgtcttgtatgatcacatagcaagacttcttcttacctgatgcgtcaaacgcctccacccgaactccgctattctaagctgtgcttttcttgtccttgaacatcgtgtaaaacctatatccgccgatgtcgtatccttgccatgaggtcacaaggctagttgggccatttgctagcctgcgcaaagtttttcctccagcgattcacccaacggcagatctttctccttcaaccattcaggaaatttccgtttctattcttaacatatccaaatggccattcttctagggttgcaggctcttatcttgttcatgtgttcctgaatgtacggctcgacgatggcgaactattgcaaaacgctgctatgtgcttccgctacatctttgaagtcctcatcataaaaccttttctttcctatgatccccgtcccgactaaccggcccttgtgtaaaggggggttacaccgatcgattcggcgtccttcatgtaatcaatgcagcattctaccacctcctcagttgtgtacccctctatcattgatacctccggatgagctcggttacggacataccctttcaggacggacatgtacctctcgtacgctcacatctggtgtaggtacaggggaccaatctcgaaaatttgaggtacgatgtggataatcagatgctccatcatgttaaagtaagctggagggaaaaacatctcaagctggcacgctgtctcgattgcaaatttttggaggggtcctaactcttcaggatcaaaaaccttctgtgatactcgattgaaaaagtagcacaacttggttatcactaaccgagtgtgaactggcttgaccgctcttatagcaatcggcaggaagactgttaacatcttgtgacaatcatgagcattatacccagagatggtcaaatctttcaaagatacaagttttctgacgttcgctgagaaaccagtcgggactttcacactatgcaagcatctacataatttttttttctcttctggtgttagtgagtagcaagccggaggaatatcgatcttcccatttggcagctcttttgggtgaagctcatgccttatgtccaaattgacgaggtcggtccaggacatcaacccatctttcgtcttactcaggatgtccagtaaagtgccaatggtgctatcaaacacattcttctcaaggtgcattacgtcgatggcatgacgaacctccaggtctttccagtaattcagatacctgaaaaatattgagtgcttcttaaaaggtaagttactttcctctacaggtgcatcagtattttcctgatccgtccgtttcttcctcttgatgggcttcttctttggcttgccgaacacaaccttaatatcttttgtcagctcgaagacagagccaccagttcgtgtgtccggagctagatcgttctctactgtattgtcgaataatctggccttcacatggcacctatgcctctgaggtaagaaccgacgatgacgcatgtacacacccttggttgacgaggtgaggtacttgtacgacatcttgtcgatacatatgagacatctgaacttttccttaaactggcccgagagcgaaaagtttgccggtaagtcgttgatcgtaacgaatatgatggcatgcagagtaaaatgttccctacggtacttgtcccacattcataacccttcctcccacagttcttgcatgtcctccatcaatggttccagaaacacatctatgttaatcccaggctgtcttggaccttgtataaggatagacaaaagaatatactttcgcttctggcaaatccatgtaggcaagttgtacacggttagcagcactggccaggtgctgtgtgtgctgcttaagtcaccgaacgggttcattccgtccgtgctcaatgcaaaccttacatttctcgggtcctttgcaaattccaggtgtagtgcttcaaagtttttccacagtcgagcatcggcagggtgtcgaatcttaccgtcatttttcttaccctcctagtgccatcccatcaacttggcatcatcacggttggaatatagccgctttaggcgatctttcactggtaggtaccacaccaccatcctaggaatcttttttttctcatccaccggtgcatcatctttgtcgaccacctctccatcggaggctccgttacccgtcttgtaccgactcgtcccacatgttgggcaagagtctaaatccgcgaatttcttgctgtacagtatgcaataattttcacatgaatggatcttctgaacacctaaagaaaatggacatatcaatttctacacttgatatgtgttcgttggtagcaggttcggcttaagaagcataactctcaaaagatccatcaaatcattgaagctagtgtccgacaattcatttctggccttcaatctgagaagttcaagcaccgagcgcagcatcgaatagtccttgtcgcatcctttcgcttcgtcatacagaaggtccttcgctgctttctccaacgcttcccaattgtccaaccctcatcttctaccagttaggacctctggttcaacgtgccacaacatatcttccagatcaaattcaatgccttcattctctatatgtcacgaccggaaataacccaacgggcgttccttatgtgcatgtattattccttgtcccaggaggcaaggaacaccaaaagttgatacatttcagagtttatcaagcggaagcgtaaatagttactttattacatgggcggcgaaggcccagcacacacaaagacaaacgggaaacagcggaagactagggcgacgaccacaggcgcttgacggcaggcacgagctagacgccaaagcctacatcttccaggaactcctcttctgggtttgggaaaaattgagcaagactgaatacaaccaccgtagtcaacaagacacacgcataagtgcagaataaatgcaagggagtacaagggggtcataatataaagggttagggtttgcagtaaacagcattaaaagtcacttagttgctcaaagctactttgtaaacacggtcctagagctatacaagattattaatcaaggccgtgaacccacatgaacctgccttaacccaaggcctacgatgattcagaccgaactggcaacccgaccctgggtcccagctcgtcccaagccaacccaggccaaccattccacattttagttgttaagcaggttttaagaattaaaaacactaacttgggtacattgctcggcttgcccataaccgagggcgcagctattcgaatagattataccctgatcagaggtgtacatctttacccacaagacacatcttcctcacgtgtaaccacgtgccacataccaccacggtatacggacggaagacatgacatagtttccaacccatcctagccataaacaagagtaccgacccaaccccacctacggccggaacccccgggacaggtaggcaggactgagcccctagcagcagacaccggccctgtgccatgacatctcgactaccgggccgcagctcgtgtagcccttatttgccctagagatgttcatcgacccccgacttcgtacatctccataccggtacttttggttataaccaaactgagccacaaactaagccttacccactaaacatgtcgaagtacggtagtgctttgcaacataagccc

SEQ ID NO: 16119 - DNA, 14470 bp, Oryza sativa
ggagtctgatatggaacttgttataaaagttagccgatatagcggaacgacgactaaccttcctgatcgcttcaatcattgatcacccaagacacgccagatgacgacacaggaacacacgatatttgttaatgaggttcagctgaagcctacatccccggggctctgattatgggcgctcctccccaaccaatatagctcctagccgctacgagtccatggccacactgccatcatatccctgcatgtctacactacattgtagtcgccatggttacattgtggtgcccccctctctatttaagagagttgccgggttacagagtccgactctaactccaccccctaacacctattacaactccaagcccaactgtaaccaaataggactagtatattcgacacctattctaacaaactccaccttggcgaatatacgccacctagaaatagtagaatcaccatgccgatccacctgtcctccagacttgggttgtcttcttttgcagcttcaccgcaagccgcaagacgagtctgcgccagacccgccgccaccaaaaacaattgctatcccagcaaccgcttcctcctggactccacctacaacagtgcaccctcgcagcttgtaaagatgcgactccaccttctctccagtcatcacagtcatcttgcccttcatgatctccatggtcttcctattccgattaccgcggaatattaacccttcttcatgcaaggtttcaagcgaaatcagattcctcttttgccctggtacatgcctgactccctgaagaacatgttcacctccatcttctagcttgattttgacttcacctactcccacggccggataacttgtgtcatcgcctaagtagacaaaaccaaactcaccagacttgtatgaagagaaccactccttccttggcgtcacatgaaacgagctagctgaatctaatatccacgcttctgcatccttagactgtgcacttgacatcgtgagaagatcacaaccatcgctatctgagtcatttgaagaagtcactgtattagcctttgcttttcccttcagtgttggacactccctgcttatatgcccccactcatcacatctgaagcactgcaccatcttcttctttttgttcttctttaccttatgcccagcatgatcttctttgactagcaaaccctccgcttgagatgtttcaccctctttgttctttctcatctgatcacgagccagcaacgcagaagtgatatctttagttttgatggtctccttgccgtacgtcaaagtagtcaccacatgctcatacgattcaggtaaagaacacaaaaaaactatggccttgtcttcatcgtcaacttccacatccatcttcacaagatctgtgactagttgattgaaaacgttcacatgtactgtcagatccgccccttcctgcatctttagcccatacaacttctacttcagatacagtttattggttagaatcttggacataaactgagcttccaacttttcccaaattatctttggtgaggtctccaccatcacatggtacatgacctgatctgagagacatagccttattgtcgcagccgcctgcaactgcatctcctcccaatcgtcatcctccatcttggccggtttgacacccttcaaagcctttgaacctccttgttgagctaacaaatctttgaccctagtctaccacaagccaaaatttccggagccgtcaaacttcaccaaatcaaatttcatacctgtcggcgccatcttgccaacccacgacctgactggtctgtcgccaccagaatactcgccctgctcagaaccgtctgtattcgtcttcacaatcccgtcttgtgatccgatctcagacattcaatagcaaaccgtgttcgctataatccgatgtgaccaatcttccaccctcgatgtgcctctactccgcatgatctcgtcggcctggcttggtcgacccatacgcgcgcactttgtcacgagcctctgcacagcaagcctattgagccccttgtaccatgtttgaccaatgtcctgccgagccgcccaaaaatcgctgccgctttgttgctttggttcggctctctcttcggctgcctatttaaagggcaagcaatacgagtctgatgcgatcacgagtccatatccatacataactctgaatccgactccatagcaactgcggtcgagtcggccttgtccgactccgacaagtcattttatcatccaactcctctactcgatttcttttttggctcatcaatctgtcagactcccacggtacaaaagtttccatatgtatgaagcattagtactcaagggcgtgcctacgttatactacccggtgtcataggacaccgggtagattattcaaatcctatataaattacactatattaattaatatattagtcaataattagataattagtatgtattggacccccggtaatttttgttctgggttcgccactgttggtactgctgccccttgatcccttgtgcacgcacgatatgcatgccctgcatgctcatgttcacgtgaatatgctcaagccatgcacgagttccaaagctgcagcttccctgcccttgtttgcatgcaattgctcgatttggttttgcttcttgcctttgctcgttagtctttgcacgccatacgtataagacagcacctgtgctatctgtccgtgcctatgcacgcaccgcagtcgcagccctcgtgttcaccgtccatgaccccgtcgtcccggccctccacgtccgccgcgccgcgccacgctcgccggtttcgccctttcatcactggcctcctgccgccgcggatccgcgatcaccacgtgcgtcgggcgcgccgtccatggcgctacccctcagatctctccagtcgccttcggccacgcccggccccgtcttccggtcattttccgccatcgccggtctgatcgcgagcgaggtcaccgcctccgcaacatcctcgttgtcgccatcgatctcatcgccacggctgacgatctcatgtcgatgcgtgatccccacctcgtgtttcctcctccacatgtcttcttgatctaatgctgaaaccttctgctctgataccacttgttataaaagttagccgatatagcggaacgacgactaaccttcccgatcgcttcaatcattgatcacccaagacacgccagatgacgacacaggaacacacgatatttgttaacaaggttcagctgaagcctacatccccggggctctgattatgggtgctcctcctcaaccaatatagctcctagccactacgagtccatggccacgctgtcatcatctccctgcgtgtctacgctacattgtagtcgccatggttatattgtggtgcccccctctctatttaagagagttgccgggttacagagtccgactctaactccaccccctaacaccttgtcggtgacatggggccgagggtatcgtgactagaggcttgggtagccgcggtcacccacgtgccctgacccccacgggggggggtcgggcccgagggtgacgtggccacccctccctctgtctccccgaggggtcgggccgctcccgcttcggccccgagggctggggcgccccgaccccctgtggttttggcaccacgtgtgtgggttaggtgagcacagcggcgctcacctaaccgcacttatagcggattgacgagcgcgtcacgccgcatttaatgcggcgcagtgcgcgcttatccggtccgtgaccagtcgcagtgtgtgaccggtcacagaccggtcagatcgcgggttaggtggcaacaggcggcctgtcacacgcctcgccccgtcacgtcgaaatgatgatagcctctaggcactcgtccctagccggagccggcgtgctagctcctggagtgggtatgtcagtcccggccagattcataccaggcttcatcgcaaccattacaaggaagtcattgtatgaagaagggcagacgtgtggcatgctaaactgacacgtggtagacaagaatgactggtttgtgactggtctgacgccggtcacgtcatcggcagacaaccgtgctcccacattgcatctgcttccggcggagtggaggtaggtatgacccatcccatcggagggtcattcggacagcggccattgcaaatctccacccattaatgaaggaatgacagggctatcccctgtgtcaggcgagtgacggcgcaaggcctcactcaaggacaagctgtgatttagcttccaggcgaaggcgcgagccaagttttggtcaagatagggtgggttcccatccaaaagaagagtaggtaaaaatggtgcatgtggtatccccttgagatataaaaggaggaccttgcccaccgaagcaaggggacgagaaaaaaaagggagagactctcagacgactctgagaatacctgagctcgtagaggagagaaagaagaagagtggttctagagcctgaactctcttgctctccggctctctgtaactctttcacacacagatccaccagaacacaggagtagggtattacgcttctcagcggcccgaacctatctacatcgcccgtgtcttgtgcatttgctctctcacgaacattccacagatcgagggtgaagaacctcacttagcgcccccggccgaaccggcaaaggggggcatgcgcggtctcccggtgaggagccccacgctccgtcatctggcgcgccaggtagggggcgcgtgtgtctttctaagccctcgtcctctttcgtgtgcgccaagcttccctcgctcagcccaatggccgaacaggcagtggcgcacaacctctctccgagcgctagcggtgacgacggggagcagaacccgcgccgtcgagctcgtactccaccgtccccctctcgccgaagtcttgggcgggaggaggcgttcgaggaggtcgaaagatccgcgacttcaccgcccacgggcgatggagaaggacggcgagacggggagcgtcgcctcctcgtctacggcgatggcagcacgccccagggcgcgctccaggctgcgggcgcgctcctgcgtcccccgcccgtcgtccccgatccagagactccagcccgacgttggctggatgacgtggccaacttggtcatgacggcgcagcagcgcctaggcgccggcgggcggtcctccgccaccaaggcctctggcgctgctaccgccggctccgtgtcgtcgaggcggagggcgcggcgagcggcggccgttacccgccgttcgtccgccattccttcgtcaacgcctccgacccaagaagatgtgcgtggggggccagatgcccacctcaatatcgagcgccggcgcaatggtcgtcgtgctgcccacgcaacggagggcgcttcctcatctggagcgccacttcggtccgggcacgggggccaggcccccgtgtccccggttggcggtgccggctgtcgagcctttgtggcgagccttcgaaacgtccgttggcccctaaggttccggcctaccatcaccgaaaaatacgacggaagcgttaaccccgccgagtttctccagatctacacgactgggatcgaagccgccgggggtgacgacagggtcatggcgaatttcttccccatggccctgaaaggtcaggcgcggggttggctaatgaacttgccacccgcatcggtccactcttgggaggatttgtgccagcagttcaccatgaactccagggcacatatccgcgcccaggtgaagaagcggacttgcatgcgggacagcgaagggacgatgagtctcttcgctcgtacattcaacggttctgtcaagtccgcaacaccataccatgcatccccgcacacgcggtgatatacgcgttcaggggggcgtgcggcacaaccgcatgctcgagaagatcgcctccatggagccccagaccaccgcggagcttttttagctcgcggaccgtgtggctcgcaaggaggaggcctggacctggaactcctccggttccggtgtggcagcttcggccgcccctgggtccgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgactggcaagtggtgcactgtgcacaacacctccctccacgacctcgcggactgccgcgcagtcaaaagtttggctgagcggatgaggaagtgggaggaggagaggaggcaggagcgccgtgagggcaaggccccggcggctcccgccggcaaccggcgaggtgaggccaagcagaaggccaccgccggggacgtcgacgatggcgacgatgacctggggttccaggagcctgaggccaccgtcgccaccgtcgatgggggagcgtgcgctcacgcttctcgccggagcctcaaggccaagaagcgagagcttctggccgcggcccctacccatgaggcgacgcggcgggcgtggtggtcggaggttgccctcaccttcgaccagaccgaccacccgccgtgcgttgcccggggagtacagatcgcgatggtggttttccccactgtttgcaacgtgaagttggggcgtgtcctcatacacgggggtgcagccctcaacatcctttcccccgcagcctttgacgccatcaaggccctggggatggtgctccggccgtcccagccgatcatcgatgtgacgccggggcacacttggccgctaggtcatatcgacctcccggtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgaagatgccgggtcccggtggccccatctccgtccatggcgaccacaaagtcgcgctcgcttgtatggagcagcgcgcggaccacctcgccgcggcgtccaagcccgagggtggcgacgagaggctcagcacctccgtccctgccgccccgaggcagcggatgatcacgtgtgacgaggtcccggtcaaggaggttgccctgggcgacggcccgtccaagaccacacgaatcggtggtcttctagacgacaaataggaagacgcgctcgtctccttcctgcgggcaaacgccgatgtcttcgcctggagaccggcggacatgcccggggtccccagggaggtgattgagcaccgtctcgccgtgcggccgggcgcaaggccggtccggcagaaagtgcggcggcaggccccgaaacgtcaagccttcatccgtgaggaggtggcgcgacttctggaggccggattcatccgtgaggtcatccatccgaagtggctggcgaacccggtcgtcgttcccaaggcgaacggcaagcttcggatgtgcatcgactacaccgaccttaacaaggcatgtcctaaggacccttaccccctgcctcgcatagatcagattgtcgactccaccgcggggtgtgaccttttgtgttttctagatgcatactctggttatcatcagattcgcatggctagggaggatgaggaaaacactgcattcattacccccataggaacttattgttatatgacaatgcctttcgggttaaagaatgcaggtcctacttttcaacgtactactcgaatttctttgggtaaccaaatagaacgtaatgttgaggcgtatgttgatgacttggttgtgaagacacgcaaccaagagaccttactctcggatctagcggaaactttcgaaagtctccgctccgcccgcataaagctgaaccgcgataagtgtgtgttcggcgtgcctgcgagcaagcttctcgggttcttggtctctgcccgaggcatcgaggccaaccccgagaagatacgagctatagagcggatgcggcccccagcaagcttagggacgtgcaatgcgtcaccggctgcatgactgccctaagtcggttcatatcgaggctgggagagaaggcgctacccctatttaagctcctcaaacactccgggccgtttacctagacggaggaggctgagcgggccttcactcagttgaaggcgtacctcagttctcccccagtcctggtcgccccggagccagatgagctgttgctactctacttggcggcaaccccgcaggtggtcagcgcggcgttggtagtggagtgcgacgaggacaaccctcactccgcgcatccccaccctgtgtcgactcgacccgggagagagcagggaggagaggcccccgagccgaacagcggcccgaggcccccgacggccggagcaggccctccgcccgcttgtccgacggtgccaggcgcccccgacccccaggatggcctcggggccactgcgggaaggccgcgcctgtcgccctctgaccccgaggtcgtcggcccaaaagtcgagtgcgcccctggtggcctctcggacgaagagcgccccggagatgtggcccctggcgaagaggatcggccccgccgaaaggtgcagcggcccgtctacttcattagtgaggccctccgggacgccaagacccgataccctcaggcccagaagatgctttatgctattctgatggcctcaaggaaattgcgccattatttccaggcgcatcgggtcacggtggttacatcttaccccctcggccaaatcttgcataaccgagagggtactggacgggtggtgaaatgggcaatcgaactctctgagttcgatttgcactttgaaccacaccacgcgatcaagagccaggccctcgctgactttgtggcagagtggaccccagctcctgagcccgtctccgtccccgaggccagctcggacccctcgcagctgcctcacaccgcctactgggtgatgcagtccgacggctccctgtctcttcagggcgccggtgcgggggtcacgttgacctcgccgagcggagacgtcctcagatacatggttcgcctcgactttcgggcaaccaataatatggcggagtacgagggactccttgcgggacttagggtggcagctggactggggatccgccgcctcctggtgttaggcgactcccagctggtcgttaaccaggtctgtaaggagtaccggtgctctgacccgcagatggacgcttacgtgcgccaggtgcggcgtatgaagcgccatttcgacgggatagagcttcggcacgtgcccagacgggataacgcggtcgccgatgaactctcaaggctcgcttcctcgcgagcccagaccccaccgggcgcctttgaagaaaggcttgcccagccgtcggcgcgacccgaccccctaggggagacggatgcgcctgaacggcccccgtggcccgtcggagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctttatcggcgcgcggctaacggagtcctcctgaagtgcattcctcgggaacaaggcgtcgagcttcttgccgatgtccatgaaggcgagtgcggagcccactccgcctcacgcaccttggttggcaaggcctttcgctagggtttctattggccgacggctctcaacgatgcggtcgacctggtccggcggtgcagggcgtgccagttccacgccaggcaaacccatcagccggcccaggccctgcagaccatacctctttcgtggccgtttgttgtctgggggctcgatatcctgggtccgtttaggcgggccccgggcgggttcgagtatctgtatgtcgctgtcgacaagttcactaagtggcccgaggcttatccggtcgtcaagatcgataagcactccgcgctaaaattcatcaggggcatcactgctcggtttggggtgcctaaccatatcattacggataacggcacccagttcactagtgagctcttcggtgactactgcgaagacatgggcatcaagctctgcttcgcctcccccgcccaccccagaagcaatggccaagtgtagcgcgccaacgcggaaatcctcaaaggcctcaaaaccaagaccttcaacatcctcaagaagcacggcgactcgtggatcgaggagctgccagcagtgctctaggcaaaccgaaccacgccaagccgagcaaccggggaaacgcctttcttcctcgtctacggcgcggaggcggtcctcccatctgagctcaccctgaggtcccctcgggccaccatgtactgcgaggctgatcaagatcagcttcgcagagacgacctcgactacttggaagagcgaaggcggcgcgcggccctccgagccgcgcgctaccagcagagcctgcggcgctaccatcagcgccacgtccgagcccgatcactctgcgtcgacgacctcgtcctacgccgcgtccaaacgcgtgctggactgagcaagctctcaccaatgcgggagggtccgtatcgagtgatcggcgtcccccggccgggctccgttcggctggccacgggcgacggcacagagctgcctaacccatggaacatcgaacaccttcgtcgcttctacccctagtgggggtcgggtgtcaggtctcgggctcaggccaaccccgcacccccccgggcgtgcagggttggccgggggctaccacatgcatatacttatcttttttctcttccgtatttcaataaaagctttttcgatttcctaaggactgtgtctgtgccattgtttccttttgaagaatcttggcttgaattagcacgctcgtgctcgatcctgccctcggtgtcccgggccggctaaaatcgccaaaaggggcccagaaccgagccgtgccccggggcgtggtgaactccgggggggaattggcaaaggcccacaatcgggtcatccataaccctcggtcaccacgctcccggcttggacagtctcgacacgtggatctccccaggcactagccccgacccgcgccgtttgaggctgggacctgggcacgagcccttgttcaagccaagacacagaaggaccgcggcacagaccatcctcgtctcatacacacaacaaacagaattgacacagaaatttcctctttatttgattgcagattaaattagtctatacaagaagggggcccgaaggcctcggaagaggaaagaaaaaactattaagatagacgggggcctgggggctcactccgacgcgcccgggtcgccggcctcgtcgtcgctgtcgtccacaccgtcgtcaccgccctcctcgtcagagtcgagggcgaacgcgagccgaggggccgtaccctcgaagctgtggacgatgtggtcggcggcgtcccggacccgcgcgcgcgtgccgtcctcggttccgggagggaactcttccagcgttgcccacggggagaagtcagggtccctggcctggtaacttgccagtacgagctccaccgccccccgggcgagatccctcgaggatgacttgatcgtctcctcgagctcctcggggagccgcttgaggaccccggccatctctgagaggcgctgggcgaggcccccctggttggcggcgtacttcgcggttcggccgccccagagacccgcttgccgcccggcgtggtatagacgggagacggcgtcccgaagcatgccgggccccacctcgctcgccaagcggagggcctcgacctcccctgcggacgagtccagcgcgccctgcagcttggcgatggtgtgttcggcggctgcgaggagggcggctgggtcgccatggcccgcggccgccccgccgctgtgcgctctcgcgtccaactccttcgctcgctcctcgagctcagcggcacgctgatccagtgcggccctctcggcgcgggcgctttccagatcgcggcgcgcttactcctcccgcgctgccacgcggagggactgtccgccagccgctgcgccgcggcctcggcctcctcgagagctcgctcccgctcggtgagcgcgtcctcgcggaggcggagtgcggactcctcttcggcgcaggcggcctcgtgcgccgccagtgttgcctcccgggtggcgacggcggcctcgcggtccgccaggtccctctccttcgcgcgggcgcgctcctccagcaccgtggcgcgagcctcaagggcctcttcgcgctgccgggacgccgcctcgatctccgctgcccgccgttcccgggcagcgacggcgtcaaggactccccgggtggcgtcgagcttcttctctagctccgccgcccgactcccgtattggaggcggaggtcgtcccgcacctcgtcgagcacggcggtggcgatgagggcagtctcccactcctcctccacctccctggcgatctccgccaggtccctgcgacgggcctcgagctcggaagcgtgccggcggtgtgccttgcggcccgcctccaccatggcctccaccgagcgccgcccctcctcgacgcgcgcccacgccgcgtcgagctccgcccgctccgcctgcaggacctccatctgggcacttaacccgtctaacaccgtagtattcgcggcggccaaggcctgcagaaggggctctgcgctcggtggggcagcggaaggcagaggggagagccgtctcggtgagggtgccgcacggctcggcccgccgatcgacgtgccggacgcggtgtactcccaggtgccccgggcgcgccgttggagcggcgcgatccggcgacgaaggtagtcgccgaacaccatggcccccgtaagcccctgggatcgcagacccgccaggcggtcaagaatggcgtcgtagccgtctcccagatctaccgtcgcccgccagctggaggcctgcgccgggggctggctcggaagtcggaggcgcgcttcgtcggcgaggagggtgtagaaccaatcgctcttccagtcgtcccactttttgcggaggacgcagggaatgtagcggttcagcacctgcccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaaactccagaatatccatgaaaaaagaagagaatggcgggaccagccctgccattgcgaaagagaggaagaagacggaccgccccgggtagtgtggcgccgggcgtccctcacccagcgcgaccacctcccggccggtgacagattccggcatgaatcggcgcggcagcccggcctgcctctcgctcacgatgcgggaaggcggcagcacgctaccgtcgagcggtgcggagccccgtgccatgatgccggcggaggaggagcttgagagcgagtgagtgcggcaagggtagggcacaggaaacgaagagttagtgctcaagtggcgaaggcaaggggaagaatggcgagaggaaggaagcaaatctcttcctcggcgtctttatacccttgccaacgctattcccggctcctcgtttcccgcgcccactacctcgccccctggtttctcgcgcccacgcctccactaacccaactcgcccgtttgcggcacacgagacggatgtgcggccgtagcagttgagatgggacagatcaagcgcgcattaaccatgctcgccagacgcgaaaagcgccatcatcacgtctccaggcgaaacgaaccggctcgtcccgattcgcgcactgctcgagtaatgtagcggtcttaaagaggccgctcattattgtcggtcggttttcccttgccgatgcgcgcaacttgcgaccgctgggttcctgcccgcctgtagggacctgccccacctgtcaccgggcctaaggagtggcgtcacgtccgagcgcttccctcgaagggggcaatcgccctggcgtaacgccgggggctactgtcggtgacatggggccgagggtatcgtgactagaggcttgggtagccgcggtcacccacgtggcctgaccccctcgggggggtcaggcccgagggtgacgtggccacacctccctctgtctccccgaggggtcgggccgctcccgcttcggccccgagggctggggcgccccgaccccctgtggttttggcaccacgtgtgtgggttaggtgagcacagcggcgctcacctaaccgcacttatagcggattgacgagcgcgtcacgccgcatttaatgcggcgcagtgcgcg

SEQ ID NO: 16120 - DNA, 10601 bp, Oryza sativa
ccgtgctcccacattgcatctgcttccggcggagtggaggtaggtatgacccatcccatcggagggtcattcggacagcggccattgcaaatctccacccattaatgaaggaatgacagggctatcccctgtgtcaggcgagtgacggcgcaaggcctcactcaaggacaagctgtgatttagcttccaggcgaaggcgcgagccaagttttggtcaagatagggtgggttcccatccaaaagaagagtaggtaaaaatggtgcatgtggtatccccttgagatataaaaggaggaccttgcccaccgaagcaaggggacgagaaaaaaaagggagagactctcagacgactctgagaatacctgagctcgtagaggagagaaagaggaagaggggttctaaagcctgaactctcttgctctccggctctctgtaactctttcacacacagatccaccagaacacaggagtagggtattacgcttctcagcggcccgaacctatctacatcgcccgtgtcttgtgcatttgctctctcgcgaacattccacagatcgagggtgaagaacctcacttagcgcccccggccgaaccggcaaaggggggcctgcgcggtctcccggtgaggagccccacgctccgtcacacctattacagctccaagtccaactgtaaccaaataggactagtgtattcgacacctattctaacagaactagagatggagtatatggatgtacaaatcacgaagcttgacgagcaggatgcaaataatttaaatttcaccccaattttccctcgtggaatatgacattaaggaaatccattcattttattatggaaacctcccgattaatattacaagatgacctccttagagaaacgcacaacatccatcacacacttgatcaatgaacttattacaatactgaaatactgcatggaactaataaatgaagaaataaacatttcctttctgagaactaaacccaaaagctatggaatctcagcaatgatcatctagcactgtggcaagtccgatggtggtggcggtaacgatgtctcctgcgttggaccgttctgaacctcaaacaccatgccaagcccgaactctagatgagcatcgaagtggcagtgcatgaaccaaacccctgcatcaaacacacaaatgtcaaatttgatttcacaatagtcaagtcaacgaaatgatcagaagaaaagaaattctgggttgtagctagttacgggtcatcttccctatgataactaaaaacgtgcaattttagatgtcgacagtctttggaattcaccgttgactattatcaaaaacacaaactctgataaaaatcgtatattgtgacatattttcaagcaaaaattactgcaatcatctgcatatgcgtataatttaaactgtttgaatatttacattgaaagttttaacgagacattaatttggcattaccacgcgtgtgatacacttataattataattaatagtactccctctattccataatataaagttttaaaaactaatatttcactaataattataaccatatgaaagtaaattcaaattttaatctataatattattttcagcaaataaaatttagttcatattatattgattgttgatcgtgctttaaaagttgaatcttgaaccacatgtgtgtcttatatgatgggatggagagagtatatgattttgtgcaaatatatacctgggttgtctgcaacgaagcggatgacggcccagccgccggtggggacggcgacggtgttgcgctcctgcggatcgacgaggttgaacttggccgggtccgtcgtctcgttgtagttgccgaagccctgtgcgaggacgaagaagttgaagccatggaggtgcatcgggtggctctccttggacaccagcctcgtgttctgcagcaccatctgcaccgtcgagttgtacttgagcgtcttcaccttggtcgacttgaacgtgtgcttcagcgtcgcgttatcgtccgatgcgtcagcggtgtagtcgaagacgatcggcggcgtgtcggggaagtcgcgggtgtagacgccgtcgatggagcccttgtacatggcctcgagcatggaggttgtgttcgggaggatgaaggaggcgttgttcatgctcgacgcgaagatggtccctttgtcgtctggcatgcacatcgtctgctccggtccgcagaaggtgtctcccatggagacggtgacgaacatgtgggtgtcgacggcgagcggcacacggttcggcaccagcgccgtcatattggagagaaaccggtgcgcggtggccgtgtcgttgtactccggcatgtccggcaccatgggtggcgaggtcgccgggccgccgccgtactcgacgatggccgtgctgttggtcaggctgtacagaaaacttgggtcggcagcattaacggcgctgttgtacgggatgaccgccatgtagtagcgccctccgacggccgcggcgacgccggcgtccggtaccaggagcgcgtccaccgtctgccccggcgagatgaccaccacgtcggtcttgtacggcttggtgtagcacgcgtcggcggccaccacgttgaagctgtggttggccaccttgaagaagagcggcgtgttgagcgcagcgttgatgatccggagcatgtacgtcttgttctgcttcagctcgaacttgtgcgtttctgccagcaaaaaaaaacacatcaaaattcatccaagacacatctcgattgccatgaatattgcatgtgatcgatcagcaacttacggttgggggcagagcagttgtagaaatcgccgggcttgccgttgatggtgtacgcgtcggcgtggggcgccggattgccagtaacgagggagcgctgctgcaggtcgtacacgttcgtcttccaccactcaccgaggatgaccaccacctcctcatcgggcacggggaacgggtaggccttggcgccgccgcgaggtttgatgatgagcgcgccatagacggtggcgcggaggaaggaaaaatgggagtgccaccacagcgtgccctcctgcccggtgacgttgaaccggtaagtgtagttgcctccgggacggaccggacactgcgtgaccatagccggtccatccgcccatggcgtaccgcgctggaagataccatgcctgcatccaagacacaattgatgataatccttcgttcaccgtggatgaacgtagatattaattttaccgttcttgagaagataaaatattaccagtggatggtcatgttgtagggtgactcgttgaccatatgaacaaccaccgtgtcgccctcagtggcaacgatcgtcgggccggggagctgaccattcactgcagttatgatcatttcctgctggcatagctgactaatggagaggttacctacctgctcagttcaaaaatgtaagattaagacatggtttagttcgatcacctttgacaagtaacccctccttgaacacaaatgaagttctactccctccggtcaaaagaatatatttttttttcttgtgcaattttgcacccattttttttatcgtaacaactaacgagtacataaaatctaatatgttaatgtgaagaatcttgtcacaccagttttgcagtttcaaactaaaattcttaaacatattaataatagtccatatttggaaactgcaggaaatagtattaaaatttatgtatttgattccaggagagttttttttatgccatgtctacgtcttgagccaaaagccctatctcatgaattaaagataacagtgttcatgcatgttgcgatatatatgcgataaaatagaagaaaaaaaactgcatgcataaatggaagtatatgaaaactagatagaatattacattgaaagtgtactccacaacagcagcttgagcaacggaagcaaccaaagcaagcgcaaatggaagaagaagaagcgaccatgatctcgccatattatccttaactatttgtgtaccaaatggatgttcgagatggacaggtgacttcatttgattttggatgaagtaaattatggttcaagatgaactatttatagagatgttggggctgactggttcaatcatcaaggaagacaattaaacagacttgaaatttcatgcttaactacagagaaagaagacgtgcttagattcttttctgctgcttcagaagttttatttctctgcaagtaattatggaggcagttaaaaattcctatatattccttcccaagcttagctttacttgctagctagttacgcacatgcttatgttgcttttctttggaaaaggttgactaatcaatgcttctagtttagtactcatgtatgacgatagcaatatagtagaaaaaaaattgacagtttcatggttagtttggtgtggtgcagattccatatatatggtgctgatgtgatgacataattatagaaaagtatgtgcaaaacttttggccgtcgagcacatctgatatccctgacagttcttggacatctcaaacaacttcgacacaggcgatttttacgcaggagctaacccatacagtttctcatttagatgtatactccctccaaatttataattcttactgtaacacttttaatatggacatggtctccaaaacatatattaacaacgattttttaataatatataataaaagaaaaattttattttattaaagtacactgtctctacttccttcggttccgtaattacagatattttagttaaggatgagaggtgaaacaattagaattttaccaatcaataactttaaaattatttactccaggtatgtatttaacgtgaaaattgtgtggcaccgtgtatggatttacattaaaatatgatatatttttttgggtttttttagcccgaaaaatcaactcatggacgcgcggctggaatcaacgtgtgtgatgatccacatcatagaggctttttatccgtgtaagtgataacccacataacagacgtagatacagagacgttgtctctcgtgtttgtgttacgtgcccgtaatattgggggcatgttgaatgattaaaatgtagttgttgcttagggccggtatcgttatgctttttgtagccttgccaattttcggcaatggtagaattgactattgcagatgtttagattgttactccctccgtttcagtttataagactttctagtattgctcacatttacatatatattaatgaatttagacatatatatgtgtcaagatttattaatatatatatgaatgttggtaatgttagaaattcttataacctaaaacggaggtagtaccatttttttttaagtaagagttgctagctaggctagctagtgtttagtttcctactaaagagtatttcgtcgtggactaactaaaatcaaccaaaccaaaaaataggcagtcaaaaatttggctacaaacaaaataaggcataaaattttcagcaacaccattattttcgtatggttaagtttgtgaggcaaagaaccaaacaactagatcttaatgtgatataatttgggtaaaacaagaaatacgacagggaacatatcctatgcacataacatttccatgcgcgccaactagcaaatgtcatgaaaagttctaacatatactcttaatagtattacacatatatacatatatatatatatatagcaaagtctcatattcaaatttattatattttagcctaaaaattgagaaatttaacaattttaagagtagaaatctatcagaattttatcttccttttgtcacggctaaaatataataaatttgaagatcagatttcacacatgggccggtgtaatactattgaaagtacgtgtctatttttttctaaaattttctgtgacatttgttacttggtgtgcacaggaatattatgtgcataggatatattcacacctatataacgttggatatatagatgaaaacgatacgaaaactttatggagttcggactttttcggaaacggaaattgttgctcggatttttttggagtcttttagaaacggaaatgaatttgaatttttatatcggaaacggaaatgaatgtgataagaacagttttcgtcgaaactcggaattggttgagaactttctatacaatttctcgaaatttctagagttacaaaggcccgtactatagtccataaccataataatagcctagcccaatccaagttagcatcctattgattgtattgattgtgttttctgatataccgttgactactgagactagagatagtaattggacatgataaagttttaacctcagtttgagggggtcttgtattcagataaatttacgtaaccgtatccatgtcagttcttattcgctacattttttttcaacaatattcgattccatttttattctgggtttccgattttgattaaaaaaatagaaacggaaactatagaaatgatttccgatccgttttcatccatagtgggagtgcatccatatattggtagtcattctcacattattgtaaggcaaaatttactacagggcatcgaaaaaacgtgtaattagcttgtggacatcgcaagaatgagaatttgctgttggtcatcacaaaaaaaaacgtgtaattagctcctggacactctgagccttattttattatttaatgtgaatttggagagagaaacacgatgagagtacgattttgcccctgccctcacactggccagagcaccgccgccaccacctccgcatggcggccggagcccacgcaggccaccaacgcacgccatcgcatgcacttctgcaccgccgccgccagccaacgcacgtgcatgccgccaccgccggcggcagccgacgcacgcgcgcgctgctgccttttcccccatctgcgccgccacgccggaagacgaggaagacgacagcgacaaggacaacaggaaggaggaggccgtggggcttgagatgctgcgcatcgaccgcgcgtggaagtccgtgaagccgacaagctctgccagcggcagccgcgggctgatgccggtggagctgctccggcctgtggtcgccgccgtcgcatcgctggctcgctgcgtgcgtgcatgtgctgaggaatcgaatcgaatcgagggaggaagtggctggtgcgtggcggcgatggacggggacgccagggtgaggagtggctatggcgcgagggcgggtcctggtgctactactagtgctacgacgtcgtcgtcgccgtcgtacatgagcattgacggcgacgacaatggtggtgccggcggggcgaaggtgtgggtgctcgtgctgctcttcttgctgatcgtgctcatgttcttgccgtcggtggtgcggcgaggcaggccatggggaggagggggaggagagcaccatcgaggagggggcgggcttagcctcaagagcggccgggatgttgtcaacctctgcctcgtggcgttcgccatcctgtgcgggctgcttggccgcgccagacgacttgctgcctcgccgccgagccggctggaaagaactagctcggcgccatacacgaaagggaattcactgtatgtgcatgtgctctcgccctcccgatcaaaatttcccctcattttttttgtgatctctccatctctatattcaaattgttgtttgatccccatttctctcccttgcaattgcgaagtagctgccattgacacggcgggagaacgggatgctggcgtcgaggctggcgaggagcagctccgcgatgttgttgttggcgtcggtgtcgtcgatcaacacgtccgttagctccacgccaagggggtcggcggcggcgacgagcacacgtatgccggccaaagcgcggagcatcccggcgatggccgcgctccaccgctcggacccatcacaaggacagaacacaagtgctgcacgtgttcagctccgtcgccgcctccggccaacccaatgtgttgtctcactgtccaggtcgagacccaagggcaaacttgtctttatttagtgtttctctctccaaatttacaggaaataataaaataaggtcccgagtgtccaggagctaattacacgtttttttatgcccgacagcaaattctcgattttgcggtgtccacgagctaattacacattttttcgatgccctgtagcaaattttgcgttattgtaaaagaagggccatcatgatgtatgcaaagtggtcacctttgtcacatgctgttcaagtggaactagaagtaaagaaagacaagtattgtataacttattccgggcttctgagaaaaggttgaactacgaatgtcataactttctcatatgaactgcacctacgatcgcaagttatccagatgtgatagattggagcctaatcatgaaaactatcttccggacaatcattgagttcattgagtacgtaaaagtgattactacctccgtcccaaaataattacagttgtaggtatctgtatacaacgtttaaccgtccgtattatttaaaaaaattatgaaaaaattgaaaaaaaaatagtcacacgtaaagtactattcatgttttatcatctaataacaataaaaatattaatcataaaaatttcaaataagataaacggtcaaacattagacatgaacagtgtaaaactgtacttattttaggacggagcgagtacttatgtggtcttcaaagaataacatctagatctcctaaaacatgtggtgccaaacatcgaactcttaaaccattaattaattattaaaaattaggacttccatatgtgaaaataatattagtgaaaacgcaatttttttttctttggaacccaacatttgaatgtgtgaaagagagaaagcacatcttccttgggcagtcagccatcaaccttttcttcggtgtgctcagctgtcattatgtttatcggatgttacaactgcaaagtcatgcatacttagcaaaggtcattttattctatagtagcatatatcattctcaatttgaagaaaacataaaagtaaagttcatgtctaaatcaagattaacgtgtgagttaagtccttagaatttaatcacacgcttagctgaaattttaccggaagcatattaacatatatatgcgcacctccaattaccaaataatgttgtatatgtgtgagtactgtttgacctatgtatacttttcaagagtttgacagagaaaaaaaattaatggatcgatttgggcaaatatcctacagctattttccttagagagtctgcaatacagctcatatggctgtcatcacgtctctggtaaacctaatccttatcctttacggaactgtccacacccttctctttcatccttgtattggataatgggatagcatatcgtcacaccttgccaacaaaccgccctttcactaccaaagctacctatgatctaagcttttccaagttatcggatgatctatttgttggacccactttgggcaaccatgctcaaaccaaatgcaagatcttcctttggacaacgcacaagtgacgtgcaaaatcaaaggtgtttttgattattattctgtgatgaacaattggcataggagattatttgtttttttatttagaatttatttacgaagtggttttggagatgattggattttacaggtgaatctacaggatactgctgttattttttgtagacctgtcagaccgggcatgtgctgctggtcagaccggcgtgtattgcgcggtcagagccttgttttcttctttggatttttatcgatctagagtttttgccatggctactcctgttaggttttcaactaagcctcatgttttcgatggaacggatttttcttattggtgtagtaggatgcaatcttacattatggctgaagattatgatatttggagaaaagtttctcattcttatgtgatttctgaagtaattaatactgctgctgcaaaaactgagtttgaacaaaattgcaaagctcgcaatattcttttgagtgggattaatcgttcggattatgattgtgttgcgcattttcaaaccactcatgagatttggattgctttgagtaactttcatcaaggaataaataacattaaagaacttcgtcgtgatattttcaaaaatgagtacattaaatttgagatgaaacctggagaagctttgtatgactatctttttaggtttaataaaattttgagtgatcttagatctgttgattcttcttatgatgctaattatctataatatgagatttctcgtcactttttgaatagtcttgacatgtctatttgggagatgaaagttacatctattcaggagtttgttaacatgtctactttgactttggattcgctttacacaaaattgaaaacacatgagatgaacattctttctcgtaaagttgattctaagtcgagtgctttggtttcttcttcttcttctttggatgttgatgcttctacatctaagccttcttttcttgctatttttaatgccacatccgatgatcaactcgaacagatcgaggaggaggatttgatttggctttggttgctaacagaattgctcgagctatgaataa

SEQ ID NO: 16121 - DNA, 163 bp, Oryza sativa
tcacagagtacctgcacgagttccatcgtttggctcactatgcaccagaagatgtggaaaatgatgaagacaaacaagagaagtatctccaggggttaaaagatgagatcgcagtgcaactactcctagaggaatatgaagattttgagaaacttgtggacaa

SEQ ID NO: 16122 - DNA, 3059 bp, Oryza sativa
ttgtttggtgttgagggatttgtccaggagttacgtaaagatgtcctttgtcattggatttgggactgcccctttttatgctcagattcatcatgatcttcatgaagagaagtgccgagtcaaagtcaccttgaacagtaatagtgaagatatcccctcagtgatgttcgaagctggaggaagaaactacatccatgcatgtcaggaggtggcaaggatcgccataggagagcttcagtgatcagttggccgacactgagtatcgctaccatcctcgccaaccccagggaagtgaccgtggcagttaccttgagactgaaggaattgagaatgatgctaccacaaggcatttggttgagatgctgtgggctatggatgaaagtcgtgcggagactgtgttagcagctcaagatcgtgaagaccggaatcggggtaagatttgcaagctagaagacaaggtggatcgtttggaaaaggaactagctgcattaaagggagaagcaccgccacagaaggccaggattcgtctcaccgcaaggaagagagctctatttgtccctcgctaccaattggcgccaaaggtccgtgtggtggagaaagaagttgccccagccctagcggatcctccggtcattatcataagtgatgatgaaggagaagaatcaaagcgcacccattccaagattgagtgggtagcaactcaagatgatgaagacgagccgaacgagccttcaatcgacctccgatgctcggaagaactagagtgacttgttaagtcgttgtcttagatcgttgtgttagtttgcttgctttaagtttggttgtgtgtgtctcgcatgtgatttacatcagtggtgggatgtaagtgcatgcgtttgtttgctttcgagtgttagggagttggtgagtttagtggtgtgagagtcttcagttctgtaataatgaaactcagttaagatcaataaaagttaaagtaattctctgtcctaagtagtttcccccggtttctcttcttgtgccctgtccatgccagatggtgatcactcgcagcaatgggaatggccctaacaaccccaataacaacaatgaagggaacccaacacttgctcaagttcttgctcaacagactcagttaatgaacatgatgatgcagcaacttcagaaccagcagaaccagggaaataaccatgcacctccccagaacaagttagcagaatttcttcgtgtgaggctgcctattttctctagtaccactaatcctgttgaagctggtgattggctgcatgccatagagaagaagttggatttgcttcaatgcactgatcaggaaaaggtctcatttgcatcacatcagttgcatggccctgcctctgaatggtgggatcacttccgccttaataggactactgctgaacctatcacttggcttgaattcaccgctgctttccggaatacgcatataccatcgggagtggtgtctctcaagaagaaggaattcaggtcgctcacccagggatctcgctctgtcacggagtatctgcatgagttcaattgtctggctcgttatgctccagaagatgtgcgcaatgatgaagagtgccaggagaagttcttggaaggacttaatgatgagctttcttatccactcatgggctggagattatcctgatttccagaagttagtggataaggctattgtcaggaggacaaatacaatcgcatggaacagaagaaacgccggattgctcaattcaagacacaaccgggaaataatcaaaggccgcgtcttactttaggaccccagtccatgccacatggaggttcttcgtctgttgttcgtccgcggcgtcagttcttcaacaacaatgctggcaacaacatccgcaatctagctccacgccctgttgcagtttcgacacagcaacagcctgccaagagggagcaaggcagcaagcccgtagtgtgcttcaactgtggagacccaggacattatgctgacaagtgtccgaagccccgacgcgtgaaggttgtccctgcccagagcaactctaccgcaccagcatcaaaggcccgtatcaatcatgttgctgctgcagaagctcaagacgctccagatgtgattttgggtacgttccttgttaactcagttcctgcaacagtgcttttcgattctggtgctacacattcatttttatctatgagttttgcgggaaatcatgggatggaagtagaagatcttagacgtcctttgatggttagtaccccaagtaatcaagcactctctttgcaacgtagcccctctgtcagaatagaaattaaaggagtaccatttctggccaatcttatcttgttagaacccaaagaccttgatgtcatcctagggatggactggttagccagacataaaggtgtgatagactgtgctaacagaaaagtaactctcaccagcaatgatggtcgagttgtaactgttcatgcattgtcttctgagtctttaaggtcaagactgaaccagataactttggaagagattcctatagtccgggagtatcccgatgtgttcccagatgatttacctggtatgccgcctaaaagggatatagagttcagaatagatttggtacctggaacaactccgatccataagagaccttatagaatggcagccaacgagttggcagaagtcaaaaggcaagtagatgatttgcttcagaaaggatacatcagaccgagttcatcaccatggggagctccggttatttttgtgggaaagaaagatcatacccagaggatgtgtgtggactatcgtgcactaaacgatgtgactatcaagaataggtatccactacccagaattgatgatttgtttgatcagcttaaaggtgccactgttttctccaagatagatcttcgatcagggtatcaccagttaagaatcaaagaggaagatatacctaagacagcttttaccgctaggtatggattgttcgaatgtactgttatgtcttttggacttaccaatgcccctgcttttttcatgaactttatgaataaggtgt

SEQ ID NO: 16123 - DNA, 6270 bp, Oryza sativa
ccatgacacgactgcttcagaaagatgtgaagtacaagtggtcggaagaatgtgagcagagttttcaagagttgaagaatcgcttgatatcagctcctattttgattttacctgatccaaagaagggtttccaagtgtattgcgatgcatccaaacttgggttaggttgtgttctgatgcaagatgggaaggtggttgcctatgcatctcgtcagttacatccgcatgagaagaactaccctactcatgatattgagttagctgcagtggttcatgcattgaagatttggcgtcattatctttttggtactcgtacagaggtgtacactgatcacaagagtttaaagtatattttttactcaacccagaatctgaacatgaaaacaaaaggaaatggttggaatttaatttaaggtttttaacttgggaaattctttttccccccgggaaaaggctaatgttgaaccaaacccttttaccaggaaaggcttttgcaatgctacaaaaggacgacagttgccattggaattatgcaaggaatttgaaagattaaatttgggaattgtcagtagaggttttgttgcagccttaaaaacgaagcccactctaattgatcaagttagagaagctcaaattaatgatcctgatattcaagagatcaagaagaatatgagaagaggaaaagctatcggtttcttggaagatgagcaaggaactgtatggttaggtgagagaatttgcgtccccgacaacaaagatttaaaagatgcaattctgaaagaagctcatgatactttatactccattcaccctggtagtaccaaaatgtaccaggatctcaaggaacgattttggtgggcaagtatgaagcgtgaaatcgcagaatacgtagcagtatgtgatgtttgtcagcgcgtcaaggcagaacatcagaaacccaccggtttattgcagcctttgaagattcctgaatggaaatgggaagaaataggtatggattttatcactggtttacccagaacgtcatcaggccatgactctatttgggtgatagtcgacagacttaccaaagtggctcatttcattccggtaaagacaacttattctggaagtcggttggcggaattgtatatggccaggattgtgtgtttgcatggcgtccctaagaagatagtgtctgatcgaggcagtcagtttacttcaaatttttggaagaagcttcaggaagagatgggttctaagctgaactttagtactgcttatcatccgcagacagacggacaaaccgaaagggtgaatcagattttggaagatatgttgagagcttgtgctttagatttcggtggaagttgggataagaatctaccttatgcagaattttcgtacaacaacagttatcaagctagtcttcagatggctccttacgaagcactgtatggtcggaagtgccgcactccgcttttgtgggatcaaacgggagaacgtcaggttttcgggactgatatcctgagggaagcagaagaaaaggtaaaggtcattcaagaaagattgcgagtggcccagtcccgacataagagttatgccgacaatcaccgcagagatttgagttttgaagaaggagattatgtgtatcttcgtgtcacgcctcttcgaggggttcatcgttttcacaccaaaggaaaattggcaccgcgttttgtgggaccttataagatcgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaacagatgagagaagaaccaggaatcgagttatccatttttgtaaagttcaatggagtaatcactcggaagaagaatcaacttgggaacgagaagatgaattgaagttagctcatccgcatctgttcgccagttcttccgaatctcgaggacgagattctgtttaaggggggtaggtttgtcacaccctgaaaatcataaatatataaattgttgtttaaatggaattttttttgaaataattttaaaagccttgaagagaagatctaattttaattaataaattccaatataaaatggggccagataaaattttattaaatactttgcttaattctataattcctagatttttctgggattcatttgagctaaggaagtatttttaataaatggaattgcatttaagaaataatttaaattgaaaaaggttttaaaaagtcttcttttggctttgggccgaaagtcggcccaaaacctctcttctctctctcctcggcccagtccggcccagtccgccgccgcgcgcgcgcgccctcgctcgctgacaggtggggttcgtcttccccgagccgccgtcgcccggccgaaaccctagcgcgccgccgccgccgttcacttccaaatccggccgttcctttccttctccggccgaatcaaaagaggggaaatgatctccgggatctcctctaccttttctccgttggaatcatcggctaaaacgttttggaagttcgtggaatcgagttcgattcggatcggcctctttccttcaagccacgaagtttccttctcgtcaccggccgccgtgggccttcgccgccgcctcctagcccctttaaaaggctccccggtgtctcctctacccgccgccaccctcgccttcgcctctcgtcgcccgtagagctctagcgccgtgtgccctagcgccgccgtcgccgccgtcgctccagcagtgcgccgccgccgttccagacgtcgccgtcactcgggaaggtcgtcgtcgtggtcgccaagtcgtcgccgtccttgtccgccgcttcgtcaccgtcggaaaccgccggagcatcgtcgccgtcgtcaagccgcagtccgccgccgttccttcgtcgtcgccgtcgccgtctgttggtcttccgccgctcccttggtcgccggtgagttcgccgtgccgtccgctacctgttggtgccctccgttcgtgccgtagtgccgccgttcgccggcgagcttgcgccgtccgagctgtcgagccgccgagccgccgccgccggtggtgacgtcatcgctgacgtcatcgtccccgtttcccgtgagccgccgtggacccgatcgatctcggccgtccgttttggatcaagtcgatctcggccgtccgttcccgtgaaccgccgccgtgcgcccggtccaccgcgaaaccctagcccgctgacgcaataaatcccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatatacatattaaaaatatccacatgtactgttcatgcttgttttgtgctgttttggtgattttgctcttttttgcttagattccgtcgtttccgaagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcctttttgttcttgattactttattccttgataccttgggttattataatttgactagttgagctttgtttatattggttcaactagacgtattagatataattgcttagccctgcttagaaacattagcacactattgggataacttatgactcactattatttaaagatggcttaatgatagttcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaactgtgccaaccacaagccagcgtgggtaacggctttatcttttgtatagcatggttcattgcggggcaccagactgagaagtggcggagataagcccacgggggtcgctggggagtccatgccttgtttataagggggtgattatgatccaggaaaggtgcgctgtaatggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacttttcaccatagtaaatgatgctataattggtaataatttgattagctcctggtttggaatggtatattcctggtttggagatagaactgtgcagccggggtggttgttcagaatggttgggcctatacaacagggtacgttgtatagtgttggattaatattgtttaattattacttaacagttttattaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttttacagtgaagctgatggtgtggaggattaggtgtagccctggtcaagctgcttgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgtttggaattttggatagaaattccgggcgtgacagtagacgacgacgccggccggaacggacggcggacaacagcggcgagcggcggagcgaaccacggcgatacaggcaaaagcgagcacaccgggtggttgcacgagaagaggggagacgagccaatggctccgattcgccggagggagcttgacggcggcgaatcgcggcggcggcaaccggcggcgggagaagggggaaacgacgacgaggtcacgaggggccgattcccggcggcaagagcatctacacggctacgggaatccgatgctagcgtcggattgggcggagctacgccgagcgaggccggcgacgagcgggtgctacggagcacgggcggtgagcacatggcgagcggcggcaacggtcggggcggtgccggctagctacggggaggctactcgtgctactaccgaaaactaagggggagagatggagcgaggaggaagaacggagggaggcactaccgtgcggacggggcgcagtgacgagaggccgacggcgcgggagtaatctctctggcctcgggcctgggaagaggaaggagacgagcgcccggagtccccttccgcgtcctcgctcgtgccggctcctccgacgcgcgcaacgacgaacggcgacggcgaaacagagggacggcaacaatatagtggaggcgatgggacaacgagaggagaagagagggagggcgcccggggctttaaagggtggcaatgtcggtttggaaaccgactttggtcggtcaaggcgcgagctggcgctcggcgctcgcgtccaaatcggcgacagggcggagggaggatgacgccggcgggaggaaaaaggggaaaaggagggagagaaagggggcttgcctccttgccgctttggggaaaaggaggagggggagagagagcgacgcggcagagggaggagggctctgcctccgtcccttggcggcttgcgcgcggagtggcggggccgaggcgatgacgacggcgatgacggcggggcagtttggagcggaggggcgacacgggcgacaggcgcgggcaggcgcggacgacggcggcgaccaggcggtcggccaccacggctcgcgcgcgcgggatgcaacgggaggcgcggcggtttgagtggcgcggcgcgggcacgcgcgctggcagcggggccgagcggctgcgcggctgcaggcggcagggcaccgggaccgggtg

SEQ ID NO: 16124 - DNA, 5121 bp, Oryza sativa
gagagagagatagccggggagggagggggagatgggccaagagagattcggcccatcgaacccgggggaggcaaaatagacttttgcggaggaatttgatttggaaggatttggattcggaattgaactcgacaatagatcggggatttgagatcttgagatggcacggacactagacaataagcaaagaaacaaatttcgcaattagggtttttaagagataattttcccacttggcgccacgacggaatcatgtcgtcgtctcccgctgttgtcttggcgccggtctccgtcatcatcgtcgttatggcgacgtcctcgaccagtattgtctggcacccgtcgttcgcgatcgttgtgatcgtggtggttgtcctggtctcggtcctcatttgagcggtctcctcgattttcgttatcatggtgccataaagagatatgacatcgagaacgattcacatcgagaacgataaaggggtagctcactgaggcgattccctccgttccgggttttcaccattggcatcgccagttggtggctgctccgggtgcgctgtggtagcggcctcttcgaacgcattgctgaggttggtcactgattcccgtagtcgttctgtccaacgcgcgaggtcatcgttcagaacgggatcgtatgggggtttccctcagtatagcgtggatggctctgatgtgctgggctggagtagtcaattgattctccgcttctgcgttggtgcgtgctgacgtgccaacgtcatcgatagccaatacctcccgcggcgcgctcgttgtcgatgacccatagtcttcgagaagctataagactgatggttcgtgaggatcgatatcgattaccccaacaaatcgatctgaagttggcgtcgctccttattccttgtcgttatccctgatggggacgtgtgactgttggaccttaggagatggagctttcatgtcgctgagaaagaccttgcagcttgagaggtcgtgattatttgtcttgtgaataggacaatagacatcacgagttggagagatacgctgaattccacgctctttgcaggcgcgaatttcatcgcggacgttgaggaaaacctagcaggcttgcaaagttttgtggataggacaccaggaccttgccgcttcggaagtcatcttcgtcggctcgtggttcatgtcggaatgacaaggtttggccgcatcagaatccttctcgagcttggatgtcatcgatgctccgttctccgtctcagcgggaggatttttcgacatggattcgccttggtttgtagcaactgcgttctcgtttccggtcattgagggaccggttgagatcggcgtcgtggtgtaaaccgggaagacgatttcgccgactttagtccacaccagcatcgttgaagcagggattacttggctgaggttggtgttgacgctgttgtcgacgaggctggatgacatagtagtagaaccttgaataccaagtgcccctacctggcgcgccactgttgacgggtggtacccgtagaccggatatagagggtattggggtacgttggtataaggatctacgtaatacgacatcaagcaaacaaaagacgaggattatactggttcagtccccttgataggtaatagccctaatccagttgatatgggattatatggtggaaaatacaggttacaaaggaaacaatggaacttgacggatccgacgagatcgtggtcgagttggttcgactagatcccggcgagttggctcctgcaggctccgactttgtagactgtgagggttgtgttggctttgagattcgatgccccatgtcctctccgaggggtcccttttatatcgcagatcagggggtttccaagtagaactcggagatatcagaccttatacgacatattgacgacccagttttgtccgagtaggactcttcccatccgtagactccgtgaaggatttccttagagtacgcaggaaatatccgtatgcgcatgggaataccataccgatatgtgacgtatatcgaagggtaaagggtatgcctaacccataaccctgacaccacgttagatgaagaccgggtcaatttagccacgtaagctaaaaccaccgtccaaaccgccatgggacctatattgcactggttttgatagttgagagacccattatatctagttttcttgttgaaggatgaaaatcggattcgttaacaagttaagggaccttgggtgaacttattccaaacgaaaatgcttctgaaacctgatgggctgttgttagttgatacatgttgaagcgtgttatctttgtggatgtctttttcccaaagcctagaaacacataacaaatttatagatgcaaaacatcaatagttgatcaattttgtaactgaagttgcacaaactgaaagagcatccatagaattgcaaaaaaaaaaaggaaaaagaaaaagaaaagaaatatgagctgaggccacccatgtgtacgtatgtgttccctgaatatttgatccatattctttcactacatgaacaaaagaatgttgaatctctgtgtgttccaaggtaattgtgacaaaagaaattgttaaaaaggtagattcctcgggatgtttccccagaaccatctgaaacggaattaatcctttcaaagagagtgagggtacatagaagtaggggcaattccttacatacccctaaagtttgctccatcccttgcatgcccttgaattttgtcacatcccttgtatacccctgagatttcgtcttgatcccgtttatacccataccgttagttcaccgttatcttttttccaaaatggccatgttgccctttttatagtcatgtgatcacttcaaaaggctaaataaagcttaatgtgaactttttaaattttgtatagatagttgagcctaaatttcaaaaccaatatttattttttgaaatatttttaatagattttcaagcaagctttaacaaaattaatgaaactcatatagaagtttcaccgaacatttagaaattaaaactatatttaacttgaatttaaatataaataagaatgttttatgaaatttgatctaaatttttaaaattttaaatttaacttttcaaactttgaggtcaaataaacacattctttttgttgtttactaataaaatatttttcaactcgaaaattatgttggtgaaaaagctagcgcataggtactctaagtaggggtaatatagtcattttgaaaataacttaatagttaactgatggtcaactaacggtatgggcttggaggggatcaaaatgaaaactcgggtgcatataagagatacgtcaaaactcaagggcacagaagggatggagcgaaatttcaggggcatacaaggaattttctctaagaagtatgctgagtctataagaattaccttgaaggccaagcatgaaaaaaacacacccaataggtaatttgggccggtttgctgaatttaaatgtgtggatttgtagtcttctagacatcatatcaaagtcaccttagcaaaggattattcttaattacatgaccaaggtttggcataattggtttcaaacatcacgccaaaacaagtcggacaatatcaaccataggggctatacaattactatctgtatagaatagtgttccaagatcgttctcggacggaagagaaaaacaagttgcctagaaagttgttataggagattaatcggaggaaccggccttgtattgaatttatagttttatgttggcctgttgggtacctggcgaccttggttatgtatagtttatcttttctatatgtaatctcttaaagtactacctccgtttcaaattagtattcgctttgactattttcttgtaactttggccattcgtattattcgaaaaattaatacaaatagaaaaaaatgataaatcatacttaaagtaaatagttgataataaagcatgtcacaaacaaaataaataataattttataattttttgaataagacgaacgatcaacaattgtaaataaaaactcaaagcgataagtattttgggaaggaagtaagtattttgggaaggaagtagtatttattttcgttcttctcaatatacagtataaccaaatgaactcctgccgttcggattaattaaaaataagaaaaagaaaaagagaattaaggttttaactgccgacaaggaatatcgatcttttggtcagcgcgaactactgtagtaacaggatgaccatcaaccactaccttcatgtatcttgttactacaagcaatggaggctttcttctgaagcatgcatgctgactcagacgagaaaaaggtacagcatgcaaagttatgcaagtaactatactcgacatgggaaataacaaaataattgttgagcgaggtttctcacaagttgatcaagaaaatttttttctcgctaagtgagcacataactaggtagatttttttatggtggattcaccccactaaatttgaatcgaagactgaatttaaaggaaaaatatcctattatagtgaatcgtacgtattgatattgcttgtatagaaaaagttagtgggtttcgtaactaagtgagcagcagctcgtagaccacctgaaaaaatatttattatttgagccgtgctcgtatcgatggctaataatgttttcagtgataaacaacgtaccaatcgaagtgaagtgtccgtggtgattcatcaatctcaagatatacctacttagtctttcgaaaattctcatagggtagagtgcgtgtgattatagggtgagtgtgcacgtgttatgagcgcctgtgtttatacggtgtcttttaaagaaaagttaatttctttgtcagaactagttgtgctgcttacatttctctgtgacttcattgccaattgcacagacatctcacttgtactgcttatacattactctaggacttcacctgtcaattccacacacagctcgcttggcatctccataaatgtattttagatttctggtggatatataattcaaatgccaatgaatattatctcgtaaggaacggtactaaatactcctatataatctagtcataaatatatgacaacatctggtactgaaacc

SEQ ID NO: 16125 - DNA, 5059 bp, Oryza sativa
ctcataaacttattacatttataaacttattatagtaaaagttatgatcaaaatcaaataccatatataaaaatatcaaacagtgcatatttttaaagagagggaatatgaaataagtagtaaaaatcagattgacttttctttacgatgaaaatcagtttgacttctgtttgcttgggcaagtagattgcttgccgtattcttatattttgacatataattttctctttccacagtcaatgatttgtgatgaacgaaataacacattatgtagacatcccctttttccattttaacatgcgacaatcacatggagaaatgtgttgaaatttgaagcccgtacactgtacaccaaagaagaaaatttttttgagggaaactacggcaggtgtgaacaccaacctgaactttattcatatggtaaaaatctttacaaagagggagctttattcatatggtaaaaatctttacaaaaagggaggtacagagggacagggagaagaaactaaaaattaggatttagcgcccaagagtagagttgttgtttgcctacggcgtcgttacatcggtttgaccacaactcgatatagctggcgcagcgacgaaagactagcgtgttggtttcatcgatggagttgaagatcttgttgttgcagcgtttccatatgttccaaactgcggcgagtaagatgatgcaccagacctgtggggtcagagcattgccgggggtgggaggccccataggtcttcgagttgtgctaggaggtaacttgctgttcatcaaatccataggagtgccaaatggctgccactccggagcagcgaaggaagagatgttccacatcttcgtcgatggggcagaagtggcagcgcgcggaagttgctagtctgcgtcgcatccgcctgtcgtggtgatgatacgtcgtgtaggatcaaaacacaagaactaagccaaccagagggggggtgaatggttggtatacccaaaaaccaaaacttttagcggaaataaaaggtaccctcaaattcgacggattgcggtctgaccgaagtagttgcaccggtctgaccgcgtgatgaacgtcggtctgaccgatgtagatcgatcggtcgaactgccgagatgcctgcctctgcctgtcaccactgccggtctgaccgccgccttgccaccggtctgaccgccggtgagtcgtcggttagaccgccgaaacccagtgaaacacaaatcgaagaactcttaaaatagatgacgactttattgattatctctgtgtttgcaaagtgcaccaacagcactccttacaaaaatttcgactaaactcgaaaccctaactcaaaactcaactcaattgctctcaaaagcaatacagggaagcctcacgctccccctttatttatacccaaggtaggcagcctaaagccacggaacaaactcatactagaagtcctaaacaccttaggaaaccctctactacaagacacaaactttacataaccaatcatatcaaatttggactccttccaaattcgactccgcatcccatacacacacaatacctccatcgtatgccatatggaatctacatcacccacgtgcatcaactctagcctaagtatcccgcatgatctctgaccaccacggacgtcgtcttatccccaagctgactcccggtccatcaccgcaaatactctcccgaggcatcgagtcacctacacatgaaatctatacctaaataaaaaatacataaggcttccggaaattattttggtacatttttttttgttatcgccgtttcgcttgatcgcggtgcccctaccccacccctcccgatctctttttattttcctttttatttccaaaaaataaataaacaatctaacttcctaatctctatctctactattataaaaattaaagatatttttgccggtattttggtaagtcatctatgtatgagtcggttttttaagttcgttcgcttttgaaaatgcatatctgtatttgagtcagtttttaagatcgttcacttttggtaatacagaaggaatcatataagaaatctgtagctcatgaattttgaaaaatatatatatccaagtgaactcccacagtgaatttcatcttaactaaaccatataacaataataagattaaaataaacttcacccgttgcaacgcacgggtatttttctagtaaacaaagaaaccatattccgagaccaagctatctctaacttgactcattagtagcaaacaacagtattacatacgtatagtatccatctagaagccataatcataaaacaatcacggatatccaaacaaacaacccggaaccgaaaccgacacagcgtcggccggtcagaccgcgggctgcaccggtctgactgcgcaatgcacgccggtctgaccagcagcacatgcccggtctgaccggtccatataaaataacagcagtatcctatagattcacctgtgaaatccaatcatctccaaaaccacttcgtaaataaattccaaataataaaaccaataatctccgatgccaattgttcatcacataataataatcaaaaacatctttgattttacaatgtcccccttgatgaacccattggcaaacacataaaaaatattttggtgtttggaaaaataaaaacaaaagtggtaaaaagcacacttcgtacaaatgtacacatcgtgctcgaaaatccaaaagaaaacttctctcacttttgaaaagaaagaaattcccaatcgaaccaaaaacaacatgctcttcaactcatttgcttctccaaaaattttcacttttcaccttgcttctcccaaaactcatctcttcttccccttttgacaatgatttcatcaagaataggaattatgttcattaatgttcaagagcttagcatacatatagcatatcaagtcatgtgttgtaataaaaagaagatgaacccatctataatacagcaagcgtgtattaaagtataaccatgaaccaaagattttacaattaaacttgaatcaacaatcaaaattcatgatttcatacgatttataatgcaacatcttaacaagcacataggttgaagaataaacactaaacacatatacatattgcattactctttctcaaataacctttagcacaaaataaccaagagaattttttaaccttttcttttcttgagcctttttgctcatatttttctcttttattccaggtacgtccctgtcgtcaagactgtttccagggattcggcacacattattttgctcacatcgaatacgtccttgtcgttaagactgtttccaaggattcggtattcattttttttttcatatttttattctcttttcacaatgagcaattaaagctatttgaggaataacaattcaataaagcatatatataaagcatttagaaatcaaaccatatgctagcatcaacattgcatatttgcataattcaagtagaatttaagtgtcatgcatcatctcccttaaaagcaaaatctaaatctcatgaaaagactagaataaagctatgctagagacaaataaaccttcaaagtattggtagcatgcaaaaaaaaatgccatatgcataaacaaaggttttttttatcaattttttttaatgttaaaataatggttgataaaaccaagaaggaccaacttccttttcaaacaaggccaaaaggatgaattattcccaattcaccacaaagaaaaacaaatcgattagaatccaaaggtttagtgaaaatatcagcaagttgcaactttgtatcaaaaaaactgcaattcaacatctcccttctcaacatgatccatcaaaaagtaaaaacgaatatcaatatgctttgtgcgtgagtgttgaacatgattcttagcaatgttagtagcactaatattatcacaaaagagtggtactttctcaaaagtaagaccataatctttcaaagtagataaaagacaaagaatctgtgaacaacaactagcagcagcaacatattcaaattcagtagttgattaagcaacactagattgtttcctagaagaccacgtaaaacctttcccattgtaaaacctttcgcaagcaaaaagttcttaagcctatcataccatgccctaggagcttgtttcaaaccatacaaagttttagacaatttaaaaacatggttgggaaaattaggattttcaaaacctagtggtttgacataaacttcctcctgtataaaaccatttagaaaagcacttttcacatccatttgatacaatttaaaaccttttgaagcaacaaaagccaacaaaagtctaattgcctcaattctagcaacaggagcaaaagtttcatcaaaatccaaaccctccacctagctaaaaccttgagcaacaagtctagctttatttctcacaatcaaaccatcctcattttatttatttttgaaaacccacttggttccaataatattatgtccagaaggtggttcaactaaagtccaaactttgtttctctcaagattttcaagttcttcatgcatggcattaatccacgattcatcagttaatgcatgtgacacatcttttggttcaaaagaagcaacaaatgcagaatttgcacaaacatcatgagtcgttaccttagaccttgtagtccgctcacctatattaccaataatttgttccagcggatgttgtcgttgaatgtgcaaaggagcagcgacttctgaagttgatccacgttctgtatcagtactggtcgaagttgtaatctctggaggtccatctcgagcagcatcaacagtacccgaacccgacgagcctggtcagtttgaccgcacctcctgtgccggtctgaccggaggtgtgccggcggtctgaccagcctggcgtccggtttgaccagccgagccgaccttgtcatcgttgtcgtcttcgctctagttttcaaaaatagggccatcctccccctaaacctgtgacattatacctgcaatatcgggtctagtacctggactagcttcatcaaaagaaactgggctgcag

SEQ ID NO: 16126 - DNA, 536 bp, Oryza sativa
gaccgcacgggagaatatatggaaaattagccaaaaattgaccgagcttagttacaaacatcaaattaaatcaaattacatagaatgtatagtgtttgtaatgttacaagtatccccgcgacaaataaaccttttagtccacagcatgttccctctcccactcccttaggttcttgaatttggggtgcgtagcaagttcgctatgaggatcatggaactgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagactacggcgacgaccacaggcgcttgacggcaggcacgagctgcggcccggtagtctagatgtcctggcacacggccggtgtcctgctgctaggggctcagtcctgcctgcctgtccagggggttccggccgt

SEQ ID NO: 16127 - DNA, 1908 bp, Oryza sativa
cctgcagcccgttgaatctgtgttaattggttgataactccaaactcccggacatgtagataaaatctcaaacttggttctggaaaattttggagtagattgtggcggcgatggagaagccaaaattgccggagaaataattggagttgatgaagtagaaagcttgctcggaagtgaagacgaagatattgactcattggcttgttaattgattgcttcatgttgacataacatctgtcgaattttgagtcttgtatttgtgtagccccgactctagaactgaagcttcttgttgtcgagtggtcattgcttaattgaagatacgtgttgaagatgtctgagtagaattcttaaaaattgtagaagcaccacttgttgtagtaaaataacacggcatcatatttcgtgatgcatgccgagatgtcgaggctcttgtagacgtcgtggttggtgaagtagcaaatcttgcgaagtaaaggcaatagagtttgccggtgcaaaaaacaatgaaaatgtagtcgctccaccatggtggtaaagttgcatagccgtgatgacgtgaagatgagtcggcggcaacaaaagcaaaccggtgcgaagacgcataatagtgaagacaaaaaatcagttgacggcgaacgagatgactggtggagaagatgacaacgctaattaacggtgaagatggcacgtagccttggatgcgaggaaactagtcggcgtaggacaaggcggtcaacattgaagacgaagacgcccaacagtgacaacagagttgtgcagccatggcggtgggataatcattcggcaattgacgaggcgaccgtagtggtgatgaaaccagtcagcgatggaagaagtagaatgatgatgaaaacgaaaacttccttgaagccagtcgtgaaagtgaagacaccttggacgacggcgaaggaaagctggtggtgaatacaatgatgaccatcgacgactgtgtgaccatcaagccatgtaggggaaaacaccagtcagcggcgacaaaggcaagccggcggtgaagacgaagacgtttggtggagaagatgataactccaataaatgatgatgaagacgcgcaaccatggaggcgaagaaactagtcggcatcaaaagataggtattagtgaagataaaggtgtccagcagtgacgacggagttgtgcagccatggtggcgagataatcagtcggcggtagacaatataccagaagtgaagacgatgacgcccaataatggtggtatgaccaaccaaccatgtaggcaaagacaccagtttgcagcgacggaggcaagccgatagtgatgttgaagatgcccatcaatggtggtgtgacgaaccaaccgtataggtggaaacaccagtcggcggcgacggaggcaagccggcagtgatgatgaagatggccatcaacggtagtatgaccaaccaaccatataggaagaaacacacgtcggcggcggcgaaggcagccgatcggtgaagatgtagacgcccaacaacggtggtgtgaccatccaaccgtataggcgaaaacactagttggcggtgacggaggcaagctggtggtgatgatgaagatgcccatcaacggtagtgtgaccaaccaaccgtataggcggaaacaccagtcggcggcggcgaaggcagccggtcggtgaagatgtagatgcccaacaacggtggtgtgaccatccaaccatataggcgaaaacaccagtcggcggcgacggaggcaagccggcggtgatgatgaagatgcccatcaacggtggtgtggccatctaattgtataggcggaaacaccggtcggcggcggcgaaggcagccggtcggtgaagatgtagacgcccaacaacggtggtgtgaccatccaaccgtataggcggaaa

SEQ ID NO: 16128 - DNA, 3129 bp, Oryza sativa
ggttatgttatgactgatccattcctaaagcgtaggggataagcttaaagccatgaatccctattatgcatatgtatatctagatcctgcagaataaacaaacatataggatgggtagtatctgatgtaaatacagtacttgatgaaagttcaagtattttaagatgtttataaatatgtatatctcctcttgtcaattttgatttccctgagaagatgactctttacgtttaaacactctgcccgactagtcatagtccccaagcaccggcagtcggccaatgcacttcccaaacatgcatatgagtgacatgagttcgtcattaatggaactgagtttcatggatcagaatttactacccgggtacttttgcaattgttaagagcagaaaataaattatcttatctctatgcttttgatttcttccaagtaatacttagcaccttgcgttactcggtctatccaacgagtccccgggtgctaggaatcggcccaaaggcaactatccatagacaaaccaaacggaaagcataggaagatagaactccataactcgatagttactttatttttacttggatcatttcgcaagcaatcaagataaatattatgaaaaattgttgaaaaatatgatataacatccgtagccctcgactcactaatcaatggagaaccaattggtgtagtgaggcagcggaaaaaaatatcaaataaagaagaaaaataaatggtgacttagctttttagtgttcccccggtaatagcagatgtagccgatgtgtggagaaagtcgtccatcaatcccaataaaaacaccagtcggcggcgatggcagccgccggaagtgaagacatggtcgccatcaacaacggcagcggattacaccaaccgtggaggcgaagaaaccggtcggcagtgatgacggcggccagcgatgaaggtgtagatgcccaacaacggtggtgtgaccaaccaaccgtgtaggcgaggacactagttgacagtggacgaggcggccggtcagtgaagacgatgatgtccatcagcagcggcgcaatatgccaaccgtgaaggcgaagaggcttgtcgacggaagatgaggcagctggcagtgtagaatatgtcattatcagccatggcgataaagacaacatgtttggataaatccaatacacggtatggtaggcggagcctgcagcttgattaatgtcatcggctgtcaccacagcatttgataaacaaaggtgctggtgatctccgttcccgtgcgtgccatcggctggcacggcatggcttgacctcaatccgtccgatatatgcaaacacaaaaaataccaggatggtcaatttattagtaataaaaaagatatatgccttacagtctgattagagaaatcatgcatgttaattgatctctatattgatctcatagaggcttggacgtcagatcagatgcatccatgttgtccctgtaatgcacgaagcgttgttgaaggactcggcatcccaggaggcagctagcttgatctcaattgccgtcgatatatgcgtgtcaaacaaaaatatgcgaagatcaatatgtgtgattaaagatcaatctaacaaatatgtattgaaacaacaaacccggttattctcacgatgtcaaaatccagctgaagcgaaggaccatgccggagatgaacatgatactggtagcactagatattaattccatcacactttgttgatgggaaactgtcacggcagcaacatctgtagcagggagttcaaagcagaagccagtgacccagcctatgaatcggcctagacgggagaagcagcccaactcccatttccctgcaagtgtgtggaccaaatagtaattggctgggccactgtcagtgagtgagagaggctgtgtagtgcgatgctatataagccggcaggattgagaggaaggggatcaaatcatgtaatcgaacaaactcaaattcaattccatctctctcctgttcaattctgttctgttcttctccttcttcttcttcctcaagccatctctctcaatctctttccttctctactcgaccgaatctctcctatgaattcgagaccgtgacaatttggtatccagagcaatttcgatcctggagaagccacgatatacttcccgtttgcaacttcaagtcgaagcgatggaggagcagaacattgatttcggcaagggtgttgatggagatccaggagtccttggtgacgctgaatcgtgctcaaggcgaaactcaagcagcgctcgtcaagctagatcacggagtaagcagttggagacctcaagtagaagcagcagttcaggagctacatgaggaagtcggcgatcttcgtcagcaactggatctcgtcggcaaaatgaagcaggcttctccggtgatgtcttcccctcgagttccgttgatggacgaggaaaggaaggcgccgccgctgcctacgccgccaacttcatctcaagctgccacggcggaaggtggaagcaaagtggccggtggctgactgcatgctcatgaacaccggggaagggtactggggatgaacacaaccctaggcccgactgcggtcaagggtgcgtatgaatctccttccacatctctgaaaaattttgatcaatttgagtttgggggtggggaatatgatggggatcagtttgggcgtcagtataatcacagggttcctaagttagatttccctaagtttgatggaacagacccagaggattggaaaatgagatgtgaacatcattttgatgtgaataatacttttccagggttgtggattagaatagccacaatttatttttcgggtagggcagcttcctggttacgatcttctaaggctcatgttagatttcctgtgtgggagaatttttgtattgctgtgtcacacaaatttgatagggaccaacatgaaactctcattaggcagatggatagtattaagcagacaggaatagtttgggagtattatgagagatttgatgaattaatgaatcaattgctgacatatgatcctcttctgaatatgcgatatctaacacatcgttttactgagggactgtgtcgagaaatcaggaatacagtgctgctgcaacgtcc

SEQ ID NO: 16129 - DNA, 7021 bp, Oryza sativa
tgaatggatgactcaaggatgggtgttttatactgacttaaaggtgttaaatctgggaagctattaacttattttaagccttgattgggtgattggtattatccctttccgggtgaatggggtaaacaaccttctttgccagctttctggaaaaaaggatccattcctttacagggtttttggtcaaaaactaccagggtcttcaacctttttttaacaagttttggaatttaaaggataaccaggcatttttcaacctaatcaattgtgcccactatcaaaatcttcaaaccaagaaccaatgccagtggaaattcaacaagtgctagcagaatttgcacaagtgtttgaagaaccttctggattaccaccgttcaaggtttttgatcatacaattccactcatgccaggagctactccagtcaatgtgcccccctaccggtatacacctgctcaaaaggatgagaatgaaatgccagtcaaggaaatgttaaccaagggtatcattcagccgagttccagtccattttcatccccaatgttgttagtcaagaaaaaggatggtaccctgcgtttttgtgttgattacacatttgaatgccatcacggttaaaaataaataccctcttccgattattaatgagttgcttgacaaattgtcaggggctcattggtttactaagctggatttaagagctgatgaacataagacggcatttaaaacccatcatggtcattttgaattcagggttatgccgtttggtcttactagtgctctagcaacttttcaaggctgtatgaacaatgtcctatctcctttgttgcgcaagttttttctggtgtttgtggatgatatcttgatttacagtaagactcttggtgatcatgttaaacatcttcaggctgtcttgcaaattcttactaaacatcaacttaaggtgaaaaagagcaaatgttcctttgctcaacagagattagcctacttgggtcatattgttagccctaatggagtatcaactgatgaagagaaggttcaggttgtcaaggactgaccaattccaacatcagtaaagttgttaaaggggtttcctgagtctgactggatattaccgcaagtttgtcagacattatggcttgttaagtaaacctttgaccaatttactacgaaaagggcagctctatgtgtggactgcagaaactgaacaagcttttcaggctcttaaacaagctttaatcactgctcctgtcttagctatgcctgatttcaatgaaccttttgtggttgaaactgatgcttctaacaagggaattagggctgtttcgatgcaaaagaatcacccaattgccttcttaagtagagctttgggtactcgacatcaaggattatctacctatgaaaaggagagtttagcaatcatgctggcagtggaacattggcatccttatttgcaacatgctgagtttttcattcgtacagatcataggagtttatcttttctggatgatcaacggcttaccaccccatggcagcataaggctttaacaaaattgcttggtttgcgttataaaatcatctacatccacctcattctgttcttgaacttgtagctgtttcttcagttgttccagattggattcaggaagtcattgctggttatgattttgaccctgatgctttaagtaaagttcaaactctttgcatcagtgcagctgcggtcccaaactttactctaaaaggagtgctattttccagaaccaggatgtggataggtaccattactttacttcaccaaaaaattttggctacctggcatactgccccagtggggggtcattcaagcttccttggtactattcaaagggggaaacaactatttgcttggcctcacttgcccactacagtgatgcgggttggtactgcttggtctgtttgtcaacaagccaaatcagaacatgtcaagtatctaggaatgttgcaaccactgcctgtacctgaacatgcttggcaagttgtttctttggattttattgagggcttaccaaagtcagctaccttcaattgtatcctgggggtagtcgacaagttttccaagtatagccattttgttcctctttctcaccctttcacagctatggacgtggccgaagcttatatgcagtttattcataaattgcatggattacctcagtcactcatttctgaccgtgataggatcttcacaagcaccctgtggactactctattcaaattggctagtacacaactccggttgagttcttcttactatcctcaaactgatggacagacggagcgagtgaatcaatgtcttgagactttccttcgctgctttgtgcatgcttgtccttctcagtggagtcgatggctggctctagcagagtattggtataatacttccttccattcagccttgggaactactccatttgaagtattatatggacataagccacgatattttggtttgtcagcaaatgcagcttgtcagttgtcacgcccagaatttctatccaaaattccaaacgcttacatgtgtgtaaaccctcgtccaggaatcacccgaggcacacaataacaaattgataatagagtgcaattattactctaattaataagcgaatataaagtcattacagaggtagatagttcctctcaaacaataaagttctaagcagcggaaaataaaataaacagcgtaggcgactccattccacaagcagcttgaccagggctacgcctaatcctccacaccttcagcatcactatagaactcctcctctgatgaatgattgcaaggtgagtatatgacatactcaacaaaccacgcagcaaatatgcaagtgcaggggataagaaaggaaggcacaatatagtctcatttgcataaatggcatttaataaatactttagaatttaataaaacagtaaagtatttaattaaacaatattaatccaatgctatacaacatacccgttgcataggcccaccattctaaacaaccattcccggctgcacagttctatctccaaaccaggaatataccattccaaaccaggagttaaacaagttattaccaattacagcatcatttattagggtgagaggtatgagactaatcacgaaagacattgttcgacccgcccataaccgcgggcatggctattcgaatagtttactctggccagaggtgtaccactgtacccacaagacacaacctcaacatcacgtcaaccatgcgtcgcgatacttaacaagtacccgaatagagattgtgacaataccctctgcataacataattcaaagcagtgcaccattcctggatcataatcaccccccttataaacaaggcatagactccccagcgacccccgtgggcttatctctgccacttcacagtctggtgctctacaatgaaccacagtatacaaaaggtaaagccgttgcccacgctggcttgtggttggcagggttaatgtttcacaaccgaaaatcgtgaaccgttccttaattgttatgagcacgaccatcaaaaccatgtgctcacaacccaccattaccatattttagttggcatcttaattaatcaacctatcatgattaaccatcatgagctatcattatccatcattaagtaatagtgaatcattagttatccattcatatgagctagtgtctctaagcatggctaagcatcctaattactttagctaaaaccatataatgttctagcaaatcaaattattaaacaggtgacaaagaataggtaatcaataatcaaaaggctatagcaaaggcaataggttattcccacccaatgacattcaaaaataaatgcaatagttgaatagaaacaatagctttaaacgggatcaacatgctcaaagggttgtttgggatctgtgtgacttgccttgctggccttggaactcttcaaaatcttctcctacaaaatcggtctctccgggaacgtcggaatctaagcataaaagagcaaaatcactaaaacagtacataaacaatcataaacagcacatgtggacatttttaacatgtagatctcaattttagaaaaatttaaagacttgaaccaactaaatctgagctaagatgaattagttatgaatttttaaagattaaaccggattaaatcatttatatagattttaattgaattatgagcaataaagaatcatttttgaaaaggaaaaaggatttattgtgtcagcgggctcgggttcacggtggacttggtgcacgggaacggtctacggaataaacggctgagatcgattcgatccaccgcggtctacggatgacgcggcgctgacgtcgacgatgacgtcatcaccggcggcggctcagcacctcgcgctcgccggcgaacgacggtgcagcgccgcaaacggagggcatctacacatagacggcgacgcggcgaactcaccgagggctcggacgacgacggacggcaacggatggcaacggcggcgaggtcgaagcggtggaggcgttcgggtcgacgatgacggcaatgccccggcggtcttcggtggaaacagaggacgggacgaggacggcgacgacttggcgatcccgacggcggccttcccgagtgacgacgatgaccggagcggcggcagcatatggctggactcgcggcggcgacggcggcgcacgggctctagtggctagggtgctacgagcggcgagaagataaggcgagggtggcggcggacggaggaggtctcggaggtccttatataggggctagggggcggcggtggaggcccacggtggccggcggcggcgatggaaggtttagggttatgaggaaagagatgatccgaatcgggctgaaatccaccgatttccaaacaatattagccgaagattccaaaagagaaaaggaagaagagatcccgaggatcatttcccctctatcaattcggccggattgggaaagaggcgatggaatttggaagggggcggcagcggcttgcgcgcgctagggcgcggctacggcgagaggaggaagacggccctgataggtgggccccacctgtcagcgggagagaggagagagggcgggcggctcggcttggcgggctgacttgggccgggcgcgagtaggctgaaggagagggagagagacttgggccgactttcggcccgaagccaaaagggagattttaaaacctttttctttttaaattattcatgaaatgcaatttcatttattaaaaatacttccttggctcaaataaatcccagaaaaatctaggaactatagaatcaagtgaagtatttaataaaattttatctagcccacttttatattggaatttattatttaaaattagatcttttcttcaaggcttttaaaatcatttctaataattccatttaaacaacaatttataaatttaagatttttagggtgtgacatgagtcgactgagttaattgactggttacatgaaagggagcagattcagagtttgattcgggatcatttgttgcgtgctcaagctcgtatgaatttcaggctgattaacatcgctctgagagaacattttctgtcggcgactgggtttatctcaaattacagccgtttgtgtagcagtcagttgtcactcgcgctaatcgcaggttggcttttcgtttttatggtccttttcaggttctctctctagttggtgaagtggcttacaagttggctttaccagctaccagtcttatatacccggtggtccatgtctcacagcttaagaaagcattggtgccaagtaaggtggtgtattctcaattgcccagaattcagtccactgctggtacatcagttgttccatcgcaagtgttggatcgttgcttcatttggaaaggatccaagatggtggagcacttgctggttcggtggtctggagacgatccgcatgtggtcacttgggaaaatgatcaagaacttcgtcgtcgttttcctgactctgaagcttggggacaagcttcgaccgcaggaggaggggatgtcacggcggcagcatctgtagcagggagttcaaagcagaagccagtggcccagcctgtgaatcggcctagaagggagaagcagcccaactcccgtttccctgcaagtgtgtggacccagtagtaattggctaggcaactgtcagtgagtgagagagactgtgtagttcgatgctatataagccggcacgattgagaggaaggggatcaaatcatgtaatcaaacaaactcaaattcaattccatctctgtcctgttcaattctgttatgatcttctccttcttcttcttcctcaagccatctctctcaatctctttccttctctactcgaccgaatctctcctacgaattcgagaccgtgacagaaactcggcgaagcccttacctggcgcgccaactgtcgaaacaatatttcagcaatataaagagggtagcgcacgagacctaaaagtggagggatgcaaagacaaaggatttagaaaggttcaggccctctcaatgagaattaataccctactcctatttggggatttgaatccgccgagtgtattatagatctgacgatctgattgtatgtcatctgccccctagagagcatcctgcccaccttatataggatgggggcaggattacaagatagaaacccttacccaatacgggatcagtttcctaaatttactttaccatattatccaaccaggactaaaggccattccataatatataaggaaacgtattacccaagtcatgatttattacatattccatagatataagttatcccctgtaactagtcggataaccatgttatgtgggtatgggatacctataatctgagcaatctgtagcccaaaagccacgaaagtaaatagcaggaatccatggcttgatgatgggacatgacaacacgatgccgacaatgtcttgcaccacgcaggaaccggcaaataactaaggcatggattagtttctaact

SEQ ID NO: 16130 - DNA, 21647 bp, Oryza sativa
caagaatcggccagtatacgtcatcacaaaagtacgatcgacaaggaagttgcaccaaaagttgctaacctaagttgaaactgtcaattttttttctaataaattccacccggtcgtcatacgtgagagaagtatgtaacccgcttctactaactagaagcattgattcgtcaacaaatttccaaagaaaatcaacatactgaccatccgttttattttaaaaatttataaaataattaagaaaaaaaataagtcacacataaattactattcacgttttattatctaataatcataaaaatactaacaatcaaaaaattcaaataagacaaacggtcaaatgctctacaatgaaacccacaactgcgaaagggcctgtagcctagtggttacaagagcatcaatagcacctgaggtgttgggttcgactctttatgggacgaatttttcaggatttatcggcgttgtgctttcagtggtagacggtgataggcgacgtgcatgtcgacagcgaggcgcctgtggtgacttcgtcaatctctaaaggagaatttgccggcctagtcttcaaagatactcatagaggtagggtttgcctgtggtgacttcgtcaatctctaaaggcggatttgccggcctagtcttcaaagatactcatacggcccgtttggttggagggagtttttttagagggattggaagttcagagggatgaggctattaactgttttgtttggttgggaggcatgggaattttggtaggatgggaatggggaattgaggaaggaactccctacttttcaatacctggtcaatctctaaaggcgaatttgccggcctagtcttcaaagatactcatacggcccgtttggttggagggagtttttttggagggattgaagttcagagggatggactataaagtgttttgtttggttgagagacgggaattttggtgggatggggatggggaattgaggaaggaactccctacttttcaatacctgggtaggagcaggtaattgagagggaattcctcctttactttgtctaagcaaatctcagccatccttttttattaatgacctaatctccaactaaacttcctatcaatttctatcacctctaccaaacaaggtattagtattaaaaatcaaattcccatcttaatctcatcatcaattccctcgtgtaaattatcaatccccttccctcgagttaccaaacaagccgatagggatagggtttgcgtgtgcgtgtgtttataaaggtgagtgtgtatgcattgtaagtatctgcgttgtactgtgtgatttagaaaagaaaagaaacccacaactacacataaaattggacggagggggtaataagcatgtgcgtaactagcaagctagctattgtaaagcttgcttgggaaggattaatatttaaacatttaactgtctgactgtctgttttggataatctccataataaaatctaagaacgagacttctgcagacacaaaagaagaatctaagcacgccttatctgtagttaagcatgaaatttccaagcgatctggttaattgtcttcccaaatggttaattgatccttaatttacttcgtccgaaatcaacgaagtctcctgttcagctcggacgtcgtccgttgttgccgcgatcgctaattagcgcatacgcgctagttatttttggcacacatgtacacgtggagcgaactatcttactggcagtgtcgtcagaaacggaaaaaaaacgtgattagcacctaattagacccagatcagtaacatcattcattccgataattttccttctccgggtaattaaccgtatcacgttcacttgctctttttttttacttttcaaatatatttaagactttcaattaaaatttttaaaaactctatcccaaatttaaaactttggacacaaattcaaaaacattcaactcaaaatttaaaaacattcgactcaaatttcaaaaagtttcaactcaaattacgaaaactttcaaatcaaatttcaaaattttcaactcaattttgagatgaagttttaaaatctaggttgaaagtttcaaaatctttagtagaattattttcaagtctggatttgaaagtttcaaaatctgagttgaattttttaaaaaaatttaagttgaaagtattcaaatcttgacttgaatttcaaatctgagttaaaaatttaaaacaaattttcagttaatagttttcaaatccaagcaaagagtttttaaatctaacttgaaagttttcaaatataaatttaaactttaaaatatgtacttaaaaaaatgtcgaacctaggttgaaaagatttcaaatctcgatttagaaattttcaactatgtttgttttagtaaaaaaaaagaagaagagaagaaaaaaccccccttaaaggaattggttctggaaaaaaatgaaaagaaaaaacgaaagaggcacggaggttttttttttctgatacggaacgaaaaacggggaaaaaaatccatagctttcttccttccccccgtgctcgcgacttccgtaatcggtgtgtatgcgctaattagccagccgccagagatctcaactattaatgccgcccgagttgtagggataacagagggtgcaggctgcacagtcgatatttcaggtagtaaacgtcccaaaataactcaacctacgatttttatgatgggtttccagatttgttgttgatgggtcatatctcataggtaaatccatcctaaaaataaaatcgaaggttgagttattttgggacgaagagagtaatttagaagcggggtcggctagagttgggatgaagataagcttatttatgtcgtggaggagaggtgatgtcatcgcggcgccattctttctctgtggaagttgtgcatgcgtttactgacagcctgactgataatagttgttcaaattaatcaggattgttggatcttgaaccatcacggataaaatttatgaagaatgagaaggttttttgaaaaaaaaaaatatatatgtaatgtaacatcccggcctagggcttaataagattaatagaatacttatatcaacaagttgcaacttcttttcgggaagccaatctccaaagaactctagggttaagcgtgcttggcctgaagcaatttgggatgggtggccgaccgagaaattctttccgggtgcacacgagtgaggacaaagtgttgcagaaaagacatgtgttggtctgtgagggcagtttatgacctatgaaagtctcctatcctacgacttatagaatatacgagtatggtatacctttacgtacacaggttgtttccgtatgcgttgtaggaatctgttacgaattatagaaaatatctctacgggccgggtgatttacaaagtcctacacggaggggatacagcttctattgtgttgtacgggatccgatgtctccaagtcttacttggagatcaagatgatccacggtataaaagggacccccgtggagggggtgcaaggcatcgaatctcatcgccaacacacctaccatagtttacgaagccgaagtatgcggagccaagtcgccgggagatctcgtcgaatatatcgactacgatctcgtcggtatcatcgaattcgtctacttccattgtattatgtggttttccataatcaatcccatgtaaactagattagggctattacccgataaggggcctgaaccagtataatccttgtcttttgtttgcttgatgtcgtattatgtagatcctcattccaactaccccaatacccaactcatccggtctacgagtatcactcgtcgacagtggcgagccaggtagggggccttggtgcccaaggttatgctagtatgacttcaagccatgccgacaacaatgtcaacactggtgtcaatcaagaagcttctatctcgacatcgctggtgtggactcaagtcggatctattgtctttctagtctacaccgttatgccaatctcaactggcccaaaattactatcgggaacgagaacggtgcggttacgacttcgagaaatgacatcttgccgacaattccttccacacaagtggagaacggaatatcgacgaccccaacacctagaaaaaatcctcaagcggccgaattctgtgccccgcatagaaactaagagccgacaaggatatccatcaagaagccgagatcttcgtgtcctatccataaggcatccaagcatactctagaggactacccagtgatactacacgtgaaggctgagttctacgcttgtagagaacatagaattcagcgcacttcaccaaccaatatcacctattgtccaatccataagtctagatctcacaatttcacgagctgaatcttccttaggacgatcaagtgccatgctcttagatccaacaaccacgagttcaacctcagtgtgttgccgaggaacgggacgcagcgacaacctcagatcggttcgtgggatttgtcgatgttgaccccgacgagtcacccgtgttgcatattttggaagaccaagagtcctctccgtcgatttcaccgcgagacgtcaacgtgatcaatacagctgagaccagcacgtccgcggcagctaggacgcctgctcaatagctacaagccctcaactcgatattgagagagccctttcgatcctggcctgaaccctgatgttgattagtaggcagtacgactataagagaccatggccaacctcaatagcgcatttgtagaggcagcaactgagcccccgttgcgagatccaccacgaggaaatagagaactggctaatgggaacgcaaaagtataaatccctactggtgaacgttccccctatgctcaatcgccacgagcaacctgagatcccactccaccacctcgcgaaaatacgatcttcgtgagcatctggacgaccgacggagagaacgtcgggatcagaacaacactgatcgccatcgacatcgttctccctcacgacgaagagagaacaccaattgacaccaacatcagcgtcattctccttcgcgacgaggagagaacaacgatcgaggaggacgctcgaacgaagatcgagactagcaagcccgcaacgaccatcatgacaatggcaataacgttcgtcgtgacggtggcgacaacaatcagttagatcagggagccgacggtcgagctcagggtggcaatggttgagatcaggggcgaggcagtgatgatagacgaggacgtaatcctcgattcccaggatcggaacgggaccgacgatgcgagcatcgttctagaagtcgagctcctgacccaagcaacccctgctcatcatcctcgccatcctcttcatcaggcagacctccttgatgacaccacgggcgcgaacaacccttcgctctaggtggcgggtgtagagcgtccacccctacattgcgagacgtgcggcggcccaaggagttccgaccaggagcaatcgagaagtacggtggaagcacggaccccgaagaatttcttcaggtctaccccacgatcctgtacactgctggtgcagatgacaacgcgttggcaaattacttaccagccacgttgaaaggatctgctcgttcatggctggttcatcttccgccccactcaatctcctcatgggaagacttgttgatgagagatgttttgtcccgatcttccgataggtactgataaatagtcgatataggcggagtcgcgacacaactcgatccggcttctgaatgtacacgctactaagccccgcaattgcagcaccatgtctcctctagttatcaaccgtgccgaaacccggttgacctcaccaagaaggctaatccctgcatgtgaatcgaagaacacaagtaataacaagatagattgcaacacaattgcatatgaatgattaagcactcgaacttagggttccacaaaccgatctagcggtgaaactgttcttgacagattaatctaagcaacacccaaatctaaacgatgacggatgctgaataaatatgattaaggatgtcctagggttgccgtagggcgcacacccccttgggctaaggccacgacacaattacaaggcccaaaacacaaatcagattcggactggatgagatacgttgcttgttttgcagattcccggcagctcggttggaattttgacgtgggaccaaaaccatctgaaagtagactccatatgctttccaacaagtctaatgggccccaaaattccttctcgatcagtggctaggtccgtttgaagttggtgctgtcaaaaggcccgaatccgaatccaaaacgtgtagaactttatctcttatcttctatatatggaccaaaagtgacatggtgagatgtaagtggacttggagaagatcttggtttggtccccaatcaacttttttaatcatccatatattccttacgcttggtcccttttctttcgcccaagcaagtacctctgcaaacgaaaacacacgaaactcattgtgtagcaatgttgttcaaatatataacaaataaatctaatagagaatatatgcacctttggttgattaatacataaggtagtcatggttatatctgagctagttgtgtcctcatcacttgtggcagcaattcatcaccaatttccaagggacatacaagcgtcacgcaatcgaggacgacctgcacgctctaactcagaacccaggtgaatcattgagggactatatccggtgtttcaatgagtacaggaatacgatccccgaaatcaccgatgcttctgttatccacgcattcaagtcgagcgtctgagatcgttacatcacctaggaactggcgacacgatggattatgtctgctcgcaagctgtttgaaattatcgacagatgcgctcatgcagacgatgcctttagacgaaaagaatgaaagagcaagacaggcgaaaagaagaagccagccaataaagacgcactggaatcaagcaagaggagaagtcataagagtgggaagcgcaaatcttcgggagaggttctcgctactgatcaaacagacccacccaagcgtccaaacccccaaaacgatgactcacgaaaacaatgttgccctatacacaaaatgaacgaccactccttggaggattgtcacgtcttcaagaaggagcttgcgcgacatataggaatcgagaaggggaagcgagtatgcggttgtcgaagcgaataccgaagcagccactcctgacttcgactccacattcccggactatgacctcgacgtcacacacatcttcggcggttcttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagactagggcgacgaccacaggcacttgacggcaggcacgagctagacaccaaagccttcatcatccaggggctcctcttctgtgttgggaaaaaattgagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtgaacccacacaaacctgccttaaccccaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccacgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagactggtccttatatggccgaggtgctactgtcaaaaccatgcaccccgagcccagcctaaaaccattttgagggttttgaatagagggggaggtgtcaatccaattccacaataatccaaccattccatagtatccaggtgatatgaatattcccaaagtctagagttgtaaaaccacctaatgttgcctaattaaccagcgaagcatctacctaaaatcatactagtggtaccatgagtagagtgtccactagtttgtgttttgtttattctagggtgaacaaggtaataataacaataacaataataaggtcataacaagggtacataggcatggctagataaaacagtgataacgcgggaatttaaataaagcgataatacaataatttaaatcaaaataattttataaactaggattcaatatgttcaaggatgatgtgacttgccttgctcactttcccaaacgtcgcttcaaccttcacgaagagcggatcttccgaagctgcagcgtctacacgaccaacggaaaataaaagggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatttggatttattgcgtcagccgaggggaggggcgcgcggaccgggtccacgggagtggggcccacgcggcagcctcacggtccacggtggaccgggtgcacccggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccacgatggtcgccgccggcgaccaccggcgcggcggagcggcgcccgagagagggaagggaagggggaaacgaatcggcggtccacagctcaccccgggtcgacggcgacaacgggaacggcgaccggagcggaggaaggcggcggcgcggctcgggtagacggggacggcggcgttccggcggtcggcgagcgaaacggaggggtggacgaggtcggcgaggttgcggcgaaaccgaaggaggcggcgccgaagcgggagaaggtccggggcgacgacggcggcggactggagctcggcggtgacggcggagagagagagcgatggcgcgagctcgattccggcggagagagagagcggcgagtggcggaaacggtggagggaggcacggggagtgtttatatagggttgggagtgagagagggcggccggatgagggggaaacgggcgcggaagatccggccgccattgatgcgccggcgaggtttagggggaaagattccgaacgaatccgagggagagagggagggaaaaaatggggggaaagagggagggaatcacggggaatatttcccccctcttgattgcacgcggggcggacgggagcggcgggatttgcggcggcggcggcgctagggcacgggcgaggcggcgggagcggcgggaggaaggggatgacgggtgggccccacccgtcagcgagggtggcggacgggcccgcccgtcagcggcgcgcgcgcggggaggaggccgaatgggccgcggggaggaggagagagagggaaggagatgggccgagccggcccaagagggggagggggggaaaagactttttaggatttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgtgggaggctttcacaaggattttaattattctaggcataatttcgaggatgtattttagagtcattttgggacgcgacaaacctaccccccttaaacggaatctcgaccccgagattcggaagaactgatgaagagatcgggatgggctgccttcagctcgtcttcacgctcccaagtagcttcttcctcggcgtggttgctccattggaccttgcaaaaacggattacccggttcctggtccttcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttgcccaaggaggcgggcagctccaactggtaagcgacttctccgcgccgagcaatgatacggaaaggacccacaaaccgaggtgcgagcttcccctttgtctgaaacctgtgtacacctcgcaagggcgtgacccgaagatacacaaagtcatccactgcgaattccaggtcacggcgtcggttgtctgcataactcttctgccgagactgggccacctttagattatcccgaatggttctgactttagcttcagcttctctcaggatatcggtcccgaacacttggctttccccaacttggtcccacaatagcggtgtccggcatttgcgcccatacaacgcttcataaggtgccatttgtatgctggcttggtagctgttattgtaggagaactcggcataggggagactcttatcccaggtattcccgaaatctaggacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcggatacaattttcttaggaacgccatggagactcacgatcctagcgaagtagagctcggctagtttgttccctccataggtggtcttcacatgaataaatcgagctaccttggttaatcgatccacaactacccatatagaatcatatccaccttgggtttttggaagtccggtgatgaaatccatcccaatttcattccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagcggctttaccttgtttcatattcttgaggagtccatgcatgtccggatcgttcttctgagcctcgcggatttgatcgagcaaggtgggcttggcttccaacgcagccaagaatccgcgacccactatgcttagattcagggcttccatctgttgattaagttcgggtggaatgccacggacgttaagagtgttgcaatggctttttcgactttgagcatcggcgaccacgttggccttaccaggatgatagtgaattcccacatcataatccttgatgagttctaaccatctcctctgccgaagattcagatccgactgggtgaagatgtatttcaaactcttatgatcagtatatatttcacagcgattcccaatgagatagtgccgccagatttttagagcatgaaccaccgcgggtaactccaaatcatgggtagggtagttgccttcatgaggccgtagctagcgtgaggcataggccaccacatgaccgtcctgcatgagcacgcaccccaatccttggcgcgaagcgtcacaatacaccatgaagtccttgcgagtatccggcaagattaacactagtgaggaaaccagcttttctttgagagttttgaacgccttctcgcattgcggactccacacaaatttctcctctttcttcaacaactgtgtcatgggtcgagcgattttggagaagttctcgatgaacctccggtagtatcctgccaaacctaagaaactgcgaatttgagtgactgtcttgggttgcttccaatcggtgacggcggtcactgtttcgggatccacagcaactcctttagcggatatcacgtgccctaagaatttgacttcggacaaccagaactcatacttgctaagtttggcatacaattgatgtttccgcaactttcccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccagaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagttctcggatgtatataccccttttctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacgtctccgaactctctgacaatggggatttctgacagtcctatctgatgaagttctgaactactgacagaggttggaggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgagtagagggttcctaagcctttctacccccaactgatttctccccacgaatggcacagatataaacgagtgggaagctccagagtcgaacaaaatggtagcagggatggaatggatgaggaacgtaccaacgatgacgtctggagttgtcagcacgtcctcggccgtcacgtggttcacacgaccccgaatgacatccttaccaccgttgttggagcagggaggcgcttggccttgctggcgcctcgacttcgggcatttatccgcaaagtgcccgggctcgaagcagttgaagcacagacgctgcggaccttgaacgtccctgcggccttgaccagactgcgcggctggcgtaggaggacggggcgcatgggtcccttgctggctctgctgttgctgcggctgtgggacgcgcaccacgaattgaggtcgaggcgcggagcgaggttgctgctgctgcgaggaagatccccctggatagggattggtgtagcggatcctttggttagcaccctgttggttgcggaaattcgccaagcgacgcttgtgcgactccagttccttgtgcttggcttccaagcggatgcttttgtccaccagacgttggaaatccggatagtcaccggagactagacggacagacagctccgggtccattcctgccaagaacttctcttgcttctcctcatcttcccgcacatcctccggggcgtaccgggccaagttgttaaactcatgcaaatactccatcacggagcggttgccttgcttcaactctcggaactcccttttcttaagggccatgactccggcgggcacatgggtcctccggaaggcggcggtgaagcgggcccaagtaataggctgcccctctggctgcgtagcctggaaatgatcccaccatagagatgcgggtccctgcagttggtgggcggcgaagacgactttctcctcatcgctgcactgcacagtgtctagctttttccccacggcatgcaaccaatccaacacatccacggggttgttggagctagagaaggtaggtggacggatgcgtaggaactcggcgagtttagagtgttgtgggggtggtggtggagcattatgttgtggcggattttggatgtggtggaggaaagcagccatcatgttggcctgctgggtgaggatttgggtgagaatggcgttggtgtctggtggtggtggtggaggcggtggaggaggtggaggtgggctgccatggttgttgtggttgctgccttcaagttggttgccatcactggtggcagcatttctcctggtcgtcaccatctgaaaaccccacacagaaccagcaaacagagagagctgacaattaaagctaaccatccacgactaccataactcttgaatttattactgctattaaattggttcattaaagttcaagttgcttaagcaaataaaataaagacaggcttcgacacagttatgccacacaccggcataaccatgccccacaagaccccaacaagaagacaaacgagaaagaacacacgcgcaagcctactaactgctcgtctaccgctgcgacgggccaggacggaaggtgagcaacagcgcatcctccgtgctaccgacgctggaggcttccccctcctgaggaaccacgggcgcgggctcggcacgaggggtctccacgaagcaagtccacgctagggactgacgaacaagctcgggcctggaggtgctcttgcaggcggtgatcttctggctgcggcagacgcggcgacgcttggggtgacagacctctccctgggcgatcttgagctgatgcagctgcgcctccactgcgtctaggtccttcttcagctgcagattctcctgacgcagctccaggatcttcaggttgttctcgaccatcccacggcgcaccatctgatggaagtcgatacgagccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcagctcgtccgggtagcgctggtgaagagtgccgatggcgaggagagcggcgctctggcaagcggcggagaaagaatctccacccgcggtgactgccaacgaagtccgctcgggtgagccagtgaggatcactgcagtaacctcccaagaagcgtggggctctgcatcgtcaccctcctgctccggaagcggcctgccctggtagtccactccatgcggataccccaggacaacgcacataccccgcagctccaagacgaaaccagtcatgtccagaccacgacgactgacgctgccggccatctacaaacaaaaacaaaaagaaaagcaacatttaaaagtcagattttggcgataaatgaagcagcaggacagagagagactagagagttttcacaaatagcaaaggatttttatttttgataatattgctaaggcttgggatctacggctcatcctagggtcaagggggctctgataccaacttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcgtaagactagggcgacgaccacaggcgcttgacggcaggcacgagctagacaccaaagccttcatcatccaggggctcctcttctgggttgggaaatgtcgcgaccgagaaacttgcattttcccgaacgctagtgtattaatccctgtcccaggaaaagccggggtacaccatacaaacatgatataaaagacacatctttattatatcgataatatttacattattacaaaggcacttaaggcctgacaatcaaaaataaacagcagcggactagcggtcctacggcttcatcttcacaggcgctcaactggggtgtaagccaagactccacctaagacttcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacagcatttaaaagtcacttagttgcccaaagccattttaaaaagacgatcctagagctacacagtattatcaatcaaggtcgtgaacctgcacgaacctgccttaacccaaggcctacgatgattcagaccgaactggcaacccgaccctgggtcccagctcgtcccaagccaacccaggccaaccattccacattttcgttgttgagcaaattttaagaattaaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccacctacggccggaacccccgggacaggtaggcaggattgagcccctagcagcaggacaccagccctgtgccatgacatctcgactaccgggccgcagctcgtgtagccttcatttgtcctagagatgtccatcaacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaattagcgaagcatctacctaacatcatactagtggtaccatgagtagagtgtccactagttggggttttgtttaatctagggtgaacaaggaaataataacaataacaataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttagggaaaaattagagacttgaacggtccaattccgagttcaaatggccaagttatggccatttgaagtttatatgctctttaaatgaatatttgtgaatttcttcatttaaattttaatttaaaatggatttattgcgtcagccgaggggaggggcgcgcggaccgggtccacgggggtggggcccacgcggcagccccacggtccacggtggaccgggcgcacccgggctcacaccggccggcgccgtgggtcccacgcgtcagccgcacccgagggcgcgggcggctgatagccgggccccacgcggcagccgcacggtgcgcccgaaggcggccacgccggcgcagcggcgggaggcagcacgcccgcgcccctatggtcgccggcggcggccataggcacggcggagcggcggccgagagaggggaagggaagggggaaaagaagcggcggtccacggctcaccccgggtcgacggcgacgacggaaacggcgaccggagcggaggaaggcggtggcgcggctcgggtggatggggtcgacggtgctccggcggtcggcgagcgaaacggaggggtggacaaggtcgccggggatgcggcgaagccgaaggaggcggcgccgaggggagaggtggtccggggcgacaacggcggcggaccggagctcggcggcgacgacggagagagagggcgacggcgcgagctcgattccggcggggagagagagcggcgagtggcgaaaacggtggagggaggcacggggagggtttatatagggtcgggagggggacagagcggccggacgagggggaaacggcgcggaagatccggccgccattgatggcgccggcgaggttaggggagaggtttccaaacgaatccgagggagagagggagggaaaaatggggggaaagagagagggaatcacggggaataattcccccctattgattgcacgcggggacgacgggatgcggcggattcggcgacggcggcggcgctagggcgcgggcgaggcggcgggagcggcgggaggacagggatgacaggtgggccccacccgtcagcgagggtggcgggcgggcccgcccgtcagcggcgcgcgcgcggagagagggccgaatgggccgcggggaagaggagagagagggggagggatgggccgagccggtccaagagggggaggagggggaaaaaggactttttagagcttttcgttttataaaatcattttaactttgtttatttcttaataattattatttgtgctctgaaaattccactaaaatttgagggctctttttagaccaaggagaatttaacaaaaattctccgggccacctttgaatttttcttgtacgtattttagtgtttgccaatttcttttcgaattttaattaattatattattccttttagaaaatgatttttatttcgggatgaatttatcaggacgtgacaaatccaccccccttacaagaatctcgtccccgagattcgaggaggctagcaagaagataggttgggcagtcttctcttcttgtttgacttcttccgctccgtcttcacaaactttcagcaaaacttcaccactcggaactgcttggcttgaccttctgttgcggatggaatcttctcttcacctgacttgaaccagggtgcaccttttagctgactcagactaggttgcggtagtttaatgatgcttccgttccagaacttctcatgattcatatcttcggagtcaacctcatacaagttaccacttcatgtcatgcgtcaacactagcttgtcattactaggataccatgtttgtcatcataagaatatcatgcttgtcatttacttctaacctgccaccaactgcctcatattagctttcctggtctccgggtgatagctacttctgctatttgatgcaagggtcgataactttgcctttgaattatgcttcccaagagaaccaacttatcccacttgacatactttgacgtcttcccaaatggctttactgctggatttgttattgtctaatcattatcctgccaaatctgaggcttcgttgttagatgtgattttaatctgacctctgtagattatcttcgaacatatcacttgattcataactgggaatagctctcacgaacaagcaactcggattcactttctttatgttcagtttactttccactattctcttcatgttgtcatcatttagcattcaacgtattcctttacaccttcagccttgatgtgttctttctcgatggatcgattgctaggaaagtgcgttgaacgatactagtgcaagtgcttttattctagtagcatctgatacaaagcccaaggttgaaccgagctttagattccactgttccggttttacttcttgacttcttggtcatgtcacaaaagtttccatccttgtccccatagaagtacttctacctgtggtcatctctcttactcgtgaattcacctactttaatgacagggcaactgttgtagggttgattgctatcgggagtcttcctcgagtgacacaaatcatggttctcgttatcctttatcaatcacctttcgtcctacttcttttcccagtaaccaaacatcttttccgatctcttccattaatcacctttcgacctttctcaaccaggtactcttcgctccgggtgttgaggatgcttctggggcaatgaggtccttgggcgtgctgtctttcagagaaaccttgaagtagttcgtcaaaagctagactgacgattgttgcctttgatccaaagaagacacatctgaaacacttagtccaaacatatgtctctttggttaatcacttgattttcttttccatcatcaggttggttattaactcaaggttcgaacatagttcctctgaaatgagaccctaggtctcctttatcagcaagcaattatacacataatcacatatccgcatcttccaaaagaatcctcatagaacttgtctgtattacacatttctccctcattacatgaatactaagcactgcctaaaaggaaaggtgcttagcatcggtacattgtttctgctatgggttctgattaacacgaggcctcacgggtacggcgtttgctccagtgaccacaatacgattgggatgtctgcttcgtgtaaattggcggtaatgtggaggtcgactttgccttgattgcaggcagtccctcgagtaatgccctggttttttgcaattgtagcaaatcaacgtcttttttgctgagctatccatctggggacgatcattttgacttggagttggaattggtggttggaaatccttggtaacattggcatcagtggtaccatagttgctatcaccattggagtctttttcagagtcccaattgctagggttgtcattttgggtgccatcattgatactatcgtcgacaccttggtgaatgatgttgacattgca

SEQ ID NO: 16131 - DNA, 2519 bp, Oryza sativa
catccttgtaggtaactcgatcgtcagaggcaatgacgattgtggaaacaatattttagcaatataaagggaatagcgcacgagacctaaaagtggatggatgcggagacaaaggatttagatagttcaggccctctcaatgagaggtaataccgtactcctatttggggatttgaatccactgggtgtcttatagatctgacgatctgattgtgtgtcaccttatataggatggggggggggcatgattacaagatagaaaccttaaccaatccgatatcggtttcctaaatctactttacaatattatcaaaccaagactttaggccgttccataatatacaaggaaacgtaatacccaagtcatgatctgttacatattccatagatataagttatcccctataactagtcggattaccatgtcgtgtgggtatggggtacctataatctccacagtagcccttgagaccttcacagtcgaaaagataatcttctctcgaactagattactccaaagccgagtgtttcaatcatcttcgccattgtctcctgagtacttttaccaaatcagaagactgtggagggctgaaaaataattaaatgaaaatttaggtgcatcgactagatgtacctaataggtgtagccccgactacgtggttacttgaacaaaccaagcatagtcaaggaataaataacatgatccgagtgatataccaactgctttgtaaaatatgatgcgcgcaacctaaagttgactacatcattgaaaataaaatagctataaagaagcttatatgctgtgaataaagaaatttctaaagtattgggcacacaccatgcacacattgctttaacagatgtgcttaagtctctaaaagacacatggttgcaccacacccaaaaatatatggcatatgtggtatgaaatccgagtaaataaactcataaaggatttaccaacagcctagaaaatgactggaatatataatcagcctaagccataatattggttaataagaaatgcacacttacgtggcaaaaaagcaacgatactgtaccaatcgattgcttttataaacccaaacagcgccatgacttatataaaaaagtcagcgggatagcgatataaagcctcactatttgataccttttaaaatgcattctaccaactcctaaatagttgagtaacagcggtataaaaggattttaaggtattgggcacttgatcacgcgcacttttgcctaagcaaaaaatgcctaagtccctaaaagaacgtgacatgccacacctgaaaatatgggttgtagacatattaggcctagacctaaagtatgtctaccggtgcccttaaaatatgacgtatagaacacaccaattaatatgatcccaagtgataaatatcctgggtgatgtagatcatgcatatctcatctgagtgggttctgatctgagtaattatccctcatggagaataccaaaatagatgtgataattgaatcccgactggcgcaagtactcagttgatggccctcgtgggaaataatgaatagtccaatcgttgagcatgaccatgaatccatgttgaatgtaaccagaataagtccgaactaaaaatatgatccttgtgtttgagctaggaagcccctatgcatgtagcttatccttttgttgtagtcacaaatgtccattgatggtagctgacacagttggcatgtagacgaaatgaccaacatgaggatgatatcacccatcaaagccggcggagatgttgatggtgctaaagacaatgacaccaatcaaaggtgacgaagtcacatagccatggaggcgaagaaaccagtcggcggcagacaagttagccaatagtgaagacaaaggcgcccagcaacggcgacagagttgtgcagctatggcagcgaaataataagtcgataacagacgaggtgcccggtgaagaagacgaagacgtccatcagtagaggcataataagcaagccgtgaaaacgaagacatcatgggtggcggcggaggcaagccggtggtgaagacgtggacgctcatcaatggcaatggcgaagtccatcaatcatgcaaaagaagaaaacaatcggtgacggcaaatgcaatcggcgataatgacaattggcggcaatagagatagccggctatgatgacgaagttgcgcatcaacggcaacagagtaggtatagcccaagaggcatggtaggatgttgatgaagataatggtattgttgatccaatcaagtagtgtagtagtcaatgataacgataaggtctcccatcggtagttgcatagcaggccaaccgtgaagacgaaataagaagtcggcgatgatagaagcaaccgaaggcgaagacgtcagggccgatgaagtagaggtgctggtgatgaagtagaggtgctggtgataatatcaaagcttgagtagtttccttgacggtagggtgtgggtattgtagattgatgcaacgcctttttatttatgaaaaatg

SEQ ID NO: 16132 - DNA, 677 bp, Oryza sativa
ttcggcgagagggggacggtggagtacgagctcgacggcgcgggttctgctccccgtcgtcaccgctagcgctcggaaagaggttgtgcgccactgcctgttcggccattgggctgagcgagggaagcttggcgcacacgaaagaggacgagggcttagaaagacacacgcgccccctacctggcgcgccagatgacggagcgtggggctcctcaccgggagaccgcgcatgcccccctttgccggttcggccgggggcgctaagtgaggttcttcaccctcgatctgtggaatgttcgtgagagagcaaatgcacaagacacgggcgatgtagataggttcgggccgctgaaaagcgtaataccctactcctgtgttctggtggatctgtgtgtgaaagagttacagagagccggagagcaagagagttcaggctttagaaccactcttcttctttctctcctctacgagctcaggtattctcagagtcgtctgagagtctctcctttttttttctcgtccccttgcttcggtgggcaaggtcctccttttatatctcaaggggataccacatgcaccatttttacctactcttcttttggatggggacccaccctatcttgaccaaaacttggctcgcgccttcgcctggaagctaaatcacagcttgtccttga

SEQ ID NO: 16133 - DNA, 1297 bp, Oryza sativa
ttctccgtgattccctctacctttccccccaaatttccctccctttctcccttggattcgtttggaaaccctcccctaatcccgccggcgccattgatggagcccgagagcgccgcgccggtttccttcccctccggccgccctctcccccttccaaccctatataaaccctccccgcgcctccctcgcccgtttccgcccttgccgcaccgtctccccaccggaatcgagttcgtgccgtcgccctctctctcctccgtcgtcgacgacctccggctggccttctccgctcgccgggaccgtctcctgccccggcgtcgcctcctccggcttcgccgcaccgccgtcgaccccgtccaccccctcgccgagcccgcggaccgccggaatgccgtcgaccccgttgacccgagccgcgccgccgccttcctccgctccggccgcctttttcgtcgtcgctgtcgacctagggtgagccgaggaccgccgcctcttttcccccttcccttcccctctctcggccgccgctccgccgtgcctatggccgccgccggcgaccataggggcgcgggcgccgtctcccgccggccgcgccgagtggccgccgcgtggggcccggccgtcagccgcccacgtcctcgggtgcggctgacgcgtggggcccacgacgccggccggtgcgagcccgggtgcgcccggtccaccgtggaccgtgaggctgtctcgtgggccccactcccgtggacccagtccgcgcgccccctcccctcggctgacgcaataaagcttttttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcccttttattttccgttggtcgtgtagacgttgcagcttcggaagatccgctcttcgtggaggttgaagccgacgtttgggaaagtgagcaaggcaagtcacatcatccttgaacatattgaatcctagtttataaaattattttgatttaaattattgtattatcgctttatttaaattcccgcgttatcactgttttatctagccatgcctatgtacccttgttatgaccttattattgttattgttattattaccttgttcaccctagaataaccaaaacacaaactagtggacactctactcatggtacca

SEQ ID NO: 16134 - DNA, 754 bp, Oryza sativa
gagtagagtgtccactagttgggggtttgtttaatctagggtggaccagggaattattaccattaccattattagggtcttaccaagggtaataggccttggttaattaaaccatgattaccccggaatttaaattaagcgataatgcaataatttaaatcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcaaatttcttcatttaaattttaatttaaaatttggatttattgcgtcagccgaggggaggggcgcgcggaccgggtccatgggagtggggcccacgcggcagcctcacggtctacggtggaccgggtgcacccggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatgg

SEQ ID NO: 16135 - DNA, 447 bp, Oryza sativa
ggtgcgcgttccacagccgcaggaacagcagagccagcaagggacccatgcgccccgtcctcctacgccaaccgggcagtttggttaaggccgcaaggacgttcaaggtccgcagcgtctgtgcttcaactgcttcgagcccgggcactttgcggataaatgcccgaagttgaggcgccagcaaggccaagcgcctccagacgttattggtggtacgttcctcatccattccatccctggtaccattttgtttgactttggaggttcccacttgtttatatttgtgccattcgtggggagaaatcagttgggggtagaaaggcttaggaaccctttacttatcaccacccctggaggggttatgacagcaaagtattatagtcctgccctccctatagaaattcaggggattccttttccctcggatatgatatttttagacaccaa

SEQ ID NO: 16136 - DNA, 454 bp, Oryza sativa
cgctcgctcctcgagctcagcggcacgctgatccagtgcggccctctcggcgcgggcgctttccagatcgcggcgcgcttactcctcccgcgctgccacgcggagggactgtccgccagccgctgcgccgcggcctcggcctcctcgagagctcgctcccgctcggtgagcgcgtcctcgcggaggcggagtgcggactcctcttcggcgcaggcggcctcgtgcgccgccagtgttgcctcccgggtggcgacggcggcctcgcggtccgccaggtccctctccttcgcgcgggcgcgctcctccagcaccgtggcgcgagcctcaagggcctcttcgcgctgccgggacgccgcctcgatctccgctgcccgccgttcccgggcagcgacggcgtcaaggactccccgggtggcgtcgagcttcttctctagctccgccgcccgactcccgt

SEQ ID NO: 16137 - DNA, 10557 bp, Oryza sativa
tcctgcagccctgcatgaaaagcgcacttacttatgaccatatcaataccaaagtttggcttacgattatgtggggttttttttttttgaaaaaacaactatcactacgagcaacaggccagatgtgtggacgttcggttagatggccaaactaataaatcatgattacaaaacgaagaggaacgtacatagattcttgttttattaactagctagccacctatacactcaagggtctgaaggctcttcaatagcttattggagaagacatcccttgggagaatctaaattaacgcataaaaaaatagaaaagtaacagagaacaccagcctgaaccctgttaaacagactgcagtggtccatctgagacaatagcaatgcataaacccgtgcaacatagaagtgatgatccaaggcagtgaagttatcttgcttgattgattgtcgttgtatttttgtggggacaaatcttttagttttagatcatgcagtccaatgcttatggcacgtttctgggtagcagtttccacattttatgcgaccaatgttaatacactagtagtatacttgtgaagtgagttttactctaattcttgcactttcagatttctctataaaactattccaggcctgttctagctgatagacaacagatgaaactaagtttatgacaattatttgaggatacaaatgaatgagttgactatcagaaatttgataagttgattttatttttttctaagaaatgttgatgaagaatgtttttttttgaaaaaaaaactgtttaggagattaggaaacgtgtccacgataatccataatatgtattgtcattagaatgcccgtaatacttgcattttgacaatatgttggttggcactaggtagtcagcttgtatctggcaaatccgaccaacagtatgttatgcaaaagttttttttgtttgttattatcaacatttgtttgtaaatccaactggtgtgtgccagtgttaaaacgttatagtcatgcgtggtattttgaagaggaatgaactgacgaagttccactgttattttatcgagaaaccgtttttttttcttgcaattatcaggcatctgcagctgtatggctcttgaattttgacttatctgcaacttaacgaatctaattgcagcaactggtttataaatgtctcgttgctggtcagaataatcaggcagctgacgtatctgtatggctgtatcagaggtgttagtccacttgacgcttgctcattttgcaagtactagtaggggctgtaggacaagtcaaagaaagcctggtagataaaagaggttaccgccaaatatttcaactcaaatcgaaagcaacttgatggaagcactgcatgaagattttcaacgagatgtctaaattattgcaaaatgacgaaggcatcaacaacgacagattcacagttaaaacataagtacatgtcacagcgttaacataggttgaaatggagctgtaacaagctgattagacccattaggtttgcgttattatgcagcatcaagttactttaggaactttgctataatttcgtaagaaatactaattccccctgttaaaaaaacatcttttttttactatgaatatggatgctttgggatgatactttgcttgcatgctgcagcattcaacgaaaagtctgaacatgcaggcagcaatgtttctacatgcctttctttctctgaaatattcggcaaagataatatatctgctaagaaatataaaagagtcacaatatttttaggccatgtttaagctactcctaaaatgtcctcactagctgaagacactcgtagggaaactcagctcgcaatgtaggatacccctagatgggctcctcaaaatctgaagtaacttaatagagacactccaacccataataggtattccaatacacaaagccccatatttatttttactaccctacccctaatctctctctctcccaccccctcttctctttttcttcgccaccatcctcgcctttccctctcgctgccgccgctcgcctctcccgtcgccggcggccgcgaggatgacgaggagggccgcctctcccgtcgccggcttccaccgccgcccctctctctctctctcacgtcgctgcccatcgccgtccttcccagcatcctctgccttgcaccgtcgccggttgggggcactagatccggtgctgtagtgggcaatgcggatccgtcttcgctgtcacctctctcttctctctctctctcattgccacgccgccggtgaggggcaagaaggggaggcataggggaaggaggtgggggacagggcaccgggtcgccccattgtgtacccccaatggagtagctcaggaaaagtgagctgaggagcccagagccacccgtcccctgtgtaggggtcacgctcgcgcctccctcctaggggacgacccgacgacggaagttggatgtcatttgcgaggctactctctaggggcacgcgttgctgatggcctaagttcccacacaaaaattttataccctgtcacatcgaacgtttgaacacctacatgaagtattaaatataggctaaaaaataactaattgcgcagattgcagctaatttgcgagacgaatcttttaagcctaattgcttcatgatttgacaatgtgatgctacagtaaatatttgctaatgatggattaattaggcttaataaatttgtctcgttatttactgacagattttgtaattagtttttttattagtgtccgaacacccccatgcgacatcatatataatacctgatgtgacacgacaaaactttacactccgtatctaaacacccccttattttatacgcaacatagattttgaaagcacgagagatgaatataaaaatcagtggccaaatgataggctgctagcgatatgcgtggcctatttctttttagaatcttcatagcttcccgagatatcagcacatgctcatgctcttagtcactctagagtctattactatacgctccctccatctctaaatataagtgattttggttggatgtgacacatatggagggagcagttactactaagttaaaaagaacaaacatatatacaaacctattttttatgagatggagagggtactctttctgttccaaaataattcaacttaagataaaatatgatctatcctaaaacaacaaatttgtattatcttagaatatgttattttgggatggaggaaatagttatccttgcgatctactccctccatctaaaaagggcaacctgcaaaaagatgtgaaacaatatagtacgatgaatctggatatagaggttcagagttattatactatattgtgtcatatcctctcatagtcctttttttagatggatggagcatattatagtgatatagtcatcccagttggctataattggaagtgattaatctggtcaaatcaaataaaagagaatatcccgtcttaaaaataacaagtcattttgaacttctcgagacccattttagaattttgactacctagttcagtataatcattatcataaaaaagttatttagtttgttcttattttttgcataagtgtaatattatgaaagctcttgttaggataaagttgaatatatcattttcatatacccaaaaagatattttgaatggtttttatggttaaaattaactctttttgaatgttcgtatttcaagcaacttgtttttgagagcgggggtatgttacttatttatttgtcatatcggatctagcccaaggaaaactttccttttatattggatcaatcacaaaaaaagcgaaacgtcgaactgaacgcaaatagtgtttctcctttcccttttcttcggtttgactacaggagtgataaaagcatatcggtccaaaatatctttcctacaatcatatttgtctcgcacaacagccaaaacatagcaaaattctaattttcattaccatgttcatatagaaaggcaatgtcgaaagcttcagataccaacgatacatttgaaaagtttaaaagttggattgaaacactcaatttttattttggtacaaagtgacagagcgagagacaaaaattactcgcacatctgaaatgtgaccaattcgatagattgctgcaccattttcatataaaattcgaactaaagcagtttgcacgcaccaaacacatgactagttgactactagcaatcactgcccactcatacataatcccggcaatggcggccgaggcgaccaacccctccacctcgcctcaccaacctcctccacgactccggggaactcgaatcccgccccggatagtcgccgccgagatcgatccatggcggccgaggaagcccaccgcctcgccgacgccagcgccaccgcgccgcccaagaacgccgccgccgtcgatggcgtcgccgtggcggcgccggcggccggcggcgggcatgggagggcgccggggaacaagctgtcgctggtgccgctgatattcttgatcttcttcgaggtcgccggcgggccgtacggcgcggagccggcggtgcagtcggcggggcccctgttcgcgctgctcggcttcctcgtcttccccttcatctgggccgtcccggagtcgctcgtcaccgccgagctcgccacggcgatgcccgggaacggcgggttcgtgctctgggcggaccgcgcgttcgggcccttcgccggttcgctcatgggcacgtggaagtacgtctccggcgcgatcaacggcgccgcgttcccggcgctgtgcgccgactacgtcgcgcgcgtcgccccggccgtgtcgggcggcggcgcccgcgtcgccgccatcgtcgccttcaacgtcgcgatctcggtgctcaactacacgggcctcagcatcgtcgggtggaccgccgtggcgctcggcgtcgcgtcgctgtccccgttcgcgctcatgttcggcgccgcgctccccaagatccggccgcgccggtggcgcgccacggcggcggacaaggactggaagctcttcttcaacacgctcttctggaacctcaactactgggacagcgcgagcaccatggccggcgaggtggagcggcccgggaggacgttcccgcgggcgctgctctccgccgtcgccatgaccacgctcggctacctgctgccgctcttggccgccacgggcgccatcgacgcggcgcccgaggactggggcaacggcttcttcgccgacgccgcaggtaaattcttccgatcaccaacaacgccatcgaatcgaatccagtaatcagatcacgttcttgcataatcacaaacacctagcacgcgcgccacgccgagattcttgattgattgatttatttattactttttgctcttttccattgacattggtacacgattccatcgaacgtgtggaccatggaaaacaaaaaagatttttttttctttttgcggggaaatcaatcttttttagtgttgttgtgattgtcatgagccatggcaagttaacaacgtgggaaagaggagaccaagcaattaggcagaaaggaacaattagatgatgatattattgtcgtcgaagaaaatctctataaagtcaattccccttagaacaatatggcaatatctttacagtactgtcagtacagctacctctccaagaacagtacaaaagattatgtgtcagtgtcaatgacatatactcctgtttagagctagtcaaatcctataaattaattcatatatcttactgtattatcttaatttggtgttccatttggacaatgataatgatgcccaacatttctaccattcttcagctgcacagatgaaattaattacgcgctgcatgttccataaaaagaatacaacaaagaatacaacataaatagtagattgtaacgacgcataattaccttatacctctctctttctcagaatttaaggcctgatcaaacttgacaatagtctccaaaactaatatttttttcgcatgtactacctctatttcaaaatatctgttgttttagattatttagtaaagattaatgcttaaaaggaaatgaccatagcgccccctattaaatgatgtatgatggggagtgtgtcggtagtttagagtaggatagagaaaattttcaattagaggtaactaatgtaacaaaaggtacttttaagtgacaaagctttttgacaaaatttaaatcctaaagcgtcaatattttggtacggaggaattactacactgtctataggaacagagtcatagctataagaaagtatattcaaatgtcaatcccgaatccaataataccgttgtcaacaagtaaaatttaatttacatcaaactaattgtcagtaaaatattatattgtgatgaggaggagtgagtattttccaagcttcacacaacaatcgatttacgcggcgcattaatttaacgatctctgcatctgcattgcactactgtggatggttgatcattttgattgatcactttctctgcaaacgcatgaacacgtacgcaggcatgatcgccgggggttggctcaagtactggatcgaggtgggcgccgtgctctccaccatcggcctctactcggcgacgctgagcagcgccgcgttccagctcctcggcatggcggacctgggcctcctcccgcgcgccttcgcgctccgggcgccggtgttcgacacgccctgggtcggcatcctcgccaccgccgccatcaccctcgccatgtcgttcaccagcttcgacaccatcgtcgcctccgccaacttcctctacagcctcggcatgctgctcgagttcgccgccttcgtccgcctccgcgccaggctccccgccatgcccaggccctacgccgtgccgctccggggcctgcccgccgccgccgccctctgcgccgtcccctcggcgttcctcgtcttcgtcatggccatcgccgggtggaaggtgtacgccatcagcgccgtcttcaccgccgccggcgtcgcggtgtactacctcatggacctctgcaaggccagagggtggctcacgttcagcgccgctgccgcagaccgcggaggcagcggcggcgacgcgatgatgtaccggcgtcaggggagcacggcgagcgaggtcgtctgatgaggggatcgatcgtcgtcgacgccattgattccggcgttgcattgcaagctgtatatgctttccgatgtttgtttatctgtgtgtgtgtgcgcgcttctttccttgtgcagaagagcataggaattgagtgatttgtaacagtcttaattagtcgtagatgctgatcaaatcaagaaatgggttgcatattactttcaaattagcaaattgtacattcatgaaagtggtagaactaaagaagcatacataagctcaaagagaaattctcgacctcactaaaatcctattgaaaacccaccaggatttcaatcctattaaaggaaaatgagcaattctaaggcacaaatctaatgaaccaatggtagcatcttgtccctgattgcaagaaatcatggacaagctcaaaatcgcggcgaacatggttagcacttagtagctagtacgaaacacctagaaaaactttgaaagaaatacaatcttggctaaccgaatgcacacttttggagaaggtgaggagccatacctacatgggcgcgacatggcttgaacaggaggacaacacagcagcatgccgacggcgtgatgattcgatgatggcacgcatgggcgtcacaggacacagcttaggaagaagaaatggtgtgtgccgtctcaggtcatcatggagtagtacatgatgtttgctttgctaggggtatttgagaagagtgtgttttcttgtcttgaactgttgatgttgggggagaaactgtatttgtcggatctgctacagtactagtactcctactcttactccgtaggccggtacatttctgttgggtggaaatgggaggaagacttccggacccatcatttcgcttattcgcggaataagccaagcggcacatttgcaagcgaaaaataatttgtgaataaaatttttatatttgtagctatgcttatctctgaagtcgatatccggcgtcttgtcttggcgcatgttggcttgtatgttgatattgtatcttgatctattgtttcatgtcccctctcctcctagggggccttatatttatactcataggtatccccttgttcaagtagaactagggaaaccaatatggatacaatccgagtagtccttgtcgtttccatgtagaactctattcatccttccttatgcggaactcctcctatatccgaaggttgtttccgtataagacatggtatgtggtgggtcctgccaagatttagtcaactactataaggtatgtggtatccataacattgacaatgtgttcttagcgatccaaaagaaaatgctgaaaaataagcttcgatgaaaaaaaaaacctcaaaatcagctccaaatgtaacattgaaaattcaaatttggctgataagcataagcataagtaaaaatatgaggcccttcctctctgttctcataaaaaccggtactcggtaggagggatgcagcggttgataagaaaagtaaaatgtgtttgaaactcacaacgcgggaaaagatgtagtgcaaactacatatatagtggaaacatgaaaactaccattagaacgtaaaatggatgttcaatattcgtccacgtatgagtaaaatttttactcctgataatgtggacgaatatcagacgttcatttgatccaacgatagttttcagattcccactacatatgtagtttccaccctatattttccccttactacgcagcaaacatgtgacatagaggaaatccaaaatcagaaaatggaaatgctaacgcatttagaaatgattagactcatttcttagacacgcaaacaataataagagagtaaagcacgagagctgtcttgtttgtttgtgtaggccgaaattcaggcccacccatttgtatgccagaattgggcccatcaagacgaggccaaggttagctagtgggttgggctggtgtgggatgcttccaggtgatatttataaggcaataagttcatattgattcccttaactagtaattgaatctgattcgtatcctataccggatatctcgatcctcaactattaaaacggctacaatttgaccccatcgataattttagagggtggttttgccaacgtggctcctacgtagtgattttgatctagtcttcgtggtgcatggtggtggtttttttttcctttcctagctaatgcctattaagaatcaccgcaccatctggtgttagtcgtcgtaaaaaaaaaaaccggtagattctcgttagcgaacttgtaccagaactgctccgtccgtgtgaagcgcaggtcgggggcgtcaaagaagaatcggcatgagctcgatctcaaagcagaaaaatcgccatgcctgcgccgtctccacgcactcgaacgtcaccgacgaccccggcagccgatccacgaatggccgccagaggcaccacgtacgagtcgtacgacaacacacccttcgaagctcccccaggaggacgaacacaattagaagtataatagtataatagtgagttataagcctactataagtttacgtggatgagagaggtaacaaaaaaaatcaagagtgtaatggctctcatgcaagagctagcttaacacaaactccaagacaatacattaaatgtataagtgagagatagagagaggaaaagaaaaattgtagccgaccttataactaatctattatatatgttggctttaaaatggactaatagtatgaagtgagctctactaccatctttgctcttagctgcaccgggttcctggaaggacctgatcacggagttgatggaaggacctcttgttggttcttttctccaacaagagagagttggatgaagattaagatttttgtggcacgcttttcaaactgataaacggtacgtttcgttctatatgaaagttgctctaaaatatcatattaatttattttttaagtttgtaataattaaaactcaatcaatcatacgctaataccacctcgttttgcgtaaaaaacttaatattcatcttcatcttcagaagaaaagaacaccactatatatactatatgtgtcggttcttaatctaaaaccatcacctatattttaagaataggtgataataatttaaaaaaaaccagtatctaaacggaaagaaatatagctgtcggttccagccccaaaccaacatctataatatattataggtgttatttttcttaaaaaacagcacctatacgaaaccgagccgagccaagccaaggagagggatcattttccacccgcccccgcagctcgaccgtatggttttatccgcatcttagcgctctctctcccttcccttttttcagagagtagcatagcgctgtccctttccgtccttctcttctccttcttctcttctggcaaggtgtccacggcggtggccaag

SEQ ID NO: 16138 - DNA, 3274 bp, Oryza sativa
tggaggtggcccttcttctgcatccgcctccccccttctcctccaaatccagtgacggtggtggagaaagctggcgcagagagtgaggtggcagccggaagcctaaaaggaggtggtggtggaggccgtcacactcctccccccctcgccaagcacttcgttgttggctccattgggccttttttttattatctcattgaatactatacatgttggttgtggggtaagaactaatacctataatttctgtatgtactggtttcagaactcctaggtatagatgccaataaattagtgtcggcttgaaaactgacacttactggcttttaaccagtacctatgttggtttctgtcgtagtggcggccatgccctcgatcttgtggaggagtctcgtgctcgccggccactgtgctggtggaagatcgagcagagaaaagcagcaaagcagcactgaattcctccttgcgtgacgccattagcgccatagttgcaaaataacccacgcagccgttgcaaagattaacccgtgctgagctcccccccccccccaaaaaaaaaaaaaatctttctcttgagcttgttggtgctagcatctgaatggagcctcgctgaagaatgagccggtggaactcattggtgcaggcagagctcaagctagtgctcgggtccgttgtgctgcacggctcatcgtacgctctggaatctggatgcctcgcacagggcagacagagagggagcgaagagaagcagaaggaaagaggaagaagaaggccctgaaaagctggctctccattactttatttttttttctaaccaggcataccaagtagacgaaaaccacgcaaatgctttgcgccgagcgtccgatgcaagaagctatcgtcggacgcgcgcggcttcgttacatatctacatagatatatgtttgatgatgtcacagtatacaacatgcaaagaaatagctacaaacttgattttcaaacaacattttctcccgtactatttattcgatttacgatttgattgcaccgttatattcgttacaattaaatctctataacaagatctcacatgatcatattccgatgaaatatatatatatatatatatatatatatatatatatatatatatatgtttcaatcgttataattatatgtttcacgtatgagaaataaatgttccaattaggatttcactttgttgcaatttttaaattttctattgcaaccgatctttatttaatgtcaccgatagtattgttaagatgtttcaacatgtatttttcaatgtttcactattgcattcataaatattacctacaatgcatttgtcgagacatgcaagaaacacctcgtgcaacattcacaaatgaaataatgaaacatcacaaaatacctatttgaaacatcctgtgtgtgcaacactaaaaaacaccattgttaaaaagacatgaaaaatatacaacattgtcgagttccagctgaaacatttgttactcattcatgaaacattgaattataatgctggaaacatatatttttttaatcaaaatataatcatttgagatgttattgtaaagatttaattataaagatttaattataataaatgacatgaaaagtaagtcacctaaaaggtttctaaatgctaatataatactaatcaatacatgttagacttgttacaggatttgctgcatatagtgcacacgctgacacgcatgttgcatgctacagagttacaatcacaggcgcacggcaggatggcatgcatatgtcagcactcagcagcaagcaaaccaggcatccgatattaggaaaaatatcggacgtccgatgcggagtcgcctcccgaaaaccactctaatttggtaaaaactatcttagaagtgtaaattaaactgtattgatagttgagagcgtacgatatcaggttttaaatttaaagggtgtgatttagacaaacgtgatagtttgggatgtaaaatgggcttatcccttatcgctcaccttcaaaagtcttgatgacattacgattcattctcatttaaaaccctagctactttccaccccaaaatcttccttggtgccaccgcgcatcccctcctttcctcctcctccgaccactgtgcctcccctcctccttcggccaccgcacctcccctcctccttttctggccaccgcatctcccctcatcctccaaagctctggtggcgtggattgatgtttggttttgcaaatcgagcttggtagcgtgaatcgatctccgagggcgctagtcagacgctagcggatgatcgagctcgggtggtgtgaatcgatctccggccatgcaaatcgagcaccggtggtggatctagaccaagcggtgtggcaggtcgatcatgggcggagcagagaagtggacgatggcgagctcctctgcgcggcggtgtagtttgggggacggcgagctccctcccaggtctccatgatgagctccctcaccggccaccaagatgagctccctctcttccctctctccctttccttgcagtgcgggtcacaaactataggctagaactgacgaatcctagcacatcccaacgaggaacttgtgcccaaactaggatccgcgtacttcgcagagtaacgagggacgcagacgtggcatagaatctttgacatagctcgttgggggtagaatgacacctaatcacactgtgaaaagccctaacaagtgaaatatcacttgtccttataaacaccgtgctgttacggtggagttgtggatagatgtcttcactcactaagttcaaatcctgatgcttaaacatattatgcacacaaaggtgagctttaactaaaattttagcgagttgaaagatgtgccgctagactccatttctttaagtttatgtgagaagacaaatttgtgagtgtatacgtacgatgctacgtgtgtaatagtgtgtgtgcatgtgcgtatgacatgtaagtggaagaaactttacttgtccttggagtgccctgttattctttgtccttccccattcctcacctcaaacttaaacatccgcacggtcaccaaaaggacaacacgggaggaaaatgactgaatcccaaatcttgcttccctatgtttaaattgtagttttaaatttattgccaacaaatcttgcttaccgatataacctattatctccattttgaaatataaatgcttctaacatttaaaattagtactagatataaacacctctagcactattaggagtggggctgcaggaa

SEQ ID NO: 16139 - DNA, 20256 bp, Oryza sativa
gtccatgctaaagttggctataaatctgtagccctctactcttttctctccttttttacctcctcaaaatatgtttataactggcttataagctgctaccgtcagcagcgcgacatgcacaataaaacatgtattgtggtgcacggtgaatggcaattaattaagccgatgactgctgccgtaccccccaccctcccgactaaaaaacctaaactagaatttggatggatgataatctaatacaacgaattcgacatgtataatccaaatccaaatcctaggttagttttttttaatggagttttttttaattggacatctagctagggatgaaaacggtcggaaacgatacattattttattatttttttcgaaaacggacgaaaacggtcgggaaattttcatacttatgaattcatctatttagtgtcaatttcaatgccacgctgacagaaattaaaaacactaaattttgaaaacgataaccatcgctaaaaatattattattattatatagttttacggaaacggtgtatatacggtccgaaaatttttataccgttttcaccctgcagccttgatgttaccagtcacttgacttaatggctggcaggcaggcttatcacttgagtcgacgtacagccccatgatcaacagttcaaccttagtactccaaagaagtttattttgacttctttatgtaaatctaaaataatttttatttttatcaattattacatgagagtttgtaaaaataaaaaataaatatattgagagtagataaagtagaaaataattatattgagatttatccaatttaatataatcattataactaaatactctatgtcctattaaaaaacaacttccggggatgaacctggataagcatttatccagatccatccctacaagttttttttcattttttttcttggacggagggtgtaactcagaggattatattttgctcaaagaaatatgcatgtttcaatagcaaaatttcggttactaaaaatcaaaattcggttttttgcaatcatggaggttggagacttaaaaaaaaccctgtaaaacaaggcaactaagagagattttgctttaatttaagctcgcaacaagcagccaaagaataatggcactagcaggtacctctcctaggccaaaataagttgatttgtatattagttaaagtttatctagctcaattggttgtttgtcagatttcttgtggtgaaaccagtccaaatagatgcaagacctaaacttggatagaagggtccggagaatagatattcagttgtcactattacataacatctaataagggacatctcatatatgacttataggtgtcagttgggagacataaccgacatcaatgttacttaagaggcccgcatataaaaatctattttcgcaaatagacctctaaatacacctgtatacaaaaacaagcctattttcgtagacggaacttttaagcagccacatgagaaaatgcattttcacatgcaggcctctcaaagccccacctacaagtctgacctttgtcctctcttccctctccactctcagcgccttcaaaatgtttaagtctcatccttatctcctcaccttctctccctcacctttaatttttccgtagtcttatttcctctctctctctctctctgtcacactccaatccggcaccgccgtacaacggcacctgacaggagcgtgtcgtaggaaaaacggcgcgaaccgcttcctacgaaaccgcaattatagtaccagtcccaggacatagtgctggtacccacggtgacaaatatgaatcattgcaatccttaaaataaataaaggacttatttaccttaacttatgttgtagcttagaacagcccgagaatgcaaccgacgatgcggacgaggaaaacaccaacagcagcagcagcagcggaaccaacggactaacacccaacaccacaggcgatggctgggaaccaggacgaaaccctaatcttcacttcacgatggaggaactatatatatatatatatatatatatatatatatatatatatatatatatatttatatagagcaagggtgagtactttcgtactcagcaagtcacgggaatcaggtgtttaatgcaagcttggaagagaggcaagattgttttacaaatcctttgtttgaaatcattttgaaatcactaagtgatttatttctttctaagtttgggtcgaaaaggagacttgcgtctcgattcgacttaagagatgctgttcaacaactcaattggtaatgtattgacctcccgggtcaaatcattacttcctggctcccagagccatttcacttgattaagcggctcccagagcctttttcattttctcggactcccagagtccagctgcccagcagcacaacaatccgcttccactcgggaagcctaatctatgatgcccgcaaacattccgaatcacacagattcgtttctgaccactcaggtcatccatctgccatgtaggctgattctggtgacgattcccaatccacaacaacttttcataaagcacaggcaaacaaatctacgcaacggaaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaagcatcaaatcctcacataaatataggccattttagttttcacaaatcaaactccaaccacctcgatcggtaatctggcaagcttcgcgttcttgccttaccaggaacccgggttggctccaaccgaccccgccccggcgttcccaactattggcatgcgaggtttccctgaaccgactagttacttagctagggtgtcccataccaccttgtggttgcactttgttatacttgatgagtttcccacaggaatcggtccttatatgcgaatacgggacaacgccatgcaggcaccacccccacatcgcgagttttcataattcatttatttttaaacacaccgacaccacatgtcgggttttcaaggcttctcaaacccatttcccaatttttcgacagtcaacggtgtatgtgggatatttggtatacgcgctcagagagcacggatacggaagtaccacaagggtggagcggcaaggaatcagggtagtacaatctacaggaattagtgcgactactgggtaggtccgtcggtttggcacgcaaaccgaggccaagcaaattaagtgtgtgattctaataatgcaagttacaaacaaaataataatgattttccaattatatgagcaattggtcaaagggtgacttgccttgctcaagatcttcacgaagcttcatgaatctacgagaaatccctgatcgacgaaaatccggtaaccgcggctatacgcaaacagtcaaaacctaaatgaaagactaaaagaaagaccctatttagactaattaatagtgccattaaatagatctcaattttacaggagtactggaagttgacggagtcaatcggagctacggattgagagatatgaattttggaagctcgaatgggattttctggactaggaaatgatttatctgaattttctggaatgaaaggaatggtttatggaatttatagaaataatattctcaagaatattattgacagtcactgacgtgcggggccaagggaaatgatttatggagcaaaggaaaaaggaattgatttatgaaaaagggaaaaaggatttattaaatcctttttggaaaagaaaagaaggatggatgtgatttagacttgggccgagcgaagggggcggggcccaggacatttgcggcgcggctgaggaaagtgggccggcgcacgggtgaggcggtccaaggccgggcgcggcccgcgtgagagggagccgaccgggcggaccgcggtccaccacgcgggatccggggcgggcccgcttgtcagcggctcggctcaccgatggcggggtgcatgcgagcgggacgctagggttagggggaggggcgcggtgcgcggtggacgcgggtgcggcgggcccacgcgcagcctctcggctcgcggtggaccgcgcgcgcgcgagcgggagtggagggaggcggctgaccggggtcagcccgacccaatccacgccgaggtggcgccaacgtggcgccttcgtggctgccatgcgggccggcgagaggaggaagacgaggccggccggaaaatggacggcgggcggcggccgacttcaccggaagcactacgcggcgattcgatcgagagggagtttaccgtacaagggggagcacggcaggggatgagccaacggctcggattcttcgaaaaggggccggcgacgacgaatcgcggcggcgcacgccggcggcaagaaaagggggaaacggcggaggggcgatgaggattcaattcaaggaggtgggagcatctccggggttcaaggagcccatttccggcgtcggatggggtggaagagcaccgaggagggccagcgacgagcggcggcctccgggagcgggcggcaacggcggcgaggccatgccgggcggcggcggggctaggggcagcgtctacgtgcgttcgagagtctagctgagctaccacgcgagccaaggaggggcgagggcgagcgagaaaaaggaacgggaggaaggcactaccgagccgggcgggcagtgatgggcggtcgacggcgcgtggcgagctctccagccttggacctgggaaggggaagaagaggtgcctggagtcctcgtctcgcgtccccgcacgcaccggtttccctagtgcttcggcgacggacggtgagggcgactgtagggcaggggcggcaacaatggcgcggtggtggcgacgagggaaaacgaatgagggagatggggcgactgctgttttataggcgcggggtggggcatcgaggagaaggaactgacattggggcggtcaaggggagcgagctggcggtcgtgctcggagctagcggccaaacagcagtggaggtgcggtggctgaggttggaaaaagagaaaaagaagggggaaagaggagcttgaccatgccgtttcggggagggagagaagcgggagcgagagctctggctcctggttttggacgggtgcgggtggagcggcttgggcacgcgctgcagagctccatggaacgccatggataggtaggtaggtcaatcgatggacatacatatagttggatttgagaaaccgatagttagttcgagtaggttgatagagcgataggtagataggtcgatggatagatagatagatgggtagatggttagataggttagataagcggatagatcgatcgatggacagggaaggattcaaggacggatttgacattctcggaatccggagaagtattggcaaggaattcaaggacaggattgaattccggtgtttgatttcggaagttgaatcggaattggaatcttcaggtggaggattttgatggcgatgagagggaacaacaggatttgaattgagatccagggcatgacttagactcacactcaaagaacgaaaattttcgcaattaggattttctcaaactagtttttaacgtctcacgaaaagcggagcgttacagatccaccccccttacaagaatcttgaccccaagatttgaaggtggaccacacacacgaaaccaaaaaggggatcttcagacttcatctcagcttcatactctgttggtctttcttcatctcatggttgcacactagccacaaaacgatctggtactctcactcacttaacatgcttcatcttactgtgggtttgtttcttcctgcggattctgttcttcagcttgctcgagattcataacttttccttttgtttccacttgcacatggttcagatgactttgtccaacaggcggtgaggttagcgagacagatccactgtttggtgactttgagctttttggtccgggtacgctagggaggctcgctgttggttgaacttgctttgacttgactttctgagggcagtaccatgaatagtgtcccatctcatggcagatgaaacattcgactcctgccttatgaccacgtcttttcggaggtggagggcatgacacggagttacttccttcaaggcttttactgttgatcactgtggtttgctgactagattctgacattgtcgagcgagacgtagaaccgaaaccattggaatactgaaatactctctgatagtactgtgctggcgagtttgttttttttgacacaaaccttcttttgcttgaatctctaaggatattactttgcgtctcttctattcttgcatctcttattctgcatcttctagtaacaaggacttatcgaccatttgctgaaacatcgagaagtcgtgagccaaaagtttcactcgcagtttcgcatccattccttttaaaaatcttctgatcttctttttatcagtgtctgcatcttctagggcatatcgggccaatctgttgaagcgactcaaatactcgttgataccagaggatccttgcctgatatttgcaaattcttccttcttcaaatcaattatgctttcaaggatgtgtgctgagcgaaagacttatgcaaattctgcccagacgatggtaccagcatctgtatggttagcacaatagttatcccaccaatctgcggtaggtcctctcaactgatgagcagcgtaaagggtcttctcatacggagtacactgtaccagatttaatctcctttccacatctttgatccaatcgtcaccttcaataggctcagttgtttgagagaactccggcggacgtgatgtcaagaaatcattcagttttgatcgcccattatcttgaaccatatggggttgacgctcttgtgtgtgttgttgttgcatagcaattatattctgaatcattccttgtaatatctgagtttgcatggctaggatttggtgaaggtccatgggtgggggttgattacctcttgcattattaactgattcggaagcaaccgtatgatcactctcagcttcttgctcatctgcttggttaactggttgatcgggaatctctgactgaactggctcttcttcaaaaccaaagcgattaggagcacgggtttgacgggtagaacgacgagccatctacttcaaagcgactgagatctgaccgaaccagaaatgggataagaaaaggaggaaaacaaaaacactagatcaaaacgtttttcgaaatcgcagaagacataggtggtgtattccagccggtaacccaactggtctaacacctgaacacgggctaccaaacaaaactcacacacgcactagttcaccacaactcctaccgagcgggtgacggagctagggttgcctaccaacaagggcttaactaagacgcctagaggcttgagcacacctttcttcaactgggcgtgaagacaggtttactctaggataacatgtcaaaacaaacgactagcttctacttttggacacaaaaacatttttcgcaaaactagagctaaaggggacaacgacaccttagctttcacaaatagtttttgtactcaattaatgccatcctattcaggggtttcgatcctagggccaactaatgctctgataccatctctgtcacaccccgatccggcaccgccgtacaacggcacctgacaggagcgtgtcgtaggaaaaacggcgtgaaccgcttcctacgaaaccgcgattacagtaccagtcccaggacatagtgctggtacccacggtgacaaatatgaatcattgcaatccttaaaataaataaatgacttatttaccttaacttaggttgtagctcagaacagcccgagaatgcaaccgacgacgcggacgaggaaaacaccaacagcagcagcagcagcggaaccaacggactaacacccaacaccacaggcgacggctgggaaccaggacgaaaccctaatcttcacttcacatcatcttcacttcacgacggaggaactatatatatatttatatagagaaagggtgagtactttcgtactcagcaagtcacgggaattaggtgtttaatgcaagcttggaagagaggtaaggttgttttacaaatcctttgtttgaaatcatttagaaatcactaagtgatttatttctttctaagtttgggtcgaaaaggagacttgcgtcttgattcgacttaagagatgcttttcaacaactcaattggtaatgtattgacctcccgggtcaaatcattacttcccggctcccagagccatttcacttgattaagcggctcccagagcctttttcattttctcggactcctagagtccagctgcccagcagcacaacaatccgcttccactcgggaagcctaatctatgatgcccccaaacatcctgaatcacacagattcgtttctgaccactcaggtcatccatctgccacgtaggctgattctggtgacaattcccaatccacaacaacttttcataaagcacaggcaaacagatctacgtaacgggaaccacctcacatccgcccatgaccgtgggcacggctgttagaatagttagttaacctctgcagaggggcacactttacccacaagatacgaacttacttcgaacacccgtctgtatcggaggttcgcaacaaagcctttcccaagccgacccagggttacctcatgccacatagaaggatcaaatcctcacataaatataggccatttagttttcacaaatcaaactccaaccacctcgatcggtaatctggcaagcttcgcgttcttgccttaccaggaacccgggttggctccaaccgaccccacccccgcgttcccaactattggcatgcgaggtttccctgaaccgactagttacttagctagggtgtcccataccaccttgtggttgcactttgttatgcttgatgagtttcccacaggaatcgatccttatatgcgaatacgggacaacgccacgcaggcacaacccccgtatcgcgagttttcataattcatttattttcaaacacaccgaatacggggcgactgctgttttataggcgcggggtggggcgtcgaggagaaggaaccggcattggggcgatcaaggggagcgagctggcggttgtgctcggagctagcggccaaacggcagtggaggtgcggtggctgaggttggaaaaagagaaaaagaagggggaaagaggagcttgatcatgtcgtttcggggagggagagaagcgggagcgagagctctggctcccggttttggacgggcgcgggtggagcggcttgggcacgcgctgcagagctcgcggcaggcagcggggctgagcggcagggcggcatgggcggctgcgcggcgcagccggccagggcggacgcggcggcgaccgggcagtcgaccgcgcgcgagcgcgcgcgcgaaggcgagttcaaacggcggtggcgggagggagttcgacaagagggagggagagagaaacagagagaacgagcgacgctccctctcgactccgacagcgtgcaacgcacgtggtgggggaagagatgatgggctgggaggggagatgggccgtgggaggaaatccggtccacaaaacttgagggaggtaaaatagacttttccagagaatttgatttggagaatttgagtaggattttggaattgcaaaccttgaaattttaatttggtgaaatgtgaggaagccaaggatgggattcaaagcgggatttatatatatttcttttgaaatatatttgtatctagcgactccggggattatttgagagggattccaaaggaagggaaaatcaatattcgaagatggatcaaagggagatagcgatggaacgccatggataggtaggtaggtcaatcgatggacatacatatagttggatttgagaaactgatagttagatcgagtaggtagatagagcgataggtagataggtcgatggatagatagatagatgggtagatggttagataggttagataagcggatagatcgattgatggacatcgagggattcaaggacggatttgacattctccgaatccggagaagtattggcaaggaattcaaggacgggattgaattccggtgtttgatttcggaagttgaatcggaattggaatcttcaggtggaggattttgatggcgatgagagggaataacaggatttgaattgagatccagggcatgacttagactcacactcaaagaacgaaaattttcgcaattaggattttctcaaactagtttttaacgtctcacgaaaagcggagcgttacactctctctcccccactcacttttctctcccacctctcccctcctctcccatttttccactcctcacatcccgacggtgggctcgagttggcgacgacgggagcgggagagcagtggtgggctcgtgcgggcgcggcagatcctgtgggagcgcgacggcgggtgcagcgacggcaacggcgaatccggcggtatggagggcgacgacggctgccttggcaaggtcgggggatggcgatgccaatgaggagaggcggtaaatgggattgttggaattttttttcacgatttttattttcgtgtgcggactacataagcaccggcacacaaaaatccgattttcccgtgtgggtgcgtcacccacatggaaaaatgggttttgaccgcatgcaaaaatgttttttttatgtagtgttcctaaatacttcttcatgtgattttgaggatagattgctacctaatgatttaattatgataagaaactatggagaatactagcgagagagaggttaggagatggataaggtcacacaggcgttcaagtcaagttggagacccaactcatatcaagttcgagtctacctcggctccaagagtagtctgtgctaaaaacatcgcctaggtcatgttcggactccattttagacgttctacctatgtatggaaaactaacaagaccacctttccgatgggtttggtcttccttcgaagtcattggggatcgtcaaaacaagtggtgtccagaatctgtccgagtgctgtgtcaccatctttttgtaccgttgggccatgtatcgtgttggagtccaacagggacgcatccaggggtttttgatcgaccgtagaacctatatattcagtagttgttgtcgagttagggttgggttttgcttagattatttttgcaattgcagtttcaccgttcatcggtttgtgaaaccccgacatcaagttcttaatcaatcctctacatttgtgttgcaatattcttattcttgcttgtgtcttcgattcgcacgcaaggatagccttctcggcgaggtcaatcgggtttggcatggttaataaccagaggagacgtggtgctgctattacatggttcatattatgttaatcgaaagtcggatcgtgtgtgccaagattttgccaattcgatagatctctacttgacggaagattgggcaccccattatcattataaacttttcccaaattactttttgaacaaaggatagaaacaccattgaatctatgaaattcctttacaatattttttgctgatccatgtggaaattttggaggaaagtcacgaggccgcccggttcaacctcctgaaaaatgttttcctttgactttattaatttcttgattcctgcatctatctgcggtctatgtatcatgtatttttcttgtattttgtacttctttgtttttttcttattcatatattttatccctgtgttcgacatgggcaattcttgataaaaaaaatgcatatgaattttctttgaagcaattctacagaggactttgaaagcctcatgctagatcaattcctcaagaacattgtggagaaatgttattcctatgctatgaattttatttaaaatggttgtctatatccacgtagatgcatgtagaaactggtgggtttttaatccaagcagttttaatccacgagttttcttccaagcagttatacaaattaaattactcgcatataagaattatttttcattgtattcccctagtctttctcacaagccacaaaatgcttcaacccaaaattgggtgatccgatcccctctaaatcgacatgggctgtttgcatgttgatccatcatgaataatcacattctaaaccattcgcggttataaacaaccctacttcgtttttgaaaacaacacatccaaattaatcgaaaaaaaaatccaatcatacaataatgtgtttttcctataccccatttatgacacaggcgagttgaaagtagaacccgcctgtgtaaacattggccaagggatggaccaatgggccacctgtgaagaactaacttagaacacacaaacacatagatctacaacaaattatgaattatatcgagcaaaacctctgccccttagttggtcgagcaaaaacaaagcccctctctattcttcccaattgagctggggtgtgagagggaacgtgcatatatattatggacctagttttcccgattgagctgttggttatgtaatagatccaacacctgtaagctcataaatatagccgtgccagggctacttcataccggttcataactaatattggcatatataagtcgtgcaagactattcaaggcccttatatatgtggaagaggttatggaatcgaatccctcacatgtatgtgatctgtgatttttttttctttcctcgcttgcatgaaacttaaagcaaatctaatagtttaaaattacgtgaaagttatatataaattacaatgtaattgtattataattgtactatatttacatctattaagtttttaagaggaaatttgtagataaatatgtaacaaaatgttacaccgttattagctcatgggcaccaaaaaaatcttgtggttatgtcatccgcagaaggctccatcgtcgtgtgtctttgatgtttgtaccaatcaattaaactagatgattcccgcgtgtgtttttctacgagatatataaataaatatatgttaaatgttgtataatcatgaatagaattggagtgaaatattttaaaaatgatttgaagataataattactatgatgtggtatgtttgcatgctagcttttagaattaataataaatactatgcttacctattgaattttagatgtttagtgggtcgtaactttatagaacgtagaacatatagataaccggtatcctaattaagttcaagttcaacatgtcatcaagagtatatatatattcattaaggtacgtggaattatacttcctccatttctgaatagataatgttgttaacttttagacgtatatttgactattcatcttatctaaaaaatttattgtatccatctcatagaaaacaaacttagtactagaaagcgtcgatatagtctatactagttatttatgggagtgtgagctagtatgtaattataatttattttgttgtgagctttttatcgctaaaagcactttacacatgatttatttcttagatatttgcgaatggttaaatgtgtatgaaaagtttacatagtcagctattgaaaacggaggaattatgggcttgtttagatcattgatagaatttttcaccctgtcacatcgaatgtttggatgtatgtatggagtattaaatataaaaaaactaattacacagattacgtgtaaattgcgagacggatcttttaagcctaattgctccatgatttgataatgtggtgctatagtaaacattttctaataacagactaattaggcttaataaattcgtttcgctgtttataagaggaatctgtaatttatcctgttattagtctatatttaatacttcaaatatgtgtctgtatactcgatgcgacacgccaaaactttacaccacttactccctcggtaagaaaaaactcaaacctatgactgattatgtcatatcacattcctaggttaatttttttttaacgaagtgagtatgtttttacgctgacttctaaaaagtgagacgcctgcgtacggcctgacggtagtacaagtactcgatagaaccgtcgatcgtaaattattgaagagtgaagaaaaaccccgtgcactgcaattaattgtcgtgcatccctccctgccattgcacgttgccacagcagatggtccggtcggtccacctcccctccattggtgaatgacaagggcacgttggtgggtgaagtgaactgagtttatcgtaattatttgagggcataaaaagataaattaaatatcacttgaaaattaatgattttgatttaagaaaagttttaaaaggaaattctaatgaacaaacttttttttaaaaaagtatattatttagaagcttaaaaatggtgactccgataatacgctagctagctattcccttaaaaaatgccctattatttgatgttcaacttgaagcatgcaagatatgcgggccgggcccaccaaggcgtgctaggaagaaaaagcatacaggtctggttccactgcagtaatgcagaagttcactaatagtgaacctttacattactgaggggatctggattttaagcgcactttattacattagataatatactcctccgtttcattttaaacgtagctattagttttcatgtccaaatttcatcgtctattttatttaaaattcttttatgattattattgttgttgttattagatgataaaatatgaatatatatttttttaaaaaaaaattaataagacagacgattaaaattggacacgaaaacttattgttgtgtttaaaatagggcggagggagtatatcgcaaaccgatctatcgtcggcggaaccagaatcagccgtacagataagtggcgctggtcctggtgacacgtaaacgaatatcgtggagaggcacatccatgggccatgccacgtaccgtcccgtacatgcatgtgcacctctggcgacattgtgggcacctcctggctcagaaacggaacatgctatactcgatcgatgacaattaataacgtgtggggggaagaaacgtgttacctctaattttaaatagtgaatttttactctctaaacctgttcatctatgttacccatgtttctaaactcttaaaatatatttagagtaatttttgttgaaacccttattttcataatcaattatgactttaccttttttttccttctatatagccatatttacttttagaggcaattgtgtctctgcccttgctttacatctcaattgtgattttacccatactttttagggtttgtgattttgcccatgctttttttaaacagggtagctgcctgcccctactctgttaactgatggtaacggtattaaatgtgtggtgaatggacgagtatacccctgacatgttttggcttgcacaggatacatgtttcaagttaattttgagcaaatttcatatgggaaataaatgttcacaaattttgtaaaagttgatagaacacaatattttggataattttgatagaactttcgcaataatttgaacacagtttataaacgatgtcagaacaatatttttgacaaaattttgacagaaattcatcaataatttggacacaaattatagaagataacagcacactatcaaggacaaaatttcagcaataatttctgctcgctgcttgctagctcgctgcaagcacacttcctgctcgttgcttgctagctcgctggctgcggggccaccggccgtggcgtctccctgcgcgtgcaacaccgcggggccgcgccgacacgccgacagagccgcgccgctcctttccgacgctcctcagtcgcggggccgccggccgccgcgcctccctgcgcttgcaatccgcggggccgccgtgccgacggaaccgccgctccgcagggccgccgcgccgccgcgtcgacggagccgctgctcctcggggccaccgcgccgcgcctgcccacgcccgactccaccgcgcgctggcccgagccgccgctcctccctgccgcgcgccgccgccgcttgcaacccaacaagctaggtttttcgattggatcggggacagcaaggtttggggatttggttgtttcattgaagcaagggtagaatagtcattcacaaattataatagcattttctttgggtgtagctatatttatggggccatatttttcatgaaaaaatagtcggcatgtatttacattgtaagtccctaaattacatatgtaattttagtgtatttataatgtaagtctaagtactaaaattacatatgtaaattcgaaaattacatatgtaaattcgaaaattacatactaattacatatgtaagtggggtgtaaatgaggtgtaactactgtgtaagtggctgaaaaaaaatcgattgtagcatatggcgccatatttctagcaactccgttttctttcatcgtttaattcggaaatcctgggcccatgaaactaccatccaaactaggggcagacggctgcttcgtttcaaaaaagctggggcaaaatcacaaaccctaaaatataggggtaaaatcataattgagatgtaaagtaagggcagaaaccaaattgacccttacttttattattgacgaaagcaagtgaacccggaatagttgagcgaaagaaataggtcttttgtaaatcttgagttacccttctatccttgctggtggaaggaaggagaggagctcctggatggaccacatatataccgatgtttctccatccaacagcaacagcggcagtgatgactcgggcaggcggcggcagcgctagctgcatgtggcgagctgtagtaggcggctgtagcgacctcgccaagggagatagatctaggcaaggtcactacatgcttactggaatactccgtattgtagaaattgcgatctactaagatataagtgctaagcctaacatgatcaccctaatgcggaatccttaggttactgaccgttgtttgaagctattgatgctgttctccctgttcttgtcggtgtagaggtagtagtggtagcagtagcagtgttgcaccggcttgatccccaaggggtcaccggcgatcacttgcggggtagcggcggccttccggtgccacctacactgtcccggaactaccacacgttctccctccagcgctcaattgattggatagggtttttgggattttcggggagaagaaggtcgtgaagagatcgtcatctcaccacgacaccagcctcccctattagtatggcgctgagggagatcgggggcaatccaaaatatagaaagatttggcgctaccgatcaatgcgcgtaatcacgtaattatggaaattgaatcgcgttaatcccgtaggcaccaggtggaaaacggccatccgagatttcctctcgatttccatgccgagagataaactttcctaacattctccccctgatcttgaggctaatgagtttattcttagaaaaatagatttactaaggcaacgcatcagggtagttatcatatcctaccaagactccggtacctatagttcactataaaacttcgaaagaactctatctaatcttaatgggagttagttaggactaagactaatgcctctatttctaggatcttagtcttaatcaaaggcaatcagttattcccatgccggctacatgatctttaaataaattgggaggtaagcctttggtgagcggatccgcgagcattgacttagtgctaatatgctcaatcttaatggtttgatcctggattctatctttcacaacatgatacttaatgtcgatgtgtttggcagcaccactcgacttgttgttacttgaatagaataccgcagctttattatcgtagtataatgtaattggtttagaaatgctgtcgaccactcttaaacccgggataagattcttaagccatacggcctgccccgttgcttcataacatgccaaaaattcagcctgcattgtcgacgatgtagtcaaggtttgtttagagcttttccatgaaatagctccatttgcgagagtgaatacataacctgatgtggatttcttagtgtctacacatcccgcaaagtctgcgtctgaataacctaggacttcaagttcttcagacttcttatatgtgagcatgtaatccttagtgccttggaaataacgcaagacttttttaacagccttccagtggtctaatcctggattggactgaaatctgctaagcatcccggtaacaaatgctaagtctggacgcgtacagacttcagcatacataaggcttccgacagctgaagcgtatggtaccattttcatctgatctgattctaatttatttttcgggctttgaaataatccgaatttatcacccttgactattggagcaggtgttgcagagcacttactcatattatatctttttagtactctgctaatgtatgatttctgagataaccccagtactcctttagacctatctcggtgtatttcaatgcctaaaacataagatgcctcaccaagatccttcatatcaaaattagatgacaaaaattctttagtctgatgcaacatattaatgtcgctgcttgctaacagtatgtcatccacatagagtactagtattataaattttccacccttagtcttaatgtaaatgcaattatccacctcattctccttaaatccgaatctcttaattatttcatcgaatttaaggtaccattgccttgacgcttgtttaagttcatagatagatttcttaagtttgcaagccaaatggtccttgccttccataacaaaaccctcgggttctgccatgtatacatcctcatgcaattcaccattaagaaatgcagtctttacatccatctgatggagctctaaatcataatgagcaacaagcgccatgacaattctaaatgagtctttcttagagacgggagaaaaggtttcattgtaatctattccctctctttgtgaaaaacccttcgctacaagccttgccttgaacctttcgattttccctttggagtcaagcttagttttgtagacccacttacagcctactgttttggatcctttaggaatttctactaagtcccagactccattatgactcatagattttaattcatcgtccataacttcaagccatttggatgaatgttcactcgttattgcttctttgaatgaggtaggatcatccaccttcccaatattttcacctaaataaacatcataataatttggaatggcagatctcctctcccgttgtgatcttctaagtggttcattttcgatcactgacggttgagaaggttcttctataatttcttcattttgtgcctcagaagtctgttgagtgtcattatttaattcattattattttcaacagagtcggtatcaccagaattttcatctggtgctaccacggtctgagtcacaggtacaacatgaggtaccaaatttattggaatattattctcttggatttccggtgtaacattagcccgaatttcctcaagattaatttctcttggacttcagctgatcttcactatgtttctgggacaatctctatctcgatttccatctcgattcctcctccacatctgatccttggattaccaaatttggtcgttaacactttcctgtgagctccccaagacttcattattttctaagcatacgacgtgtcttgtttccacaaatttagtgacacggtccgggcaataaaatcggtaccccttagatgtctcagggtatccgataaaatggcagcttacagtcttaggatctaatttctttagttgtggattaaatattcttgcctcagcacgacaaccccacacacgtaaataatttaatgtcggttttcttccggtccataattcataaggtgttttgggtaccgacttacttgaaactcgattgagtatgtgtgcagctgttttaagtgcctctatccataaattcacagacaaagtagaatgtctaagcatactccgtaccatgtccataagtgtacgattgcgacgctcagccactccattttgttgtggttctctaggcatggaatattgggcaattattccatgtatatgaaagtattgggcaaatggaccagaacttt

SEQ ID NO: 16140 - DNA, 4277 bp, Oryza sativa
aacttatcgagtgattcagatctatctataatggggaaaacatatccataacgggagaaatcatctgtgaaggtaatgaacgagtcatatccatcaacagatgttactgggaacggtccacatatatccgtgtggattatctctaatggacactgctcctagtagctcctttcttatttttttttagtgaattttcccttaatacaatctaagcaatgatccgcatttgaaaaatctaagggttgaagtatctcttccttaatgagacgctccattctccccttagaaatgtggcctaaacgacagtgccacaattttgaagacgtctcattatcattacatgcattcaatatattcataatatgattatccaaagagagcaaacagagcttgtcttgcacactagcaagaccaatatcaatattattatacttaataaagcatttgtccttagaaaaattacaatcataaccactgttcgttaaaaccattacagaaataaggttcctcttaacagagggagcataaagaacatcatgaagtaaaagattattgccgcttggaagtcgaagatgaagctccccaacggccatcactttaatttcagctccatcagccactcttaggatccgctccccctttcttagcgtccttacggaacggaatccctgtaatgagttagcaacgtgcacagtggcacctgactcaatccaccatgatttatgagaaaattcaacgtaaagtaattcatcaacattagagacaatatcaacattagtacctttcttagcaagccaagcccaaaagccttcacagtccctctgtgcatgaccttctgcctcgcaaaacttgcaaaggaacttaccagcagagttctgacctgctggaacctgagatttgcccttatgagcaccattagaagcctgagtggaaggagtgttgggcttcttcttcttgttttgggagttgctggactccccttgatagaactttttcttactgcccttagcaccatgaaggaggttcagctgatccttatgcttctatttgtcagccttctgacgatcctcctcctcaacagaatgagaaatgagttcttcaatggaccacttatccctctgattattatagttaataatgaaagactcaaaatcagaaggaagtgaactcaagataaagtggactagaagatcatcattaattcccatgtccatactcttaagctctccattcatagcacccatctgcataatgtgctttctcacaccatctttataattatagcgcatggacgttaggcgcttaattatagagctagcataagacttagaagaactcctgaagttcctatcaatgttttctaagtatgtcttaacatcatcagagtcctcaataccaccaataatgacatttgatatggcactcttgatgtacatgagagaaatcctattggacttctcccattcaatagttttctcacgatataacttcagtttctcctcataatcgtgctcaacactaaaaggttcctcaggacggtcctctctaatggcataatcataatcgagtatgcctaagttgagtaacacgtcagccttccacttagcccattaagaggctcaatgagtcagatctgaccaaaagctgaaaaatcatgaagaaaaaatattcataagtacatatatgcaattaatatgcgttggctcaattaattacataattaaacagaaataaattcccctaattacatcaccgttgggcagaaataattttgggaaacataatcataaataaattttcgtgaatttataatcaacgttggtcaaaaaataaattcacatcatgaaaaaacaaatatctagccaaatttctcattggttccatttagctagaattaatttataaacagtcataaattttttcataatttttcagcaatttttaagcaatccaaaaaggtactaatgcaaatctgtaaataaaaatacttaaagggaaatcgaaaagagaaaatggccaagtacacattatagcatcagcccggccagcttgggaccttaacgcatgcggcccataatgcacagcgcggcccgtggcgagatcgatctcagccgtttgatgtaatagacggtttggatttatcccgaatcggaaaacatatagccgccggctgtaacactaaaaaaaaatcttttccccaactctctctctctccgaaaagaggcggcggcggcgatttcgcggcggagggggcgcgcagcatgaggcggcggcggcacgcgcgtgttaacagtgaaatttggtaagcccggagtagtcatcggctgagagtcagcatcggcttcgaagtcctgagattagccgatgagaattgtcaagtcgttagtagtcagattcctgctatattcggttaaggaaatcaatctactaaaggaagcttatccctaagtgaccgagtttaaagaggatgcggcatggcagtttatctattaattaggaatagtttgttagtttccttttatctttggaaaagtgtgtttagtgtccgataaggactttatattttccttttttctttaggttagtttctttcttgtccgacaaggacttgtatcaacccatgggtataaatatgtacacccggggtctatgtaatctatcttcacgatcaatgcaattcggcgcatcgccaccctttttacttctacttttgttttttaagttccgacggaacttggcatcggtgttcgatctctggcgaaagggtaagtccaatgttccgtcggcccaggcaattgtatcgtttacatcggcgtcgttcaatgctgcatcagtacattcgacctcttggattgctctggtttggatgatataattgcctatctatttatcatgtctctgttaatctagtcttagcatatcaatttaggtctatcggctgtctcttgctttagggttcctgccggtatcggctaaatcgcgttgctagattagattagcctaggcatctaccaccgtgaaaatcagtcaacggcttgattctctagatattgtgtttcttttcatacttagtgctgcatcagttaagtttgatctactaagtcgtgcttagaaccataatctctagcctgcttattgattgccaataagggtttcatcggggtttcagccggtgagttatctggacgttgcatcggcccataaggattgcatatacatataagttggatttagccgatgacaacaaaggtttcattgtttaatccaatcttgtggatttcatgacatcggacctctagccgatgggtgctttaaccttcggatcaatacttgttctactatatcatattgttagccgattggtttctactggattatattgctatattacatcatcatcagccgattgcctttatatcattatctacatttgacatatagccgattgcttaaaccctatcgctatcggctggtatcggcatcggctattttcggctatcggctggaactactccatcggcttgtcagccgattggctgttttgatctactatttgcatatcttgtcggttgcaggattaaactgactggcacgcccgcatctcatcaatctttggacctgcacaggagctaagcatatctctcaggccggtgtgttcgattttttcgtcaacacagattagccgatgagaattgtcaagtcgtcagtagtcggattcctactatattcggttaaggaaatcaatctactaaaggaagcttatccctaagtgaccgagtttaaagaggatgcggcatggcagtttatctattaattaggaatagtttattaatttccttttatctttaggaaaatgtgtttagtgtcggataaggactttatattttccttttttctttaggttagtttctttcttgtctgacaaggacttgtatcaacccatgggtataaatatgtacacccggggtctatgtaatctatcttcacgatcaatacaatttggcgcatcgccaccctttttacttctacttttgttttttacgtttcggcggaacttggcacctgacgcggggctgcatcggtgttcgatctccggcgaaagggtaagtccaatgttccgtcggcccaggcaattgtatcatttacgtcggcgtcgttcaaggctgcatcagtacattcgacctcttggactgctctggtttggatgatatatttgccttcctatttatcatgtctctgctaatctagtcttagcatatcaatttagctctatcggg

SEQ ID NO: 16141 - DNA, 15240 bp, Oryza sativa
  unsure (1)..(15240): unsure at all n locations
ccgatcacttgcggggtagcggcggccttctggtcgccacctacgctgtcccggaaacaccacacgttctccctccagcgctcaattgatcggataggtttttgggattttcggggaaaagaaggtcgtgaagagatcgtcatctcaccatgacaccggcctcccctattagtatggcgctgagggagatcgggggtaatccaaaatatggaaagatttggcgctaccgatcaatgcgcataatcacgtaattatggaaattgaatcgcgttaatcccgtaggcaccgggtggaaaacggccatccgagatttcctctcgattttcatgccgagagataaactttcctaacacatatagcatcaaactaggttgtgtttagatcaggggtttggcgtatcacatcaaatatacgggcacgcatttgaagtattaaacatggtctaataataaaagaaattatagaatccgcctataaactgtgagacgaaattattaagcctaattaatctatcattagaaaatatttactgtaacactacattatcagcttaaaacattcatctcgcaatttacatgcaatctgtgcaataagttattttctcatttatatttaatactctatgaatgtgtccaaatattcgatgtgacaaggtataatttttttccagggatctcaacagacccctaatatatgtcgtgctcttggagcgatataatggttctcaacggcagcgccgggccccggctgggaatagcaccgcccagcatctcctcgtctggctggataagaccattcccaacccaagacattaaacatagtttccataaactccacattatcaagtactaaacgctactcttctaatgcaaacaccattattccacacttaaatttaatgctacttatcacacatgatgccttggatgttgtgtagaaatcatgtctcatgcaagacatgatttccttctctttcctcatttattcacttgtcatatcatttttcattctaggtggcagcttatttaatgttatggacaccatcctagtcattgggttgggaatgatctaatagtactagctcagtgcagtgaattgaagtaaccgtacgaactatagctagtacactgatgtctgaacgtggtgatttgtttcaaaattttgctgatattcttcggaattgttatgttcatcaatgttcgtaaaaaaatcatttggtataaaatatctttaaaaaaatcaagttgctaactgcatgagcaaaatgagagaaaattgcacgattactgatgaataaatataggggcaaatgtgcaatagcaagtaagggtataaatgtctttttgccaacaactggacaccatcaacttaaccatccaaagtaggagtaaaatttgacttattccaaacaaatgggggaaaacaaaaatcccaaaaaaacaggagcaaaaccacaattgaatgtgaaaataggggtaagaacaaaattgcccccattatatttttatgtcctcgaactaattagagtgtcataagtattccatattgccatgaccactccacgatcctatgtggcgcttaagtgacatgctacatagacactaaagtgacattccatgtaaacattctggtctcaaattttttttcatctcctccacatttcccttgtcttcttttcttttttctctttttcccacacgaataggaaggaagaagaggagataaaagataaaacaaaatgagtcaatgttcatgtttatctgccatgcgagaggatcctaaatgggtcattgtaatttgggactggaataacacactctcaaaaggttggggacttaaaaaacaatttggacccttcaaatcaatgaatttagggagaaattttataggattcaaatcatataacctcttcgatacaaaggaccggaactttccaaatcctacgaaattactaaggaatggctcattacatatattacatatagattttggagaaaacttagcaaaaacttcaacctcttgaaaaatttcctgagtctattctctcgtcctattcctgtggacaaatcaaacaacgattcatgtgtttttctatattttataatcatttgttttgcacttgtattcctattaaaattatgtgttttttctatttcttcctatttttaatcctgcatttcaaaggagccctcaatgttcgaggacctagacaacacaggcgaacaagtttagggactgttagtgtaatttactttatcgaatatatacgccacctagttggctttttaaagattaggtttaataattcattttattagaaaactatgtgagcataatttattttgttttttttctaaaaccatcattatttattttgtatttatttgttttatcataataggtattttaagtatgccttacttttttcatatttacgccaactttttaataagataaatgattaaacaaattgtttccaaaagttaacagtgtcatactctctattttgatttgaaaataagttgattatttctacctcttaaatatcatcaacccctaaattaaatttttttattttttcaatactttctaattgtccacctatcaatactattttctattaatgaaggatattgtcggagggtaaaactcctttagcgggaagcgtgaacttccccattggagattcggccagagagctagtgagcggaaacaaggcaatggatagaaaaacgagggatgcaagctttattcattgttcgatctccttctgaactttttagagtgaaagcgattatgtgattggagtacagtgagcttgatctgatagccagccaaaaacatttcttctactatagctactctttacaatttgaaaaaaaaagtgtttatcaccaaaaaaataactatgcattacaaccgactcataataatacatgataagagtaaattctttttatgctttcaaactttagtctgtaatacataattttattttaaaatggtattaatagttttcttataatcatccatatcagtggatttagaacaacaaataattgttatgttagcgtcttttttttttcaccacgaagattcaattcacctataataacctcaattaacttggtggctttatgctcccacccactcgctaccactttttttcctttgactgagtgtaacgcacgggcatctttttatactataacatatagatttttcatatctgtatgtcctccgtatgtacgaaagtgatcacgcgatcggtagcgttttcgtggcgatacggcataagtggtgtagatttaaatgtccaaaaactcggcacgatttaaattcagatcgcctcgttaaggtcagatcgtattggccgaccaggttatggttataaaaacacgaatgaagagaacactagcaactaagtaagctcgcatgagtgagctcaccatggaccaagaaatccaactgaaccagaggccatcgccgcagcgacagcaacaagcacaagaacatggcggcgccaccgcaccggcgccggcgccggcgacgccacaagatgatgaacagcaagggcaccaagcagctgtcgccaggcatggctgcggcggcgcgacagccgaacgccaccaccagaccaagctcacgctactcccgctcgtcttcttcatctacttcgaggtggccggcggcccgtacggcgccgagcaggccgtgagcgcggcgggcccgctgttcgcgctgctcggcttcctcgccttccccttcgcgtggggcgtcccggtgtcgctcgtcaccgcagagctcgccgccgcgctcccggggaacggcggcttcgtcgtctgggccgaccgcgccttcggcccgctcgccggctccctgctcggcacgtggaagtacctcagctgcgtcatcaacctcgccgcgttcccggccctcgtcgccgactacctcggccgcgtcgccccggcggtcgccgtcccgggaagcagggcgcgcacgggcacggtgctcggcatgaccgtcttcctctccttcctcaacttgggcggcctaagcattgtcgggtggggcgcggtggccctggggttcgtgtcgctggcgccgttcgtgctgatgacggcgatggcggcgccgaggacgcggccgcggcggtgggcggcgcgggtgcaggtgaaggggaagagagactggaggctcttcttcaacacgctcttctggaacctcaactactgggacagcgcgagcaccatggccggcgaggtggagcggccggagcggacgttcccgcgggcgctcgcggtggcggtggtgctcatcgccgtcagctacctgctgccgctcatggcggcggtcggcgccacggacgcgccgccggaggcgtgggagaacggctacttggctgacgcagcaggtacgtagtacgtgtgtacgtatatacgctgacgcgattacgatattgatgatgtcacagcttcttttatcaacaaacaaaacacacatgatgtctccggcagatcgccgtaccggtaattgtcgccgttgtttattactttatgagttatttactcatcatatgaaaaagatccaaccttacattttcttggtggaagaagtggccattattttctcaattattattatattattatacaaaaattgatgatgttttcgtctaaattttaatacatcatttacatttgagttggttatacgttgctcttatctaattcgacacgagtcagaataactattatacaccccgtcatagcccaacccctcctcgaccctctcagtccaacccaaccggctcacaccatcccgtcaccccatcccacacgcttccacttaaagctgggcgcgttactccccgatcggggtcctttttctctttttttttctttttctttttctcccaatacaaaagacactataattttttaaaaagtatcaatacaaaatgtttttaatattacttaaaatatgtgttcatatatttaaaaaaaatttggcacacgaagtaaacagagccttaatttcctggatagtctgccacaacaggctagccttaacgttggcactgtcagtttccaggataaccggcgtctgaatccattctgctgctagccgaagcccgtttctgcacgcaaacgcttctgcttcctcggcccactgacaactgcgatacatattccatgaagtcaggagcacgtcacccatatgatcgcgaatgacaatgccagttcaatcattcatctattcggctcttcagcgttccattcaattctcaatcttataaaaaaaagaaaggaaaaacaccactctcgacaagatgggttagagcatcaccaatgtatatgtcaaagtgatccatatagatgagacctatataaattgtttttccctatagcaatctccacagtgtatatagatacaaggtatcaatagaagaagagagaggagtagagatagataatataatttattccatatgggtagtccatatgcatatgggtatcttttgttattttttccatatggactagttgcacaatggttatagatggctgaataaaatattctattgcttatgaactacttttacaccacattgtggatgcccttacagcgacgaagcttgtgaggaatctcaagggaccagctacaagtattccactctaccaaaactacaattcactgtacgttgtgtttcccttcaaactttcaacttgtttgtcatataaaatgtttcgacagtacatacatggagcattaaatgtagacgaaaaaaaaaaccaattgtacagtttgcatgtaaattgcgagatgaattttttaagactaattacgccatgatttgataatgtggtgctacagtgaatatttgctaatgatagactaattaggtgtaaatatttgctaatgatggactaattaggattaataaattcgtctcactgttcacacacgaaatctgtaattcgatggttcgaatatgtgtttccattatccatacagtatacagtagcagtatatcgcaaatatcaaggcaacaccacagtagagggcaacaaccaacgagtcaatgccaaaatgggtaaagaacaaacagtaaattctactagcacggaactattccttctgttctgaagcgaccctatttgacgctgtatgttagactttttaaaatacttttgaccgttcgtcttattaaaaacttttacgaatattattaaaaaaaacttgaatagtagtagtatatttaacaatgaatcaatgattggaaaagaattaataattacttaatttttttaaaataagatgaatggtcaaacatgtttaaaaaaatcaacagcgtcaaatatttagggacgaagggagtaaatcataaggagtaggggtatatatttttgcatgaccttaaataacatactttgaacattcatttatttcatattatgtcatcgataactataaaattagtatcacataaaagtatttttaaaaatattaatctaatgatataatatacataatacttgactagatattattagtataactagctaggtgggccgcgcaattgcgcgtctagtacccaaataaaatcatatatttttcagtatgattttacttaaaatttattaaatagatatctcgttctcttaagactttaaaagaccaaaccttatcatcctcgtatttctaattatatagtttttaaaagtcacatcagctgctatgctaccccttacttcagtcatatccttctttatttgcttgctcgatctaccactatttctattcattctctttgaaacctttaaaaattggatcatatagttcttagagtttattgtctcattggtttcgtttttataatttttagaaatcccgtcaaacactgcaattatactcctctatgacccatccactgtcttttctctttattgtcattaggattttaaattttgaacataattatcattcgggtttatttttttactttctagaagtcccgccaaaccgtcagcgactttgccattgtactcctttatggcttgtccgctgcctcccttatttattgtcattaagattttaaaatcgaacatgattatcattagattttttttttactttttagaagttctggacctttaaaaattggaccttgtagtttgtagagattatgatcttattgggttttattttttataatttttagaagtctcgtcaaacgatgccactatacccgcctactgtttattgtcattgggattctaaaaatcgaacataactatcgttggaattcatttttttttattttatagaagtcccccaaccgtcggctgttctactactcctatacaccccgcccgctgcttctcttttttattatcattgagattttaaaaatcgaatatggttatcaatgaggtttatttttttactttctagaagtcccgacaactgccttacccatttgcttcacgacttgcctatcgttcctccttttaatcgtcattaggattctatttgatgttttattaacagtttttatatatcgtatcaaccgccaccgctctactctttataggcctgttacttgaattatctcatcatgtgttttaggtgatcttttctttcaatagtatttattttttttcacgaattttagttatttataaattgtattcctaattgaaatatttcctattttttttcaaatttcagaatttatttttttcagattttaattaataccatatagtgttcttttaatattttttttaattttagttgtttcaaaattgtattcctacttaaactctcttttagtttttctaattttggatattattttatttttattttgaatattaatcaatctcgtattgggttcttatatagattcttctttcaatattgcttatattaaatttcgaattttaattaattttaaattgtatttctacttgaactcttcttttaattttgctaatttcggattttatttttatttttattccgaatattaattaatctcgtattgggttcttatatggacccttctctcaatattccttatttttaattcatattgaaatttatataaatattcatattgtattttatgtacgtgttagttattaattatttttaatatcaacttttagttatttctaaattatattcctatatggactctagactcgtctttcaatattttttttaaattccatatttccgttatctgtaaattgtatttctatatagactctaggctcttattgcaatattatttatttttaattctgaatttttattatttctaattgtatttctatgtggactctaaactcgtctttcaatattctttaatttttaatttcgaatttcagttacttctaaattgtattcctatattgattttagactcttcttcccatgttttttttaatttcgaattttagttatttgtaaattgtatttttatacaaactctaaactctacttttaattttattatgtttattccgaattttagttagttttaaaacttttattatgtttatttcgaattttagttagttttaaattcctatatggattctatactctacttctaatattccttatttttaattatgaatttctataatctcttaattgtatttatatatggactttatactctacttctaatatttcttatttttaattccgaatttatattatttcttaattgtattctatacagactttatactctacttataatatttcttatttttaattccgaatttctattatttcttaattgtatttttatatggactctagtctcctcttttaatattccttatttttaattccgattttcagttatttctaaattatatttctatatagactctgtttttttttctccgattaatatgagaatttctagaccgtgggagcgaacatggagacttttttttatttctttaataagttaatagattaggtgcacgaaccgattgccgcatgagatttttgaggttgtgtgcgagctgacaactctgttctgtcatgtaagcgcgttgctcgagtggaccaaacccaccacacattctcaaacccgttagccagagatcaaaatctaacataccctgcatcttaaaatggtttttgttaaaatatacaaggagaaattgaagaattgcggtattatttcagtacagcacgtaaatagtaagaccccttcccactttatatgttgtgcgcaatccgactgggctgggccggagataaatgtgcaattgatggctgatttggcccaaggatagcattatcaacaggaataagttcatatgagatctcttaacttgttagcgaatccgattttcgtccttcaaccggaaaaccggatacaacaattcctcagctgtcaaaaccggtgcaaaataagtccaaggaggtttggatggcgattacagttgatgtagctgctatgtggttaattttactcggtcatcctctaacgtggcattgacatgacgcttacgtggcaatttgatttggaaaataataaaaaccctgggcccacatgtcagtacccaaggggggtgggcgaagcatgcangggcagcaggcgagagcggcggtggtagacgagagtggtggcggcgaacgagagcggcggcagcagctgctggcgccccgtcgccacccaactccggtgacgcctgccccctgctccgcttcgtgaggagatccacattgacctgctccgcttcccggggcggcgcgaacactacacgagcgtcggccgcgcgtgcccaccattttgcgcgtcatcccctccgcctctcgccgccagcgatgtcatcgtgccagccacctctcttccctctcccacgacaacgacgacatggggccagataaatggaggagcgcgaccggcatcctctccccccctctcccacgacgaccacggtgacatcgacgagaaggcgctggggcagcagggggatgacaccgatgagcaccctgatcccggtgctgccttgtcgccccgccacccctgcctgcttcgcctgccacacgctcgctcgtcgtgctcgcccgctgcccctgcttgcttcgcccgtcgtgcgcttgcccgccgccgccgccatatacatgtgggccccgcatactttattttttttttatttttctgactgggatgccacgtcagcgaaatcaggtgtctatactcttatagacctaaattggacgcttttatacagtctagggatgaagatttttgatattgaggataagggatgtaaaaaaaaaaactcggtgtaaagttgagggacggacttattccccgtaaaatatgaacatgttaggctcgatttaatctcagcccagcccatgtaagttttacagattggccgtctgatttgacgtgattttcgatgcaggcatcatcggcgggcggtggctcaagtactggacggaggccggcgcggtgctctcctccgtcgggttgttcgaagcgcagctgagcagcggcgcgttccagctcctcggcatggcggagctgggcctcctcccctccgtcttcgcccgccgcggccccggacgatccgccaccccgtgggtcgccgtcgccgcctccgccgccgtctcggtcgccgtctccttcctcggcttcgacgacgtcgtcgccaccgccaacctgctctacagcctcggcgcgctgctcgagttcgccgccttcctccggctccgcgcgagggaggagagcccctcctcgctcaagcgcccctaccgcgtcccgctgccgctccccgcgctcgccgccatgtgcctcgtgccgtcggcgttcctggcgtacgtggtcgccgtcgccgggtggagggtctccgccgtcgccgccgcgctcacggccctcggcgtcggctggcacggcgccatgagggtgtgcaggtccaggaagtggctcaggttcaacaccgcggttgccgccgaccatcgtctgcaactacaagatgctcctcctcctcctgctggtagagtctgaactctgaacccgttttggcagatttcgtcttgcgaaaagatgaaacacggtaagaaactcgaaatatttgctagtagaagactaattacaagctatactagtacaagactaattacatggttggatgaagctctaaagttggcgttttcatatttgttcctctaattaatcaccgtgtacgattgtggttcattatcagagacgcggtttaaattgaacggtctgtctctctcaaatctgaaatggtcacatttgtagtgaagtggacatccatgaaatggcgacaaggaggcggacatgatcatattcatatccacgtactaacccagctcctcttttgtggcacacgcggctccacactacaaacctccgttccgcgccacaaactgcaaccaccacacatgctccatcgcccgtagtcatcctacaaaccaatagacaccgcgcgcgcggaacgccatcgctgccacatctcatggacgacgtgtggccgtggctggccggcctggccggcgaggagccgccgccgccgcaggccgttgtcgcccttgccgccttcgctgacggcaccacgtccattgtcctgcaggccgaccacgtcgcattggctgaaggtgatgaggaagagaagactctagtagatttctctctcgccttgaacagcaccaatggcggcgcagcgcgcgtgctgtggacgtcgggtcgatttgaggccgcctccggtgtcgcgttgcagcggcagctgctggcgaggctgctcgacgaggtgatcacgctctcgccgtccgtctcttgcttgagcggaaacctcggactcggagtcggcggcgcaccgaagtcgaagttggacgaggagatcgtcgccggcatcgggaatgattctgccgcctcattcttctcgctgactctccttctgcgcctcttctggctgtgcgccaccgaggcacccgccgacaccgggtttctcttcttccaagctctcggcgccgacatccagcgcgctctcgtggactgccgcccagcgctcgccctgttcctggcctccctcggcccggacgtcgaggagcggttcatgcggtcgctcggctacatgctcgccaagctgtgcttgctacgggagatgcaagcggatgcggatcagccggcgccggcggcgacacggcgcccgcgcgcgctccccgcggcgtgcctgtcgtacgccaccgaggtgcacgggctgtgggttctgagaggatacgcgccggtgctcgccatgccccgtgtcacctgcgcggcatcgacgacggcgcccatcacggcgctgccgcacgaggcgccggaggagccggcgctgaggtacggcctggtgcaccagcagctggaggtcgtggcgcagctggagtacgccgtgcgcgctcgccgcggcgagaggttcatgaccgtcgccgtgcgcgtcgacaacgtccgggtacgcgtcgcgcggctcgggttccggagggacgacgcggacgctgacgccgacggtggcgacgctcacgacgacgccatggacggcgagcgccatttcccgtcccgtctccgcctctgggtcggccctaggttcggcgcgtcgtacgcgaccggcccgagcctcggccggtcgacggggaacccggagcaggacgtcgagacgacgcgcaccgtcaagggcgccttcgccgccgccggcgccacgaagctagccaacggcggcgtccctccgaggatcaaggccaagacgcggtcgtcggcccgggcacgcaaccggagctggcggtgggagcaggaggcggagggcagcgccggcgtgttcgagggcgtgctgtgcgacccggccaccggcacggagatctcggcgtggcgcggcgacaacaacaacaacaatggcggcgccggtgacccgcgcaacgggatgcggcggcggtacggcgggccgggcagggcgttcagcaagatgcgggggctggtggtggccggcgacgagctgcccgaggaggtgacgtggagggtggggagggaggcggaggggagaacgctgccgtggcgcgtggggctcaaggcctggttgacctaccttcccaaccaggtgaggagccaccatttcgagacgaggtgcgtcgagtgggcacacgaggtcgacctcccgcttgccgccgttaatggcgacgagaggtaaaaaaaaaaaaagaaaatctctctttatatcacctatgaacacatactagccaaaagaaatgaaatgatcttatgcacgtattgtgtatatgaaatgaacagctaaaataagaggttaagaatctaaattcagatgctgtccatttgcaccgatttttctttttttttcttttttttttcgcagggcatttgcaccgactttaagatagatcatcttaatacctgatcggagaccaaatcgtaatggatgcaaaactatttctataagggcacaactattataccgccgtaatggtataaccccccatttcaaatgctcatgcgtccactcactctcccactccatgcgagcacgcaactcccgacacgtgagcgcctgacacacgccatatgcatccattatgtgtcaagccatcttgatatgtatttatcgggctgaacctactagtcaagtttggttggttctagagaccaaagggtgggaggtttcgactccattcggctgggctagttcggttgttccatctagctcttttctcattatcaagttctcaccacacatatattcatagtcttgaccagtacatgtctatgatacttaattgatgcttaaaagtatcatcacatatataccttccaaatggtactcgtgtcgagcgatactagtcggcatcagacatcatcccctgatacatatcgataccaagactatactaatcagcactaggtccgataacgtttagtaccactctttgtaccctctattggtaccaggccggtattaggggcctgtttggtagagctctaactcctaaatttatctccaggagttgggtctaaagtggagttgtagagctacctaaacctaactccatctctctagttcattttgtgagagacctccacccaagcccactcccattttaggtggagctgaaactgtttggctgagctccagctccagaagaggtggagctggagttggagctgtgacaaacaggccctaggtctaatacccatcgatgctacacatggtactcctgatacccatcggtactaagctaataccgatcggtactaggtagagtatattggtcagtacaaacttgttacccttattagtaccatgtcgatatcgggtctgatactcgtcgataccagagttactactcctgatacccgtcggtacctatgtgataccaattggtaccaagtctaataccaatcaatacaagacttagtagccctgatacccgttgatatcagactaatacatgtaggtataaggtttgatacatatgtactagcctaatatttgtacgatattaggtcctatatcttaggacaaagatatgaacctccatcggaaataatatgtatataccaattgaaaaaaaagaagaaatgaactctatatagcaaaagaagtgaagaaaaatgttcacttttacacttgacaccacttaagaaaagagtatataaattaaaaagtactagctataataagttggcaagaaggtcactaagctcagtcttatcgcatgattagggtaatggttttattttttcatacatctttctcttttcttctcattttgttttgccgccccaacatctgcagtgaacagttagacagccatagagtaggctgatcgatagttgcacgttctgacacatgtcatctgtaccgaaccacgtgcaaagttactaaccatatatagacttgtgtacccacgaagtctgtatgcaagaaggaatataattccataagctcatgtagtttcttacattaaacttttacagtcagtctaaaagcaagtttaataatattagagcaagtttaataatattgtcaactaatatctttaaaagttaacacatatcatctacagccaacctaatagtatgttcactcatacaatagttagttgcaggcccggccacaggagaggagggggagggggttgagatatgccaccgcacagggcccacaaagtgaaggggcccaa

SEQ ID NO: 16142 - DNA, 601 bp, Oryza sativa
cttccgtggagcgtggggctcaaggcatggttaaccttccttcccaaccaggtgaggagcccacaattcgacccgaggtgcgtcgagtgggcccatgaggtagacctcccgcgttccaccgttaatgtcgaagagaggtcaaaaaacaaaaagagaatctctctttatatcacctatcaacacatgctagccaaaagaaatgtcatgattttatgcacgtattgtgtatatgaaatgaacagttaaaataagaggttaagaatctaaactcagacgctgtccatatgcgccgattcatcatgggcatcttttcttcttcgcagggcataggctccgactttaagatagatcatcttaatacctgatcgcagccctaatcgtaatgtatgcaaactatttctataagggcgcatctattatacagcagtaatggtataaccccccatttcaaatgctcatgagtcacctcactctcccactccatgcgagcacgcaactcctgacacgtgagcgcttgacacacgccatatgcatccattatgggtcgagccatcttgatatgtctttatcgggctgaacagtctagtcaactttggttgga

SEQ ID NO: 16143 - DNA, 1113 bp, Oryza sativa
cagtcagtctaaaagcaagtttaataatattagagcaagtttaataatattgtcaactaatatctttaaaagttaacacatatcatctacagccaacctaatagtatgttcactcatacaatagttagttgcaggcccggccacaggagaggagggggagggggttgagctatgccaccgcacagggcccacaaagtgaaggggcccaaccccatatatgctgtatataatagcccatagaaattaggaagcctattagcccaggagagaaagagacacacctacgtgaagaaatttccatcattttggcttcctttcgtgctatcgcctattcgcctccgccgcccttctggccacgtcatcttattaaagggcccatttttctaacttcgttctaggccactaaattgacacgacagggccgggttagttgtacatatgtatgatgcatcattttacaaatatgtgatcctgtttaacatgggaaatactaatgtatgttcaggtgtacgcatggatcctaatgcgaatctgacgtctctccacttgagtgctattgcacccgggtgcagaaaaatactttccaccttaatcaaccaggttatatacgcacgatgcgtacaagaatgcagggcactgggaacacactaactagcttgcacttgtgttacttagctagtataattaattaagctcactcgatcgccatggaccaagaaatccaactgaaccagagaccatcgcagcgagagcaacaacaagaagagcatggcgccaccgcggcgatgccgccacaagatgatgaacggcaagatcaccaagcagctgccgccgtgcatggccagggcggcggcggcggcgcgactgccgagcgccaccaccggagcaagctaacgctgctgccgctggtcttcctcatctacttcgaggtggccggcggcccgtacggcgccaagcgggcggtccgcgcggcgggcccgctgttcgcgctgctcggtttcctcgccttccccttcgcgtggggcgtcccggtgtcggtggtaaccgccgagcttgccgccgcgctcccggggaacggcggattcgtcgtttgggccgaccgcgcgttcggcc

SEQ ID NO: 16144 - DNA, 2523 bp, Oryza sativa
agactggaggctcttgttcaacacgctcttgtggaacctcaactactgggacagcgcgagcaccatggccggcgaggtggagcggccggagcggacgttcccgcgggcgctcgcggtggcggtggtgctcatcgccgtcagctacctgctgccgctcatggcggcgatcggcgccacggacgcgccgccggagacgtgggagaacggctacttggccgacgcagcaggtacatggttatcaaacagtgctctctcaatggcattataacgacggccagcatgacagcttagaaactcttttcaaacatacaagcaagcattggaaaatgaaaagtacctcaacaaaatgaagatgcaacactagagcatacagataatttgtcaaacaagagaaaagatatatttatttattgccattttaatttgagataaattaacataaataaaaacatccccgcaaaaaaaaacataaagaaaaacaaagggaatataaagacagtaacagaagaagtttgcctcgcggtcacctaaagcctgcgccctgtggcctgtgacatcccgtctccataggagctgaggattatactgacccctttcggtataacgaatcggataatcatttgctcagattcgtggtactgggagaaaacatatcttttactaggtcagaaaccaatgatccaagaatatccaaaatgaatgctctagtgtaatgctcaatttgccttttttcattgcattatctggcatcaacttgaactgatcccgtaatttttttaagctgatggagtagttagaacatgtcatcatcccgtaacttccaagtcaccatcagctgcctttcgcttttttttgcttcatcacatgttttactggagtaattccttgtaaggtctcaatttcatcaatcgatggaccctctgacttgcctatgataggctcaacttaaattgataagcccatagacaactcacatcttgcaggacgccatcattctactaatgctccaattagaaatctgtctatactcattccaaccatctgagcaacttgataaaatctaagcctcttcaatagctgctcacataaataatagtatggaatgtcaacatggtgatacctgacacttgcaccatcattatcctacatacatagggtaaaaattagtcaatcattctttttttggaaacaagtatatgaaacaagctaacgacaacttacattttcccaaactattgagattttgtactggcagtggggcatccacagcagtgcactgaaatgttctgaaacacttttttcagtttgctgaactaaagtttgatctccatctaataagcctagctctccatcagttcttgcagctgaccaacgagcatctccaacagtctctccaaatctaactctctaaatgtctatttggccaactctccatctaatttggcaagtcaaactcattgtttactccaacagcctcctcattcatcctctctattatgagtctatgacaataggacccacatgtcaatctctacaactcttttttcttcttcatctttctccccttctctccaaactccaaaccccctcccctctcccctctgctgccatccgcctccgccaccggcgctcgggctccatcctcatctgccgccgccgcgagtcggcgacggcaaggcggcggaaggcgaggggcaaacggcggagatgtggatcttgtaggggatcccggcgtccttgagtggcttggccaggtcgtcggccttggacacggtgaaggcgttgaagtcgtcctccatcttgcgggccgcggcctcggcgtcgtccttggcggacggcgggttgcccatctgcccgccctcgccgctctggctccgcccgctattgcagctctggccgagcttgggctccatcaccatccgcctgccatcgccgctccggctctgcccccatcagccgctgcttcggcaccatccccatctgccgccgctacttggctgagctcccgtgcttgtgcgagaagagagagagggaggggagagaaagcgagagagaacgtgggtcccactagatgagtggatggccagccggcttgactggctagatttggctagcgggaactcagatttggccaaccagatggcttggcccttcggttggagagcctgttggagcacgatttttatttttttagaattgctaaaatttaacttggccagccatttggccattctattagagttgctctcccatctagagtagtcctcatcttactacttgtcttaaaaaaaattaatagagcatgtccaacaatttacaattggtatatttttttctgcaactaaaaaataaggattgtacgatgattggtcctaaagtaaaactaattcattttttccagattatgtgcacactattgtctccttaatcatcttgttatgttgacaaaacaggaattgaacagacaaatcttctattatatactaaaagttcattaaattttctataaacgctctcaaactg

SEQ ID NO: 16145 - DNA, 571 bp, Oryza sativa
gctccacccgcgccggtccaaaaccgggagccagagctctcgctcccgcttctctccctccccgaaacgacatgatcaagctcctctttcccccttctttttctctttttccaacctcagccaccgcacctccactgccgtttggccgctagctccgagcacaaccgccagctcgctccccttgatcgccccaatgccggttccttctcctcgacgccccaccccgcgcctataaaacagcagtcgccccgtattcggtgtgtttgaaaataaatgaattatgaaaactcgcgatacgggggttgtgcctgcgtggcgttgtcccgtattcgcatataaggatcgattcctgtgggaaactcatcaagcataacaaagtgcaaccacaaggtggtatgggacaccctagctaagtaactagtcggttcagggaaacctcgcatgccaatagttgggaacgcgggggtggggtcggttggagccaacccgggttcctggtaaggcaagaacgcgaagcttgccagattaccgatcgaggtggttggagtttgatttgtgaaaactaaatggc

SEQ ID NO: 16146 - DNA, 613 bp, Oryza sativa
tagtagcatcaaagtctccagcaacctgcacagacaaggtattttagaaatttaaatgggtggtgttatatccacaggtgagatgagaattaaagagaagaaagtacctcaaaactaatgacaccaccaaagccggtcatctgactcttggcaatgtgatgttctgggtgacttggcagaccaggatagtagacacgtgcaatctaaggataggaaataagagactcataaaaaacaacacaacaaaaagaactactcgtagcttcatagcttgtacaacaaatgaaaagtgcagagtttgcaaacctttggatgttcctctaaaaattgggccatccgcattgcagtattattctgacattgtacacggagatgcagtgtcttcatgcctcgaagaatcaagtaggaagcattctggtatcataatggcatgaaaagttaagagacaagagaccagaatattcatcaacagtataacatacagaaatagaatgcaaagacattcacaacttcaattcaaatcgctttcagacattcacagctgcagatcatctattatagtgtgttatctatttctgtacaattgacgattttaattacagaattacctaac

SEQ ID NO: 16147 - DNA, 499 bp, Oryza sativa
agacacggtttaaatggaacggactgtctctatcagatctgaaatgggcacatttgatcagaagtggacatccatgatatggcgactacgatgcggacatgatcatatttatatactcctactatcccatctcctcttttgtgggacacgccgatacacactacatacctccgttccatgccacaaactgctaccaccacacctgctccatcgcccttagtcatactactaaccaacaaacaccgcgcgcgcgtaacgccattgctgccacatgacatggacgacgcgtgggcctggctggcccgtctggcctgcgatgagccgccgacgtcgaatgccgttgtcgcccttgacgtcttatctgacggcaccacttacattgacctgactgccgaccacgtctctttggctgaaagcgatgacgaagacaagactctactcgatctctctatctccttgaacatcaccgatggctgcgcagtgcgcgtgctgtggacgt

SEQ ID NO: 16148 - DNA, 3674 bp, Oryza sativa
  unsure (1)..(3674): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctgtagcggatccggtggcggtggcaatgccgacggctcccgtgggcggatccagcttgattgttgttgtgttgttgcgatgatgttgttgttgtgttgctgtgatactgaccgatggattgattttggggggcgaagtagggggaatgtgctcggtgatgatgtattgagcatttttttttcatcccggaaaccttaaaggtactggcacctttgaggagactcaatggtgccgccttctaagtgtaggttgggaaatccgacacctattgccgcttcccaactggcaccaaaggtcttttctgcagtagtgttgacacttcgttcttcaacatgcctcttatacatgtacatggtgatgagtgacaatccttgcatagatttgaattggcagtgatttaccttgtatttgaatacatgttccatataacattgtgataccacctgagattgaatgactcaacagaatgattagattgatagaaatgtggagtacatatataagcgtaatccttccattatccacttacagcaagaaatatcgggaggatcggctaagcaaaacacgggtacatgccatatacaagtgaaacactaccattttcttccatttttcatgttttgcaagatgaactgtgccaaaaatgggttcagagttcagactctgtccgccgcaggaggatcatcttgtagttgcagatgagggccggcagcaacgacggtgttaaacccgagccacttcttggacctgcacaccctcatgacgccgtgccatcccacgccaagggcggtgagcccagcggcgatggcggagaccctccacccggcgacggcgatcacgtacgccaggaacgccgacggcacgaggcacatggcggcgagcgccgggagcgggagcgggacacggtaggggcgcttgagcgccgcagcgtgcctcccgcggcagcggagccagaggaaggcggcgaactcgagcagcgtgccgaggctgtagagcaggttggcggtggcgacgacgtcgtcgaagccgaggaaggagacggcgaccgagacggcggcggaggcggcgacggcgacccacggggtggcggatcgtccggggccgcggcgggcgaagacggaggggaggaggcccagctccgccatgccgaggagctggaacgcgccgctgctcagctgcgcttcgaacaacccgacggaggagagcaccgcgccggcctccgtccagtacttgagccaccgcccgccgatgatgcctgcataaaataaatctcttagaaatcagggttttaaatttagaaattgctatttctgctgggggcaccgaaattttagaaattttaaatttttttggccgaaattatttaaaattttgactgattttgaatgaatttgaataatatttggtcaaattctcaaaaatatgcagaaaaacaaaaaattccatgcgagatatgagcttgctggtgggggggggggatttcagaaattttgaaacgaaatttcaaaccctacttgaaataaggttgtcgtatgttctgtaaaaacttctttgggcaatgcgtgtcaccctgtccatattcgttgacgctggatttgaaacacgttgggtggagtcatgtacagatgattacaccaccacactgatgcttcttttaaagcacgatattagtttgaataatttgtccttaatcttttgtgtagaaagagttacaaaagtggaacacgataaatcttcatattaggataaacttgaatatctatttgtttatatgcaaaacctgatcaagttaaattgtggtagttacacacgaaactgctattcggtgaccagtcgtgcgcgcctctctccgcgcgactggacacgtgtcacgtgcggagaggggcgccggacagcgcgccgcgcgggaggagctccgtgttttcccttttttttttcttttcggtttctctttttttttctttcgtatttttttcggtttcgtttttctttttttctttccgtatttttttcgtttttaatacgtatgtatgcaaactttgtatacgtaaaaatataaactttgtatacgcatgtataaagtttgtatacacgtatgcaagctttgtatatgcgtatataaggtttgtatatatgtatacaaactttgtatatgtgtattattttgggttttatatgtacatatacaattttatatacatgtatacaaagtttgtatacacatatataaagtttgtgtacatatattttttttaggttttttatacatacgtatacaaattttgtatacacgtacataaagtttatatgcatatatataaagtttatatacacatattttttaggttttttaatgtgtatatatttttttatagtagtagtactaatagtagtaataatagactagtagtagtaatagattagtagtaaaaggtactagcagtagtcgtgtgcggccccaggcgcgcgattagtcgcacattaggcgcccccagttacacatccttaataatgttcttttatgattgaggttatttatgagaggtagtaatcaagaaaagaatttatgatgcatgtataaataaaaaaaacgtactacctctattctaaaacatagcaatatattggatatatctaagtgctataaatcttaacatatcgatccatgtttagatttattagttttataatattagaatatatcatatctatatttagaatagagacagtaatatactgctagctttatatcatccgaccatgatctatatttatgcttacttttgtctgttttggtagctgtgtgcttgtttgtttcataaccgatctaggcattggttttgcttcggcatgttggtgttgttgctgatcttattgttctcttgccttggcttttgcgataccggaacagacaaggcattgtaagtagctttggtagagcggaacagatatgcaactgccccttgagatttctcaaaactcactagcagcttcgtcactgctataacccattttgttcagacagaggtgctgtgtgtgggtcaaggatatgtgtattacaatatcaaaattgatcctaaatgcctgtacaatgatagatgctactactctgttttctattattaagaatattttgtttcattagaaaaaaactttaattaacaatatatttaccaataatataatttatgtgatacaaaagcataattataagtaagtacttctgaatataaatccatctatctaataggggatacaaatttgtaaatttgtcacctaaaatcgcacattgataataattctaaaattgcagtagtatgcaatgtgtaattttactccttttaactataattttgttgtcatatttagctttacattatttttatttaggtttgaatattttttatataatttgtaaagtttatgaattgtaaatttatttcatatattgttatgtttaaatatgttattcaacctttttagaagaaaaaaaaggaagaagcaatgagaatcactgattaccatcaaaggtagaaaaaagtgacaaaaatctagacgtacgctcccaa

SEQ ID NO: 16149 - DNA, 5262 bp, Oryza sativa
atggtcactccatttcgctcaacccctgcgactagctaatctaccaaaactatgtactgctgccacctagctgcaccacccgactaccacacatcaccgaccgcccgaaccaccactcccctccccgaccatccctctaagcttcagaacacccctctccccggcccatagccacactcacactaaccctcatcccgaatcctaatctagcgatgccgacatcctctcatcatatactaacgtttacattgtaatgaaagtggaatgatggggacattggtgttgttgttattagtgaaaaaaaagagagataaaagccggaggagagttgaagaaaaggtagaatacaactcacaatgatcggattttagtccaatggtaaatacaaggtgacactgtgaatagtttactgtgatacaaatttataacttattaaaaatgccatgatttatcttccattatagggcaacattttcgagtttttattctaataattctatttcaaatttattctagcgagatggcttattgtaagggtcagcgaattgctcttctatctgttcagtttgctttaggcttgatgatttgatccttaatcctttcttccgaggccatttatactcgaagaaataatcatgggatcctttgatataagtttggccgaagtcgagtatgtcatcaggattttgccaaagttgattttttttaattcagaatcctatcctcgttatacgtatgtgggtgaggatcctctaccataatgccactgccattaggccagtgatgcgtggatcccaccgtcctattgccccacatgtcaatctctacgtacacatattgggtatgatatatgtggactagcacatccatacatctatggaatatctcatactcccttcgtctcataatataagtatttttggagttagaaacgattattaagaaagcatgtagaattaaatgaatgagggttgtgattagataagaagtgaggtagatggaaaaattgaatagcggagggttgtgactagttgtgaagagaatattggtaaataaattgttatattttgaaataaattctaaaagagttgttatattttgggacggagggagtattatacagtacaccgacaaccatttgaagacaaaaaaaaatactggtgtggaaatggtttgaacatatttttttcagacttttttttcccgctggacatagaggagcaagttcgccgcacatatcctaaccagaaagagaaaaaaaaaagatcggacggtcgctccagcagcaagatagattgtgcgtcgacatgcatgattcatggcaatgatagtgaaccccagaatttagtacagccggagatcgatgagctcacaaccttatctcatctaatcatgatttgattttttgattagttagttttagtggccaccgcgtcggctcgcaggacaggacaaggacggacagtgctgagcaaaatggcagctgcctataaaccaactgcggcagattgtttacgacgcattacatttgttagcccatccatttaattatactattattatcgaacgcacacactgcacgcacccatccttttgctgcgatccgccaatggccaccaccaaatttgcaagattctgcagatcttgtcgctaccagggccaggatgtatgtttctttaagaagggtattatttcctcgacatttacatccaactggatatatacaatcatttaaattgagaactttgtttaaccaaatatgaaattcgctcctataaattaggaacctagtcccgcaaacaatctaatctgaaattcactcctatgaagatttaaactcagaatcttatgatgctattcagatcactgcaaccaatagattacatgctctttttgcattgttactgctgctgctgcttattgccaatcattttatttggtggagaagaggaggacggatcggatttctctccttatctccacttgcagtactcaaaagaaagtctgatgaagcgtttgcgagtgtgtgtgtatgtgttggtagtgtttgtctggatcttgagacagaaatgcttttgcatgatcgatatggcgtcggtttcggcagcactgttgaggcacgaacggcttcgtttctccgagaaaagtcgttctggatttcagtgggtactaggctgctttctggcgacgtgatttgtcgtctccaattatccagagagagagagagagagagagagagaaagcaagtagaggtcatgtttgctcttccgaattgttcttgttgctgttccgcggctgcacgagagcttgacgcctcaacgaccaccttgttctcatgatcctcccattcatctttgattttaaaattttaaggagtgactacactacatatgcaggtggttggtagtcagtttttaaaattttgaaaaagttaaaaaaaatccaaagctcttgacttctagttttctgaattgcttgagaaagctagatattttgaaaaaaaaatttgcaggtgcgagaagttagtttagtggttgtgacctaagtagtacctcaagatactgagttcaaatctttatataaaagaattttagattaggttgtttgagggacaaaattcccaatttaaaaagaccgcatacatctgttttgatgcaaaagttgggtaaaaaaataccattctctaaaaagagaagttaaaaccaaagctttcatatccaaattctgcaaatcaagttcaaatagggttcaaagttgcgaaaggacctgtaacctagtggttacaagagtctcagtagcatctgaggtcctaggttcgactccccgtgaaagcggatttttcaagatttaacgacgttgtgctttaataaaaaaaatagggttcaaagttaaatccactaacacttcgggatttgactgaacagatggaccgccggccaaacgaacaaacccaccactcccactgtcccacgcaacgaactgaagctcatgcgatcaaaaattcaaggaataagtccacatagactcccttaaaagtgacccaaatctaatatgtaaccctcaaccgcaaaaccggataggataggatgactcccgaactactgaaatcagtgcaatttgactccctcagtggttttgctgatgtggtgctgacgtggaaatattgacctagttttcgtcacacgtggcgcttacgtggcattacaattaaaaaaatatatgtgggacccatctgtgattcacacaaaaatatattgtggtccccactgacatgtgaggcccacatgtcatcctctctctctctttcttcctcctccctctctcccccttttctctccaccttctctctcgtggagcaatagacgggcaggggtagcgacagcgggcgggagctggagcggcggcggccggcaatgaccggagcggcagcggcggcaggcgggctcgacgaagcgggacttgagcttggtgagcgacgaccggcggtggagtagcgcggcaacgacagcggacgcaatcccgtcgcgccgcggccgcccatgcgacaagaggaacgccgtgccgggggagaaaggggagggaggagaaagagatgcggatgcaggggagtgggtgggtcttcctcgccggccgaccggtcaagggcgtcgagggctccgccttcgtccatggcgcttggattagggcgcggcggactccctcaaatataggtcaagctgcagtttcactaattcacaacttccaccgcctctacctcgccacgagcacgagccaccaccacccctcgccgacatcgcttcgtcctcgtcacaggagccgttggcttcgtcggctgccacgcaactgccgccctgcaaatcacaacactactaaaatctgaactctgaattcctgaatgcccagttgtttggtcttcacaaatgctcctatatatacaagacaattactaccgcaagaacacagaattagatcggttttgcagtagcacacacaatgatccaaggaaaatggattaacatcaatggcagtcgttttcagcacgcggaactcaggaggcagatcggcaaggcgatcgtcgtcgtgagtagtctgaagctctgaaacgaactaatcgacgagcggcacatacaggagaagataatcggtggagagagatctcatgagctgttgctatcgcattcaagcgccatgaccagtacgccgttgctatcggttttggggaggctttgcaacctccggcaacggcgtcgtcggcgtcaacagcggtggcggcgcagtcggaaatcctcctcggggtggcgctcccggacgacatcgccttcctggctggaggtggagcacggcgatgggatcggggcggccaccgcttcagctcccgccggctgccaccactccggcccccgcccgccgccgctccagcctgtgctccccgcagccggccgagagaaaggaagaggggaggaagaagaaagagagagaggatgacatgtggggcccactgacatgtgggccccacaatttttatgtgtgaatgataaacgggtcccacgtatacgtttttaattcaaatgccaccaaagcgccacatcaaccccacagattaggtcaacaatgtcacgtcagcgaaaccaccctccaaaaccaccaagggagtcaaattgtaccggtttcaatagttcgagggtcaggatatccggttttgcagtttaggatcatggattagattcgggtcatttttaagggagtaaaagtggacttgttccaaaattcaaaatggacagttttttttaggaataagttcacttggtgaccctcaaaagtgattgaaatttaatccgtaaccctaaaccataaaaccggatatcttaacccccaaactatggaaatcggtgcaatttgactccctcagcggttttggaggtcggtttcgctgacgtggcggtattgaccgggtcttctttacacgtggtgttgacgtggcatttagctggcatttagaattaaaaaatatgtgtgggacccatttgtcaatgacacagaaaatagattgtgggacccacatgtcccttctctctcccctccctcagttccctctctctcctcgtcgttccctctctctctcccgcagcaggcggagacggaggtgcggcgacctgcgagcggcggcggcacccgggctgagctccaccacggcgaagacggaggagaccacagcggcagcggcgggaggcacacgcggcggggtacagcgagctcggccca

SEQ ID NO: 16150 - DNA, 4525 bp, Oryza sativa
cccacaattgtgtatgtgaatgacaaatgggtcccacgtataactttttaattgaaatgccacctaagcgccacgtcaacgccacgtgtaaaaaagacccggtcaataccgccacgtcagcgccacatcagcgaaaccgccctctaaaaccgccgagggagtcaaattgtaccgatttccatagtttgggggtcaagatatccggttctgtggtttagggtcacggattagattacaatcacttttgagagtcaccaagtgaacttattccttttttttaagggtgaataactaacatggtcactgaagtttcgctttgggctcagtttagttcttgaggtttcaaatcgtccaaacaagtcctccaaattaatcatttgggttaatatagtcctttgaccaaaaaaaaaaagccatgtgagcatgctaagtcatcctcgcatgcagcggtatgaacaaaatgaccattctacccttatataccatataaaaaagaaagaagataaaagaagataaatgtttcacacgtatatgatcgttttataattatcacttacgattgctgcagcgatcatgtaaattaacaatgttgggactgggctggcctgttattttttctgtttgtctttttttttctatatggtatataagggtagaatagtcattttattcataccgctacatacaaggatgacttgatatgctttcgtggctttttttttctaaggactatattaacccaaataataaatttggaggactttttttggacggtttgaaacatcaacaactaaattgagctcgaagcgaaacttcataggctattcacctttttttttattggaaaatggagtcgtacaacgtatactggtaaaaaaaaagtccaagtatatttggtcccgtcagagccccatcaatcgaaattgttcccaaaataaaacaagatcagcccaacctggtctatccgctcaagatactgagcagattcaatgagatgccaagttggaagggcaggtcaatctagaaatacagatgtggacatactgcgtagttactgatgataccatgttggtgcttagtatgtggtatatcatgtcagcgccaggatctcgaaaggattatgacagttttggaccggaatgacacactttgtcaaattatgagacctgaatagcacaagtttagagaccggccgtgcactttactctataattcaaggaacaagccatacataacaaaaaaaagtgggttcaaaaagttaaaacaaaatgatatatatctcatcaccaaaccaatcttttgaaccatatggtggaagttacgactagaattccatcgatgctatagaacaatcatgacgatagtatgattcatatctggactaaccataggcttcagggcatctaaacgaatttcaatattgtctcctaggtggtttcgattctgctactgtaactcggatctgtctgccatccatgtcctgcacaacaaagaaaataggcttgttttagcacacactaaaagaacaatgatgctgaaagacatatgagaataagaaaccagccagacttagtgaaaactcacagcgccatcaagatttgaaactgcattctcaacctcttcagcggaaccatacgtgacaaaaccaaatccccttgacctgccactctccctgtcatagatgaccttggcttccaagacctccccttccccactgaataggtttgcgagagctgcattgtcaacaccccaagaaaggttacctacatagaccctgttggcctcacccctgggtgctctctgcgatgattgctcccttggtggtggtggccctgagttaaccctcaaagatctcccatcaagtatctgttttaagaaatgaaatcagcaaattagttaagcacaattcaatgatgttgtataggatataacacaacatatgtccagcaacatgccagaaaagagtaaattaaagtttgttttctagtcatgaataagctaaaagcaaacaaggattaaaacaagcaagcaggttcatatcgagcaacctcagctacagttatcttgaaagaatgcaagccacagcatgcaaaccaaagagatgaaataggagcgcactttatgcaatatatttttagccagcccatataccaacatggagcaaaaataatgacttagaagtatggaagcatatactcacatagccattgaattgctcgacagctgcctcaacttcttcaacactagacattgtcacaaacccaaacccacgactccttccagtcagcttatcatagatgacctgcaacaatgcagtttagcatgatacaatataggaaaaatcaaccaaagccgagtactactcttaaaattgagcaattaaccagaaaaatgcaatcctaaatctttcgccagtcacagaattaatagcatgagcgccagcacaccaaatttaacaaccttaaataatggcaaccttatcgcatccttaatcatctccaaatacaacctcacaatgagcacccgaaataagtttttttttcttaaaagaacgagaatatgcccacactaccatatgcaacccaattgtatcgcggtttaagctaaattaacaacagaatgaatttgtcgtgaactgtaatatgaagcaactagacacaatcattcatcaccacttcaccagcgaccagcggtccatttctggtttcacaaagacagggacacaccagcgagcgactcgacgaaggtggtgtgataggagtacttagtaaggcgagacgaatggggtggtgacctcgaccatctcgacggagccggcctgctcgaagaggccggcgagctgggcgctgtcgacgctgaagggcaggttgccgacgaagaccctcaggtcgtcggagaactcctcgcccccggagccctcctcctcctcctcctcgtcctcctccgtctcgacctcctccgacacggccacggccaccggcacgaaggggctggtcctcctccgcggccatcccgcgacggcgagggcggggagcagcggcttggagaggaaggagagggaggatgaggcggggttggaggaggtggaggggagggggaggaggtgcggggagagggcggtggagaagagcgtggccgccatgggtgaggaggaaaggggatgggatcgatagggttttggggataaggcggagtgaggagaggagagagcacaaactgggaaagaggcaacagtagaggagaggagacgggttttatattgtttgtttatacttgtagctaatttgcccgtgcatgaccaccaaatcttaaaggataattttggcattcatttcaaagccttaagaatctacaattccggctgtcttttgccatcaatttttagatgcttactaaattagccagaccaagaaacacaaagcttatgttgtttcaggatgaaacaccaacaccaccaacagcgtgaaagcctacacgctagtaagagtggtggtgacggaagattcactggcatcaccactgcccacatttaatgtagtatagatattggcttcgtttttttgacatggatgagcaaaaaatactatctctgtttttttcgttggttaactaccgtcaaacatttggggaataagatagtatttttaatagcaggtatatatcttctacttaattttactattgcttccatcacaaggtaattttatttttcacacattccgcatataccgatacaaatataaatttgtatgggcctaggaatcagtaggtagtagctttgtatgtgtgtgtgtgtatatatatatatatatatatatatatatatatatatatatatatatatatatatatatatatatatatatgtggcaacatatcctatgcacacaggccctcacgtgtacacacgtgcacaccaactaaaaaatgtcaccaaaaaatctagaaaaaatcatacacatactttcaattgtattacacctagggttaaaatcttaaagtaaaattcattatattttagccgtaacaaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgttataaaatccattccaatcgaatattgagtaatcaaatccttcaaatcatagtttttgaaatctttttaaaagcggattaatcggacgaggataaagagagagtcccattctacatgtcaatactgacaacaatgaaatttctggtaaaaggaaaatccgtcgactttctaagtcagggttcaagtccctctatccccaaaccctcttttattccctaactctagtatttatatatgccaatgtgtgaatgcaaaaggtgaaggtaaggcccacaagagaaagaagacctctccatacccccacactgtttattgtacaa

SEQ ID NO: 16151 - DNA, 644 bp, Oryza sativa
ccaacaacagtggacatcaatcagtacataagaatgatcggctaattcgaccaaactgttcaaatacaatgttgagagaattgcttttacatgcataaacaaatttggccaaaaaaaagaaatatactgaaagcagcacaatactgtttgccatgttaccgcctacatcgaaaatgtatcatagtctacagcaatacactaacaaatgccctgcatggcatggcaccaacgttctgcaactccagcagtggttccatatagcagtggacaagtctgcagtagcagcacacggcgtatgctcctgcacctccatgagaagggtaaagaagaggaaaagactccaaaacacaaaggaaactcttaactcgataaaatctcaacccagttattaactttgagaggttctctgaaacttacccacactcagattgagcatcagagcacacgtgcacatcaagtcaagatcccatgtatagcatggcttgcacaattgcatgttagggcttttatgatctataaatcagcaaaagcgaaaacttccagctaactgtaaatcgccatagtagtcatatagcttaccagacaggttgatactagaagaccatgctgagattggtttataggtaaacttaagttttatgtta

SEQ ID NO: 16152 - DNA, 731 bp, Oryza sativa
ctgcagcccgatccatcttcgaatattgattttcccttcctttggaatccctctcaaataatccccggagtcgctagatacaaatatatttcaaaagaaatatatataaatcccgctttgaatcccatccttggcttcctcacatttcaccaaattaaaatttcaaggtttgcaattccaaaatcctactcaaattctccaaatcaaattctctggaaaagtctattttacctccctcaagttttgtggaccggatttcctcccacggcccatctcccctcccagcccatcatctcttcccccaccacgtgcgttgcacgctgtcggagtcgagagggagcgtcgctcgttctctctgtttctctctccctccctcttgtcaaactccctcccgccaccgccgtttgaactcaccttcgcgcgcgcgctcgcgcgcggccgactgcccggtcgccgccgcgtccgccctggccgcctgcgccgcgcaaccgcccatgccgccctgccgctcaaccccgctgcctgccgcgagctctgcagcgcgtgcccaaaccgctccacccacgcccgtccaaaaccgggagccagaagctctcactcccgcttctctccctccccgaaacgacatgaccaaactcctctttcccccttctttttctcttttttcaaccttaagccaccggacttccactgccgtatggccgctagctccgagcacaaccgccagctcg

SEQ ID NO: 16153 - DNA, 6863 bp, Oryza sativa
gattttcattgctaagaacacgtatatgagcaccagtgtcactgcggattccctgtataatatgcccaccttttccaataatgcatccaatctggtctgatggcacaagcaaccgaacggtaacttgagctaaaccttcatcactttcttcattcccaatatcatcatctatggatagcttttcatgaactctaaagagagcgtcttgggcagggcaaaccttatcttcagcatctactagggtattagtttccctgcttgagctaaatattgtgataactctctcatcacaaccagatacactctcaccaatccttatcttagcttgagtgtcggccctcatctgcttagcaatttctccacccctcccaatgatgctccctatttttctagaagggcaaagatagcggtagacagtatcatctggaccaggagcatatgtatcatcaccaggattccttctcttgccacctccattttcagcataatcagagtgacgcttcccgtgactgttcctatgcccaggtccaaccattgtctacaatcggagaaagaacggtcaacacagtagagaatattgggtcaaataaatggaaactaaaataacgcgcaagaaggaagctattctaagattattcacatcaaaccctcctgaaattctcatttaccaaataaaatcaactataatcacacgaatcaccctgtcaaattcgtaatgacagcacatattaataatccttacacttgtatggctgcatgatggcatgtttatcatggccaagcgttaaacgaatccacatgaacaaatcaatcccataccacaatgaacaaaagtcatctttcgatcctaccaactagattactataaaagatctaacgagaaaaaataaaaattgtttggtctattcatgataacctctccgactctttttttacagttcaattattattaagttgaagaactaacaaagatatcccgacaaaaaaaaaattctaaccaaaacactccaaccacgcgaatcaggggcggatccaacttgggacgtgggggttcagttgaacccccaaactattggggggaacaaacaaactgttacttgtattaaggttaaggctctgaaatcaaatagaagaacctcttccagatctataagagaagctagggttaacgcaagcaaattccacggaggtgcaatcccggtggaagagagagatagatgaatcagaaagagaatgcagatggatgctcaccaagatcccctcccctcccctgctccgctcgccggatggagatcgccgcccctcccctgttcagccgcgagatggcgcaaggagcggaggagacgacgagacggggagattttcttttacgccaagcctagggaagcggccaagggggagacacccgtgtacaccgccttttatctcaagcttttcactaaagcccgaaaatttgacaaattaaccctttcagaaaacttatctaaaaaataaatcgtgctaaaaactaatcatgcgcttagagccatcgaggttaacaatgacgccgttgattttttttttaacatgtttgaccgtttgtcttgtttaaaacttttgtgaaatatgtaaaactatatgtatacataaaaatatatttaacaataaatcaaatgatatgaaaagaattaataattacttgtttttttaataagacgaacggtaaaacatgttttaaaaagtcagcggtgtcaaatatttaggagcggagggagtatatcctttttaacatctttgacgttggcgtttcatcgaagatgacatgaatttgccaggttatatataaatatcacattaacgctaaagatattgaatattccatcggaagcggcaagaatttaccagattatatataaaaatagtaggtatgaggctatgtctgtcaagcttgaaaccctggttcaaatactagggatgcctcccatttgaaggaatttctttctaccccttattttctttggcgaaattaagaaatagtgacatattttttggtgaaattattttttaatataaaatttaaaatacaaatatattatggataccacataccaaaaagtggttgactaagctcggtagggcacaccatgtaccaagtgttatacggaatcatacctcgtatatagaaggaattccggataaggaatgacgaatagagttctatatgtaaactataaggactacttggattgtatccatattgatctctctagttttacatggacaatgggacacctatggtataaatatatcccataggaggagggaaaaaaagatcaatacacgacacaacaacagatcaacacacgccaagacaagccgctagatatcgacatcagagataagcctagacaaacccaatatgatgtatgcggaggccaataagagagatctagcgctatctctgatctcgtcgagtgcgaattcgaggaggaagactaccccgttgttggctacgtgatggtattttcgggcgccaagtcgataacggctagataggtatatcccaaatattgtactggtctaattataatgaataagagcaacatcggcttcgcccaacatgagtagggctattacctgtcagataaggggcctgagcctgtataaaatttcttgtctccatatcttttacttcaatctcgcatataccttggtaccaacgatccccatactatgcaaaataccgtagtcgcggtatcacccatcgacaatatctattttatagttaatctttaactaaaacactaaatatatataattcttaagagaacactaagctcgaactaaagcaaatgctggtgtcctcgggagctttttatttcttttaaattcctaaaatccttatattattggctaaactaagaaattgtgatatatattttggtgaaaatgtttttattaaaattattgacttcataattaatactttaattaaaacacttattctacataattcttagttttaaaattcctaaaatatttcattattttcttcgtgtatgatttatttaaacaaaatgtgtcatttcccaataaaatacgaaaaataattaacaagtgtagaattggtaaaaaaggtaaagatccttaaaaggagtagaaggaaggactcaaaccagggtcttcaggatgagagcaccagacccagtagcaactcacgtgtgtattacatatacaagcatgtatttatatattttcttataacttagtaccgagcaccagatccagtagcaactcacatgtgcattacatatacaagcatgcatttatatattttcttataacttagtaccaaacaccatgaagctaattctatatgactagttaaatttttgtcttctcgaataggatgtgagtgtcaatattcttgacactaaagcattatatatcaccactaatcttaatagcgttgagctgacgatttatttatgcaaataagtttttagcacggtcgttgcaaaaagttttctggaagggtcagtttgtagagagatctatgctgcgcacaggcacaacctttaggcagccacacgctggtctcctcgaactcgaaccctagccttttgctgctccctccggcctccacacgcgcgagatcccttcccctctcctcccctcccggcgagatgtcgtcgtcggtcggcggcggcggcgggcagcagttccggtacacgcagacgccgtccaaggtgctgcacctgcggaacctgccgtgggagtgcgcggaggaggagctcgtcgagctctgcaaccccttcggccgcatcgtcaacaccaagtgcggcgtcggcgccaaccgcaaccaggccttcgtcgagttcgtaagccctccccccgttctccctccccttccccacccgcctggcccgcctccatctcccccctctcgtcgctcgatctcattcgagatccgttcggatgaatcggccaccggatgatctgccatgttcaatccacgatctatcgattcggccgtataggtatagcgcagtcctgtaattaggggattttgtctcggatagtatagcgcagtccgtaattaggggacagtgggggtcactggctcacatgccgtcctcacatctgcttggttttagcttttttttttttttttttgctatgccaacacatcgcgaagatggaattgatatgagcttcggtcatcgtaaaggatttgataagatgcggctgcaggatacacgcgggactggatatttgatactagtagtaaagttgtttaacaatgttagtattttggatgggttttcaggtggattgttgggtttgtgattggagttgaccgaggttagtttatgatactggaatgctatatgttgtatcaatctgtctgtcaggaatcgatctgtagcatactcggtaaccgctatctatatggatggctgggcctatgtggttttgtggttttaaaagttccacatgtcactgtttggtttgtgataggatacagttacagggatgtgatttgtggctcttggatatatggtggcgggagctgggagctttgaaatgacagcaaagctgtattctgtgtcattagtaactttagagtatgattctatttgtgagattgattatctaataaaatgtggtgtatctttagacttctaggaaaggctttcagaaactttatcttcctacaaattctattattgtttatacttatgttttatttgtaataaatgctgcgcattacttatgcaaagccattccttctttgcagactgacattaatcaagctatttcgatggtttcttactttgcatcatcttcggaaccagcgcaaatccgaggcaaaactgtttacattcagtattcaaacagacaagaaatagttaacaacaagagccctggagagactgctggaaatgtgttgctagttactatagaaggtgttcaagcaaacgatgtcaccatcgatgtgatccatctggtgagttctaaattttagtttcttttccaacatgaaagtatttcaatgggtgaattagtaagatcatgaaaaatttaagtgtgactgttgctatatcggttgccattgactgaagggatccaagggagtctacctgacctgatccttgtaaatcaaagattttacatagctcttcatctcgtagtaacgtattctgcatgaatcagcaggcccatgttaacacggagaaaatgtcgttatcaacatctgcaattggagagatatcatgtttgttttgctgcctctgtcttctaactattacatctgaagtttttatgaactcttggggatgccattttctaattatctttcatcatcacgcttttccacggtgtagggcacctccctgtttatccaagttattgatgaaaggttaaattcccaacctttagaaaattagtacatctatggtgcttcttttgtgatcattttgtggttcttttatccatctattagcaatacaatatagttccattcgtccctggttcatctgtctaagatcttctgtcctctttgtctttttggtggacaaaaggataacctttaagagtttcctgccagatagaatatttaataattgattttatgtactacaactacaagatttttatatgtgctgccagttcctggattaattttctcttttactcctatatatgacccttctattatatttcaggttttctcagcttttggatttgttcacaaaatagccacttttgagaaggctgcaggttttcaggttacttgaaatttcaaattctgttaatatacttgattgtttacaaaggcgatcttcccaccttattttcttcccccgcaggcactgattcaatacacagatgcagccacagcttctgcagcaagagaagccttagatggaagaagcatcccaaggtgacatctttgttctctgtacattgcatcttttaatattgttcacactttgctcctcctataaactgaattcctctgagactttaatttaatgtaggtacttgcttccagagcatgtaacatcttgttgtttgcgtatttcgttctctgcgcataaggatctgaatatcaagttccagtcacatcgcagcaggtatcacttatatcttttttgccttgagttaatttacaaagatcaaatttcgcggttgttaagatggatctctatatgtctaggaggattgtaatatcaacatactacctggtaccatattttaatgtctacattaagatttatgcctaggcattgcaagatcatacctcatattttccctgcaaattcagaaatacgtgttctgccacatcatgggcattttacctttattcatctttcctgttcatcctgctgcctccttatatactgacacatgattactttgaaaacctggtaaaatagactatcaaccactggattccagatttgaatttgcaacctaatcgttggctaaaacaaagtagcttttttcatggggaaagggcatattcttccatagtatcacttggcttccatttttttagcctcttgctttttgtatggaacttccatatttgtatgagtatattactgcaaaatctttatttgtcaggggatccgtcttctccatctttgttccttatcttatttgccttgggttattattagatcaaaatgcttcttactatgtatcttgttaaacatgttttcttttttattttgcagggattacaccaacccttaccttccggttaattcatctgcaatagatacgttacaggtactactattggatatcaccaacatttgaataatttaattgtctttttttttccatttatatgaacctgcctttcatataaa

SEQ ID NO: 16154 - DNA, 2847 bp, Oryza sativa
  unsure (1)..(2847): unsure at all n locations
ccacctggagctgctgctccaaaccacggcacaacagggcaagtgccaaattggaatcccgggaactctgggtatgctccagctccaggagcatatccaggtcaaatgtactcgtcaccaatgcagtatggcgcatcagggggcttctctgctcctgctgccccaccacaagagttgcatacttcgcagcagatgccgccgcctcaatatggaaatcagcctggaccagcaggtgcaccaggaaccgggcaaccacatccatattatcgctaaatttagattcctattcacaactggtactatgccctttctaattagtaactttgtgtacctttgcaatagggcaaaaccagttccttttccctgtctttcttctcatggaaccttttttataaataaactcttcatccagttgttctcatccgcggcacaaaatgaagggttttcatcgaaactcatcatagttttctcccaaaggtaactttgtatattcctaatatgtttatcgtcagctcgttggtctgtatcttggaatttagtattccctcgttttttacttgtcactgttgtgacaaaaaaaatcactgctttaactttgatcaccaatcatttttttaagttgaacaaatccacatggttacatttatatcagacgcactttgattaatatggtactatttttttacaagtaaagtgcacaagcggttattaaacttataaggttatgtcatttaggttcctaaactcttaaaatatagatccaagttttagaacttgtcaaagtgtcatttaggtcttaaaacgtcacaacctctttaggatcttacgtgacgtgtgacgttgatgtggcatgccacacgaacatgacgtgacatcatcttgaccggcaaatgagacctagatgagatattttgacaagttttggaaattggatttgtatttgagagtttgggaatctagatgatacacccttacaagtttaagtatcacccatgcactttactcattttttaagtactaggaataatgcccgtgcgttgcaacggtaaagtcgtttgttccagtggtacaacaaaagccaaagccattttctccaatggcacaacaatcattaggagctgagcgataaattaaaacattggtaccgctatacattatattgaataagttaattaaaatccatacttggctttgggtcgaaagcccattctttcctttctttttagccgcagcccggttgtaagatttccataataccgttgggccaaaatagagtgaaatggcatgattgaaataaaatatattaattgtgcacataaataaaaatctattccttaatatcgtagacatatatggaacaataaaatattaaaacataacgtgacaattaacacgcataatttcataggattttaattgtatctcactttggggctataaataaagctaagtgtcaaaatgtcataaaaaacatataatggtttggccaaaatgaagctaaattaacattatatatgaataatggaaataaattaaattttgttgccaaatttattgttggttccatttagctacatatatgatcttaattgcacaagaaagtttataatgcaactttatgtcatcaaataattgcttaaacggattaaaatgctcttatgtaaagaggaaatcattaattcggtccgataataacggaaaatcaatttggcccgaagaccggcaacggctcggaggctagagctggcacgtgatcgtgcggcccatgaggcacgcgaagcccaagcgcggcccgttagcgtgagctgtccgatcctgatggatggctacaatctctgatgggtggctgatgcagtgtgggagagtcgtgggtcctctaatgctgatcggacggtttagattgatcaacccggataaaattgccaccagccgaaaccctaaccctattaccctctctccctggccctattttctggtgctaggcgaggggtagtggtcacggcgacgccgacggagcggcggcgatgttgaggcgccagtgtgtggcgaacctgatgtcgagcatggctccggcgaggccagggcggcggcgcgcagtgggatgccatggccaaggcgacggttcatgtgagctgaggccgtcggcatcgagcgaaatggcggcgatggtggtaaacggcgtgctgcgagctgataccatgcgtcgatccctctctcccacctcagttctcctcctcgacacggcgcaagactacaacaaggcgagcctcgacctcgagcggcaaactgaggcggcgctcaagttcgagttctcctcctcaacatgacggctaagggatgcacggcggtgcgtgtagctgtacaccagtcgcacgaagatggttgagagttcggaggtgcgcacacaggcggagctcatgccgtgcgccacgaagtccgacgaactaaccctaatcccggtgagtcttagggttttccattgagctggtgatttgcctgttcggggttaactgttcttaattttgggaatttcttaggttagggttcgtatttttcggaaaaatcaaaataagggtttcgaatttgggggatattcttactcttataccgatctgattcgcctcctcgtaacaatctcttattgtacttttaggatcggtaggacttaaggtttaggtagtgacaaacgaacaaagattaagtttccttatatatgagctaggggattgggggcgagtccatggcgtaatcggatgtgctagtatacgaatgaaagattaccgcggaatcgacggatgnnnnnnnnnnnnnnnnnnnnnnnnnnnnnnnnnnnnnnnnnnnnnnnnn

SEQ ID NO: 16155 - DNA, 1273 bp, Oryza sativa
cagggactggaccaacgtcgccaagaagggccaggtcgatgtgagtgcctgtctctctctctctctctccccccaatctgggatcccccaaactctttttgcttactttgttccaatctgttaggatcaatcaatactacacggcagaattagttttttttttgaaaaaattgttaaatattgtgatccatgggttgaggcattgagcgatcgagggcttactaaaccagaattaggaagaataaactcttaccttgttccaagtgttctttcggataatttgttagatattatgacagatggattgaggcattgagcgattgtgggcttactatatagaataggaagaacaaattcgcagcagctcatagtggagtggagacactatgtgctgatgaatcccctaatgattttggtaaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctagggctgcaggaa

SEQ ID NO: 16156 - DNA, 716 bp, Oryza sativa
ttcctgcagcccttgtaaaccttaagaggctgtcaaatatgctactgattattatgttcattagcacagtagcatgggtagtaccgcttactacaactgtacactatcatatcgttcacttatattgttcaatcatatcccctcccttctctctctaactggtgactgtagcatcacaatgggtcttatcatgcaactcattatcagcagtattacacattgtaaactaatatgttaatgtggacatgcaaaatcacctccatattgtagtatttgcagaaatatatcttttgttcacacatttatcttttgatatgtggcagatgatggaggttgagctcaagaagctggaggatactatcaactctatccatgaagaaatgttttatcttcgcgcaaggtatggcttgcaatgataaaacatttctttgtgaaattcaatatgatctcttaatcattattatccgtgtttcatttctctagggaggaggagatgcaggaactgaacaggagaacaaactcaaggatggcttggcttggtttcttctcactagctatctgcctgtcagtggcggggttgcagttgtggcatctgaagaacttctttgagagaaagaagcttctataattctgactcagaacatttaggcataaaattgtgtgatttctctttttatgcttaccaagcgtaaaattcctgcaagggacagatgtta

SEQ ID NO: 16157 - DNA, 706 bp, Oryza sativa
caaaacatatgatataaagattaatgaaatattaagtagactaggcctaaaaaaaattagtgcacacttaagagtgaatttccatacatagagaaacataaatatttggtattatgacaggtactgtctatactgctgactcataaagtacaggtatgcttacccactgctgccagaacgaccactatatccaccataagccccataacctcctccagagacctggagaaattccagtcgaagttttgataagagtctgttagcatgaagaggaaaggaagggaagtgaaagggaagctatacctgggagctgccataacttgcatagctgtcaatagggccaatatcatctgagccacgatatccacttgaatatggataatcatgcccaagaggcttagtatctctgcctagatactttggcccttcagaaacaccaactggaagaggatggtaagggattacaggtgggaaacctgataaagcaccttctctttcaaagaaattggctttcagcctagtagttatttgcagaagagcatgtcttacaacatcaaggtctccactgatctgttgtgcaagcaaattacattggtgaactcatcgcagtacaaaagaccagtaaaaaaaaattaaaacataagtttaaattgtacctgaaccatctcttcgtcttctgctgctacttttggtacattctccttag

SEQ ID NO: 16158 - DNA, 873 bp, Oryza sativa
catgctctagtgtgaactaacatgtattgcttaacctcacaattaattaggaaatggatagaaaacatgatttgtcattggtgcaacatgaattgtgaagaggcctacttggtgggagcaatacctttctaaaaaaattaccagttccttcttgattttgaagcaatatgccaaaggcaaaccatttttatgcagtcactacgtcattagcgctttgaagaaaggagtaacctttcaagcttcatacatgggagttgaactatgggtgtaaattatatctacctagggtgatgggttctttcacaaccctacctagcccttaaatatttttaggtaaaaaaatagaaattcagatcaccccattttaggcctggccctcaaattttataggctaaaaagttgggccctttgccaaagtttatcgtaaattataaacccaattgaccactgggtatgacatagctgtcctctttttggcatctatcaacgacaaagtcaatacaaccatgacgaactctccttggccactactgctgctgcctcatatagggcatacaggcatcaacgatgccaaaggggctaatgtggggagggaccagaacaaggagatgtggccagggatgtgacgtatggactatgaagtgctgcagagcgctgaaggatgaatgaggtgctacgggatggagcgatgcagggaggtggcagcacgaggggagaattctgttattggtctagcaccctagcctatctaatcaacaatgacttgtgttcaccaaaattagcaagtataaatcatgccttctctctgtgttagggttatcaagattatgcgccatatcaccaataaagcatacgttaatatgcataaagtga

SEQ ID NO: 16159 - DNA, 1747 bp, Oryza sativa
tggcataacgcttctctcctatcgaacattaacggttagaaggtatggatccacatggaaaaagattactctcccatagtgagcccatgtccaaggcccaaactcatcatgtctaggcctgccatctcgtaagcatcctgatacagcgaaccgaagtaattttcttcataaccaatctatatacatcatatctttatcatatctttctggtttcatataattattaacgtttaaattagaacatgttctttaaaatatatctttgactatatttttatataacatttaccataaagacaaatctatatatgttgtaaactaaatatttttttaagttattgatagttaaagttataaatatttaaccttaaccttatctaaaacgtaaagaatcatataatcagaaggagttgttgtacttcggcactcaacatttaatttatcatgtggcgaattgatcaactaagaaaatggcatgttttgcaaagcaaaaatttatattaaaatattataagagggcattttgtatatgtttggcaactgttttttctcttttataccagcattatatggtcttggacattaaataggaaagaaaataaaatggaaagtcatatttacgacataagctaagaggcaaagaaagaagatgagtctagatatgagatatgggcttgagggtccatgagctctacgctcctgacccctgtcgtacattttgttcgtactaagattgtacgtaaaatatcgtattcatagcatttcctgaaccaaattgctcgtgtaccactgccacatgccgttgctctagacctacacttgcattaacattacattcaataagctgattaatcgaagaagacccatcttaaaagaatgcattattctgccttccacgtccttccttcaagtgtagcaaagctgtaaaccaccgatgtcttggctcaaataacaacactcaatggtttaacagtgagtttttttatggcgtctttttatttcctttggtccaatatgatgggcatttgactacaaagttttggcacgggctgaatgttaccattgccaaaatacaggaaatactccgtacaatatagctatggagcattgtatacaagcaatcacatccaatttttacgctatcaatctgtttaacaaaatttaactgtggtaaccaaaaatccaaaccataccatactggaggccttcatttggaaaggagagaaaatgaagccattaggatcaatggaaatttctggagtcctacatttcctttgtcacggacacaatgctacaaattttcagcatacatccacttacggtcagaatactcaccacaaatcgcatggacatctacaagcggcaacctcatgcgggagccaataaccaagcgtagttcagcatcatatgatatcaagccccagcatcctttcacccttgcaatggagattgggctttgttctcattgaatccatacatcccatacccatagtgatctatgtcagcaatagcaaggctcaaaccgtaataaaactactggtataatgcatcccaacggtatgcaaagcaacttctctgttccgactaccaacaggacaacaggcaagcaaaagtacacaacacaacggtggattttcagcatttcaaaaataattctgaacatagccattttgagaggaaaaaacagagacacaaacttaattggaactaaagactagataatgggaactaatgaagaaacttattc

SEQ ID NO: 16160 - DNA, 1627 bp, Oryza sativa
ggatgcaaaggtactatcaatacaaagcaatgctcccttgctatggcacatttttgagacaagatcaatgtcgatgcatctcagaaatggattagtaggagtctcggtgaagaatagggatacctgagtagaggtcacggataaatttttggttaataaataggcatatgatagcattagaggaaaaggaaatagtacaaagatcacactcacattattattatccagtgcattttggagagcatccatgtcagcaggtctaataacggtcatctggacacaaaattgtgtcataagataagcaacaaattgtaaacatttatgtataaacaaatggaacaaagatcataggcatattccaaacaccgtattctgcagaacataaatatttaatatgcacttccaagatactggaaatttgaaagcaactatgaaatcattatacatttttggcttctacaaattgatggaaagccaatctcaaatagtaactgcagaatcaagtgtgtgcacacgcacgcacgcaaaaagtaccggtataattataaatgcctctatctggctctcacaggaatctgtacagattactaaagtagcaatgattgagtggtggtggacaaaagaatgcgagttatgttggattagtttattatacaacataaaattgaacttagaaagatgacaggtaattgctgtgccaattaacacaggaaatagtagcctccatgtccaaatataatattttaagtagatcataaaatttaaaatttgtaagccttctgctactatagaacaatgacaagtcacatcaactacaagaaaaactccattgaaagttacatatgcattactgcaaacaagaataataagatcagattaccgtaattcccctcttaggtagttcagtctccatgtaaattctcgtcttgcggtaacaatcagtggtggtcacaacgtgcccacctgctggaacaagcgcgctgagcatagccacacttgcatacatcccggatgccacaaagacagtggactcggctttctccagtgcactgaaacatcgaagtagagcaatcaaaatcccatccactaaaaccaacacagcatcaagcattcccacttccaattagcagaaccattcatttcaagaagaaaatattacaccagcaacaaaggggaaacatcacctcatcttcttctccaatgcctcagtggtcgggttaccatacctcccatactcgaagctagcatgcctcccctcctgagagaagaggaaatttttaacatttgcaaaaagggcatctaccaaatcgatttgtaggagtaattgcaaccccccaactatttacgaaagatcgccaatcatttctaaccttgaagtcaatgagctcctgcgagttgttgaaccagtaggccgaggtgttcactactggcgtggtgatcgcgtctgtggcgatccttctgcccagcctctcgccttcgataggtatatcaaaagcacgaaatggatcagaaaaaaaccgaagcagcggggggaaggcgatagatctgagaggggattgatcgtgattacccgcgtggacggcgaggctggcgtctgaaccgagcagggcctgctcggccaatgcgg

SEQ ID NO: 16161 - DNA, 1839 bp, Oryza sativa
tgcgggcttatttgtagtggggtgggtgagaggcctccgtggctaggtgcacccgagggggagaacggattttttttttcaactctgagcatgagcaggaccctatcccgtcaaagtcacgtgactttgtcactgacatgtggtgtggccctgatgaaaacaccatgcatttgactgcagaggatctcaagtcatgtcagctacgttcggtgttaaggtaactttgggcctattcggctgccctagctgcggctgcggcgcagccggcacgaacagtttcgcactcactgtacgcagctgcagccgcagcagttggcctaccgaacaggccctttgttacttttagatttcaacgtttaactgcctactactccatataaaaaaagttgattatcatatctaagagcggaaaatagttacatgttccttcgacatcagcggagcgagagaaacactattgtttaccgtgcaggtgtttcctaagcctgctaaacggtgtgttataagttgtttttaaaaattatattgatccatttttcacatttaaaatagttaatactaaattaatcatacgctaatgactaatctcattttgtgtatcttctcttttcctctcctctcaaacacatctatgtttggttactgctataatttgccaaacatttcaggttttttagagcttaggttctgacaatgcatggtttgtaactctgaatatcacatggcttactccttctttttccaaacctagtagtaagaacttgtggacacacctgaccttagctgaacatctgatgtgttggcgattggtgttgcgaaatgtagtattgaacccaatttaagctaaataatacttaagtgggttgttagttgttacttgttagttatacacatctacccatttaaccaaacattgctgaacaattttgagtccattgctggttgccacatttttttgacatggcacaaccttcccacaattcacctaatcttttgcaaaattgtaccttacgataaattattggccatgtcttaatcaaggtttggcaaagacttacatgatagtatttgatagtgagagatttaagaccgaccgagactcaagggagctagatggtagctatacacatccatagattttataaactaagttaggatcaataatatgatgtatgcacacagttacactgtaaagttgcaaccgccgcacatgacatttttttttatagaagggtttttttttaccgctcacatatgtataggcaataaaataattgtgatcttttatgttgtgtgagtttttcttagtttgtgtgtgcttttatttattcaggtgtgagtttttgttgaattggtgttataattggatgtagctatttgagcaaaggccgggattatattccattattaaaaaaatatgtataggcagtaaaatgtgaagttgatgttgaaaatgagaatgataaaatctgaactattggttctaaattctggtcttacatttctttgttagtattgaggtagtcgcaatttggcagtattataaacaaaattagtttattctactttcatatcttattttcagtttatgacgataatctacacatggcactatataacttatttcatattaaactagtcacagagtggcgcgttgcgcaacaataaatatccacatataagtgttaacacgtgctcgtaaattattttgtgagtacatctgcactatttaatactcccttgttacataatataagagattttatccttactaattatcccacaatataacaatttatttgagaaataatataagagattttggtgtagtacttatca

SEQ ID NO: 16162 - DNA, 720 bp, Oryza sativa
ggatccccctcgtgatcgtcttgaataagttcaatggagcaaaggagacatgtgcccaggatttcattgtagtgactgaatcgtcattctactttgggcttcaaatcaggatggattcggggatatacttgaacttcgggagttcatctacaaccccgaactttagttttaacaaatacatcaaattaaccatgagcttcaccgacaaataagctccatttttatagtttcaacaaggtggaatccatttggatttattagatttggaatccatatgtaaatgtgcttcattggatctcgcggatttgtcaatttgtttatggcctgcaccgctcacgttgatttctttctttaatatggtacgatgagattagcttgttaaaaaggttgagtgtggcctggtaattaagtaggactgatgatcaacttgttaaacacatgtaggttaggaatggatctgttggacaagcttactgtgagactccacttcaatggatagtttttgacgatggaacgatgttgcattgagaaagacccggaggtcttcaactgtcatatttttaaccggaaggatattctaaaaagttttattatcccatttcaggcgacttgtttaccctgcaaattgtttccgtcattttctagtctaaaaaatttgctgggcgatctgccatgatctgtatcgatagtgatcgtcttaaatcatttcaatggaaaggt

SEQ ID NO: 16163 - DNA, 719 bp, Oryza sativa
gctgtgtgtttatgtgcgcgctttcaagcttctcctcgtgcttcacatcctcaagcggtcaagcgaataatgaggtatttgaatcatacacttgagtttggaatttggtattctacttcatcttctatttgcttaagtggatattcagatgctgattttggaggttatagaattgataggaaaagtactagtggaacatgtcattttcttggtacatcattgattgcatggtcttctaggaaacaatctagtgttgctcaatcaactgctgaatctgaatatgttgctgctgctagttgttgttcacagattctttggcttttatctactttgaaagattatagtcttactttgagaaagtacctctcttttgtgataatactagtgctattaatattgctaagaatcctgttcaacactcacgcacaaagcagattgatattcgttttcactttttgagggatcatgttgagaagggagatgttgagttgcagtttttggacacgaaattgcaaattgctgatattttcactaaacctttggattctaatcgctttgcttttcttcgtggtgaattgggcataattcatccttttggcatggtttgagggggagtttgtacctcatggttttatcaagcaataatatgacaatgaaaaacttgagaaaagagagctttgtttatgcatatggtattttcttctgcatgctagcaatac

SEQ ID NO: 16164 - DNA, 10237 bp, Oryza sativa
  unsure (1)..(10237): unsure at all n locations
gtcggtcaaaccgatctcatcgaaattgagggtaacttttatttccgctaaaagttttcggtttttaggtataccaaccattcacccccctttgattggcttggttcttgtgattcgatcctacacagatatccacgcgtgatgcctcgaaggattttaggagcctgccctagctgccatgcagctgcagttctggcgatttaacaagaacagtttaggtcgggttaaattatcctaaagcttcaggtttgcagtaaagcaccatcgaaatactccaagttacaagttaattacaagagtcttcaggttagtaaaggcttcaggagcaactaaccaatttaccaacagagacaagtgttcagaactgaagaccattttcttttctgaaggaaagttcagaactgaagaatgtgcaggacagctcgcagacagtgtttcgtttcagggctgtacacttgattgccaattgctttattgcttagaaataacgaccattgcctaaacattccattctagattctgaacaagtcatcggaatccaatggcattcgtcaggcttctccagaaccagccaagcagtcataatcagggtgttcttcacttcttctagaccaattgaccagagatggatgactgggataggctacatgcatatcctgaaaatgggacaaggatgtggaaatcaaatgaatggtgctgcattaatttgactgggattaatgtagattcaacaatctgactcttcagagtggatagatgatgactgcatccacagtattccatccttcttgtgctacattagcatgatctagcattgatcaccatcattatattcagaggtaaaaagcttcagactttttactaggctcgacaaaagattaaaacttgctatctgaataaagtgacggggcattctatctactactagtctactactactgtaactacaatctttatgcttcagacatggttgatgatgataacacatgcagatcagatcatcacctttactcactcacaggtggaatagtactagtacttacagactattaagaatgattaggggagatgagaaagttggaacaagaatcattgtgcaaaagtgtaaattcagagctagcatagcaatactagcatgcaagcagggacaagttcatcagagaatgtcggtaaacagcactgcaccctgctgctcaatggccctgtgctggtgcttgtctattgcatgcacagaagatgctttacccaattctgacttttgtgtcactttcatttgttgttgtttttctttctctgcagcttcctcccccacattgtactcaatcaaccatacactgatcccatctcgttttcttgacattggtttgtttattcagttaatcatcttgccaactcacatgcaaattatgggcaggagagagaggagacaattggagttaggtaaagatggggatttttgcattctagaccctgaattttctgtttcattttcaggatgagagcatggttgtttcagtaggttcaaccgttggatttagcccttccaaatcgtctgttttcttattaaaatgtgtacatggagtgcggatacgtgcaatcactccatgtttcaatgggaatgtgatctgagaataggaactagttaaatggtgtaacaggaagatgaaaatgtgcggacaaaaaaaacaagaactaggaaaatgatttcgatagaaaagtagtgtgagaatgaagttgatgtggaatgattgaagtattaattcttttaaagtgttaactgggtggtggagagaaatgtcattgtcactactttaaaagcaccagatgcatgatgaagtgcaaaagagagttagcaaaaaatgtatcccttccttcctagccaagttaaaaagtccctcttaacaagaaccaccaaccatcaacgattatacaatgtctacttcgtcgcataactcctctacaagatatgtcttttctttctacgcaaatttcaataattttgttggtgttcacacatcaagcaaatgatcgcggaatgtagggtctattttaatgcatgcgcttcatcgattcaatagatactaagctcattgttaaaaaaaagaatatacacatttgagatattttgtgagtcgaatactatttatgccaaaaggaaatccataactcttacacaaatattacaaccattttttcatccatccactttgtatatcctaaattaaaaggacttatctgcaaattttgacaaggaaagaagtccaaacacttgcattctcccaaatggtgaaacgtggagcactcgtctgcaaaaaaggcatggaattgggaactgggaaggaaaagaagagagagaagaaaaaaaaaagaaagtagagacaagccaatcctactcagcaaccacaatcattattccactctctccaactgacggctacggtggtctactaataaagaagcagtatataagtgtttgagcaacccatggccatggccggattaaaccaataaattaagcagctaatctccgggtaaccatgggtaattaacaactaacccacctgctaatctaatctaatctaatctaatctcctcttcctcctgccgcttccgtattcgttgtctctctcgtgcgtcacggcttcctctttccatgggtgtcagttaattaatcagataatgacctatccgttttggtaaacacctggttaccagcttgacagaatggcagtgtttcagacacacgataaacttcctttttctgttggatgatgttgatttcttttaggtgtccgtgatcttggctacttttatttttttttggtagattcgtatcacaatagttgtgtaaattgtgatgacgtggtaatatttccggcaacattttcttcggagtttacggtgtttgaagcatacggagcacttccctgaaaatcaatacatctctcttcagagttcagacttcagagtgtttgattaacattcagagtttcccatcacaataatttgtgtaaattgttggcaagattttcttcagagtttacagtgtttgactaatcatttccgaggaacattttctttgaaaaaaaaacttattcagagtttcaagtgttttattgactatacattcagagtttggagaaaaacaattaagcaaatgaaaaaaaaaattagcagcacattctttatttcgttctttgataagtatctaaaaaattcaattcatttaagcgaatatttatctccaccgacgatagcagcaggacgagccaataaaataagagggcggtgcaaagaggtggaggagcaaaattaatcagggcaattagacaactgaaaagcgaagctaaggcgcgctaataattgaccccggactctctgatagtactacttaattaactaatcggagcaaggaaaatagcaaactatagtttagctacaaccacatgcgaagaagataggagaaaggagagagaaaatcgtactatagatttatattcagctatagtataagtataataaattaaaatgacactagatgatgtgtcaatttttagaagctacaagttaggtatagtattaagggtccgtttggtagagctctaactcgtaaatttaactctagaagttggatttagaatgcagttatgaagcagccaaaaattcaacttcacctctctaatttattttacgagaacactctacttagcttcagatcgctgaaactgtttggccaaacttgaagccgtaacaaaaagaccctaagtttaaactaatcctgcgctaatcttgtacgctaatccgtctctgggctgtgcatccagccagcgccgtgctttgctgtgctgtgcgagcagtgaagtgtggcggctttgtttaattgggtatcgcgtccctgtccggccaccgggtggtggttcgcgtccgggttggccgagctgcgagagcgacctctcctcctcctcttctcctcctcttcctcttcttcctcgtctcgtctagttctacatcgccttcctatcgcctccgctgcggaaaggctctccctttccgagctcttcccgagctctcctgcttgttcttggggccggggaagattcttgctgctctgaatcagaggtgggtgctgatacctgcttgctcttcttgttcttgttcgtcttaatccgagctcgtttggattgggagagagggctagcgttgtaggcggattgatttttgtttgggttgttgggtagtggcaagaacgtttgcttttggtgattttggcggctcgagctctgttgaaagttacttttttttttgggtacatggggtgtcgtgaaagtgaatgttaatatattgtttgtttgtctgtttgttcgtttgttcgtttgttagtttgttttcccgagttgaatttgaaattttggatgttattaatagtggtgttcttgccgttctgacggttgctgctgggcttgtagtctctgatttgtggctgcgaaattggatccaatcttttttttgggggaaaattggtgagttttgggatcaaattaggatcttgtgagaatataagcaggtgaactcttgcattcttgcccgcttcaatccccaaaactcgtgtttgctgctgtcctggtatttttgacaaagttctattctgacgtttgaattgtccattgcttggatttaaagcttggaatttttcttctttttttttctcgaataatattcagcttttaggtgctttgccggagaattcggacgcgattcttcccttggccaatcccattgagagatgccattcatgtttctgtcgatccatttctttttttgtttgttttctccagtaacctttctgcaatcacaacagctctactttttttctctatgtggatgtccttgtgaatttgctctgtaggtgagtagtgtctgccttgctggacattgatgtgattgatggagcatctgttgcctaatcattttagctcaatttgatctgagctggcgttcagtacattttgaaagtttatccgtacagagatttcggcgctgtacgttgcctgtttaatcacttctgtatacagctcatttggatccaattcctttagctgatgccatctggatccattgttatatcctaaacagtttgtgatccaactgtttcgttgctgtttgttatttctggttgatgaatttgaagtgtagatttatttggatggatcaagatttatttagagcagataatctcatttgtagtatgtttggttctntgctgcatatcagggtcaagtagtatatcatctgtgagttaagnagaatgcaaggagttggcactcagccgacgagctcagngaagtatcttggagccctcaaggacaccacaactgtgagcttggcaaaagtgaacagtgattataaggtcgaaaattctatcaatcctctgaagaatgtttggaaattctcatgctcaattgcttactgttatatgctttactccgccgcgggcttagcattgtcttttttcaaaacaggaattggatattgcaattgtgaaggctacaaaccatgttgagcgtccatcaaaggagaagtacataagaggtggcatatcctgtctcttagctgaaagcttgaaacactagtgccagttcatagctgcatcttttcacttgtgttaatcttttttaattttcattgttatatataattgaatatatagtgtagaaaaccaatgaattgtcctgctcctgcttaaaattcagtgattttttgttatgtagtttttgttgaatgaaatggagtattatattgattgtgcactaatttaccttcagactgtcaaaacttgcctcatattcatttgtttattggtttgcagaaattttttattccatttctgcttcaaggccacgagcagatgtagcttactgcatccatgcccttgcaagacgtctttccaagacacgcaattgggcggtatgtaccttttctataagactttagtgttctaactagaatgtagtagtgcttctttctgtccaaggaaccattttacaccaagtatcttctcgttctgtctaaggagcctttttgtaacattttaaaattttgcatttctctgtagtttatggagctatgttaaaatggactttgggaaactatgaaaatatttgttggcattagcttcctttgttactgtctccattttctttgtaaaacagatgggtctacgagtttagtcctttttctttagagtagttacaaaatggttttttgtttaaatgcatggtggaattgatggtttttgaactttttgaaggattgccaaactgctatgtgattagaaggattagtttgcatttaacattatttgttttgttttattgatagtgcttttcctgggtgatgcactgtaaaaaaagttataaacttatgaatattctttgcttcaatatttatacctcaggttgcattgaagacattaattgtcatacatcgcgcccttcgagaggtcgatcccacttttcgtgaagagcttatcaattatggcagatctaggtcccatatgctaaacttggcctactttaaggatgattctagtgcaggaggtactaattgacattttattactagtgttgtcacttttatagctgtattagacattctaactctgaactataatgactatttactcttatcttgttcagcttgggatttttctgcttggatacgcacttatgctttatatttagaagagagacttgaatgtttccgagtgctgaagtatgatgtggagacagatcctccggtatgtaatccaattactactcttgcttatgcgaggttttatcaaatttttatttctttaaaacttaaatgtaattttgctggaaggaaactgtgtttaaacttcataactaccttgtaagttccaattttaaggtttcctccttttctcctggaagactctgaggaagtagattgtggaagtagatctatcaccttagaaaactctaaaggagagaaagtgaatttcaaaaccatagttaatcccccttggaaaggagccctagtgcaccacatggaagtttccgaactacagaaggttacctattgctagagaatatccagatatcttccagaagagttgacaggcatgccaccgcatagggacatggaacattgatttatgtaattgaaactttatcatgagagatgagattacaagtgccatgttgccaacggtattctttctaactttctgaaaattctggtctctgcagaaaactcgggatcttgaaactggtgatttgcttgatcatctgccagcattacagcaacttctttttcggctccttgcttgccaggtaattagtttttgcctacatatgatttgaaatttcaccacattccatcttcatgttccactgtcaggttaaatttgaattactgaatattatttttgtagccacaaggggcatcatcttacaatgtcataatccagcacgcactttcaatggtaagtagcatgagttagcatgcttgtttcattttaagtgcacaacatgatggtcttggcatgaatgctgactttgcttgtgcattactggaaggttgctctggaaagtgttaagatctacactgctattagtgatggtacaattaatctggttgacaaggtgagttttcttattagttattctagtcattccagataagtttgtaaaatctgctattcgctagcgatatttctttacttttctcatctaacctacggattattctctattacagttctttgagatgcaaagaagtgatgctgttagggcacttgatatatacaaaagagcaactaaccaggtgaagttctgtccctctactgttgatccattaatgaatttgttcagtggattattttcacttgcatgtagcaataaaaatcaaggttctttcttaagtttaattaattaaggacttgggtatgtgttagggcttcagaaacttagaagctgatcgattgaagaatgtatgagataattcacttaattgctgtgaatagatcaaatctatttacactattatgttgttttattatccctgaccagtttttccccccttcaatgtttgattcatgacaaagtgataaaaaacagtaggacagaggcagataacaatccatctgagcatcttgctttcctccatggtctctcctttgatcgaggattagctatgtgcacttttaagcaaccttgtctctaattaaaatttaggtatcatatctgtgatggaatatgaaattaaacttagagcacaaggtttttttttcacttcagcatcatcagctctgttgatgttgatctgtctaaaacagaagttctgaaccactgatattaatcgttgaattatgttgaaataagaacatttagggcactgttgctgcttcaccttttaatttcttaaatttgttgcacaggctgaaagactatcagagttttatgaagtgtgtaaaacgatacacattgggcgtggtgagaagttcttaaaaatcgaacaggtctgacagatattcgatttgcatgtatttgttgtttgttttccattttagcaagctactgattatactgaaacttctgcagcctccagcttcattcttagtaaccatggaggaatatgtgacagaagctcccactgtagctcaaaaagataaggttcgagaaatgttgaaacttgctgatgtttagagctcaaattaatgtgttgattgattgtatcagtacattataaatcgagaagacaatgaatctagttagaaccatcttatgcatgattttctgctcttcaggctccttattgagtttgcttatcacacatcttatctgtgtttaggtactggcaatcgaatacaagaaagaggcagaggaggaagaaaagccggcatcgcctcctcccgctccagagccagaaccagaacaagaaccagagccagagcctgaaccagtaaaagaggaagcacctaaagaggagccaacagatttgctggtaacattctgtactactcacaagaggccactaatcctgcattgtcatgctaataactcaatttctctgccagggtctgaacgaaccgaaccctgccgcagccgagatagaggagaagaatgctttagcccttgccattgttccgataggtaaaattccccacgaacgaaaaccgttcaattcttttgtctccactagaagttgatcggttgtaagacatgcttctttactgttcttgcttttctgtggcagatgatgtacctaaagttgcacctgctcaaaatggagtcactggctgggagctggcccttgtcaccacacccagttcaaacgaaactgctattacttcaagcaagaagctggtactgaacctgaacattttaccttgacatgtagcgaaattccagatagacgcggcaacactagcatcatccttagcttgaaatgccagcgaattttcagataaatgcagcaacagtagcatcattcttaccttgaaatgcagcaaattttcagacagatgaagcaacagtagcatcattcttaccttgaaatgcagcaaaatttcagataaatgcagcaacagtagcatcatttttaacttgaaatgcaacaaaattttcagacagatgaagcagcactagcatcattcttaatttgaaatgcagcaaaattttcagacagatgcagcaacaacaaaagctaaccatctctgaaactctgaaatcttttcttcaggctggtggactggacttgctcacgctcgacagcctgtacgacgacgcgaaccggagagcgagccagccgacgagctacaacccatgggatgtcaaccccggcgtcgccggcgccggcgccgccccgatgatgcagcagccgatgatgcacgacccgttctacgcctccagcggctacgcggcgccgcacaacgtgcagatgaccgccatggcgcagcagcagcaggccttcatgctccagcagcagatgatgatggccgccgccgccgccgccgccgaggcgcccccgcctcaggtgttccaccaccaccagcagcagcagcagcatctccaggccaacccggcgaacccgttcggcaacccgttcgccgccgccgcagccgcccaccacccttacggcgccgccgccgccgccggcaacggctacacggggctcatatgatgatcatcatccagctccggcgatgtcggtc

SEQ ID NO: 16165 - DNA, 8870 bp, Oryza sativa
gccgccctccccctccatcctcgccggcatcctcgccgacctcgccgagatcggcggctccttcaccggtggcttcgcccgccgcgccgccctccccgaacctgccttctcctccgcctccgcctccgcttccgccaccaccgcggagtccccgcgcgccgcttcctccacggcctcctctccttccccttcccctgctgccgctgccgctgctgatgtcgctgatgacgtcgtcggggcggcgcaggcccttacggcgcggcccgaggcgtggattgacttccccgtgctcgcgctcgatgagagtaatgctcgattatctatatacttatggttgttgctaattatgcatccatcacgcactgattgcacccctggtttcgtggtagatgtgttggaagtcgagatgagtgtaaaaagttgctgattcgggatatatattggatttcatgcttgtgattctagtgaaattatgaggcaaaagtacttctcttaggaattcatctaggattatctgaggttagtataaagttatggtgtggggaattattgggccaaattgaaagaaatcaattgctctactcatcgaagagcattcattgccattattagaaagtacagagtgtggcaaggcaaaagaaattatttgagttgctcaaattcatagctaggcaaagaataaactagatgcttcattatggatttgatgaatggtttaatgataatagctataacagggacaatccaaatataggcagcaggtattacttaataaatgtttgtgtggaaatactgagaggtaaacatatcttgtttgtgccgtgctttttgctggttcagtttctagccattgttgcattcacttcttaggatcactgaagttttacagaaccatactgtaacttttgaagatttcaattatgcttttggaatcaggatgtctttgagttgttttactgagctcatcttaggagaatcatttgtggctgttatttagctctgcgatataagtctgtctaaatgccatacttatttactgattttgcaattcacagattctataatctccgatatccaaagggatcatatggaagccattgaaaaacttgtacctgacttagcatctctgagagctaggctctgcccttcttacatggatattgatgtattctggaagatctactttacgctgcttgagtcgaaccttactgaacatacttcagaggtaagtctagtaatttatgcttttttagaagtatacgctacctcttatattgttttatgtacctgtggtgtgacttattttttgttgtatgcattccgagtttccgatattatataatcttgtgtgaatcacaatggttgcaccattgcaccacatcgtgaattagaaagtgaacattttctagcaggatagtcttgtctgaatcgcaatggttacacacaccattgcaccaatggtcttgtctcaatcatactaggagtctaggacttaaacttgggaaccatggtattattgagaaaccatacaatgctagcaggatagttgatgcatgctgagagcctgagacaatttcttccgtaaacaggcaacagctcagagatgtggaccagacattagtgtcatttcaatttagttctggatttctaatcttggtagtcaattcagatacaatgggaacagatagaaacttggatataatcagggaatgcatttttttcttcgtgttactgctttcttcacatggtcttaacataaatgagcatcatctccaattgacaagcagcacataattgagctggattctataaaattcttgggtgttattgttgaaacatgatcattgaaattaggtggaatactagagtatgaattcgctttagaatctacatatctcagacttgcgaatatgttagtgttaagctgcacaaatcaataaatcatgcacactttcaccggttggttgtaggcatcaggacacatctgtatctcactatcttgtatgaaatatagcttgtgtaattgtgttagttttaagcatcccctggaggctttctactcatcttacagtgaggtgctccatttggatatagtaactatgatttgggtgttaagcgcaaaagcaatatgctgagctttgttttgcagatatggtactattttgcttatttatcgtgaccacctgtacttgcaggtagatgagaatgtaccaggttctgttcatcacgtcaatgagatagagtctgattctgcgcctaatgtttgtgaaattgaaagtgtgaaaagcactcaagagggttatcaatcgccagatgatcgtgtgttgataaaaacaagatccaatcaaagcattgaccaatgggtgtttgcaaagtcaaaatctgagcaaagcatggatcagtggtccgaaataccttcggatgtggaatcttctagagatggtagaagatacattagcggtgaggagcttagcgacgctgacagtgcccatattgttgtcatggacaaatacatggattcacttctgtcagatcggaggagcctccactatgctagctcctcagtccggcgggattcagtaagaagaaaacctgcatcttctactgactatagccaccggcctccacaaccaactccacctgcttcactatccaagaaggaatcatgggatgtcattgaggattcagagtttgagatacttgacagttaataacagagatctctgggatctctctggctatttatcctttttattatttttctctctattcccttacccttcacctgcttgtaaatgacgaccttcaggtggtgtcagtgttcgtgggaaaatttctctaccattatattattacagtgtgcatatcactatgtaagttgggtatatcccctcattccatatggtgtaacataaagaaaactgtgatggatcacctgccaagggtgagactatgggtaagtctcccactgtacaaaattctgtgtcacatgtggcttctatgctgggtttccggaagttctgtgcagaatgcagggaatgctaggccttcttctgactgcatgaattttgtataacttttttttcatcaggatcgattcgatttaatttctacaaaccttgaaaaaggaattcatgtccactgaaggaggccttaaaactttgcacctaatgccagaatccactgaaaaggttactgtgcatggtagcctcataataaccgttcggttttgtaaaccctaggctagattggacgcggttagaatgccctgcggcagctgcctcgccgttgctggcttcttgttcttcgtcgtccggcagctgcatttgggcgtgaaacgctgtgttcttcgctgtctggattcagtggtggagctagaaaaatttttgagcccgaactaagcttcactataactattatttactatggaaatttcatcatcaatttatttatgtaaaatttgctacaggacacttaaaaaacgtataattagttatatgacatcacaaagatgtgaattgtctataggacattgcaaaagagtgataattagctattaaacaccgaagatattattttattatttccgaacaacatgaagagagaaacaatcaaaaaagactaaattgccctatgtgggccaaggatatcagtctctcatctattttcatgacctcttcctcccaacgagacgcatcgcgcacagtgcggcgccgacgccatccttctccgccgctccggcgggctcgtacgtgaacgaggcctgggcgtcgatggccctgacgacgccgaccgcgcacagcagcacaagcagcgcaatgtcgtagcaggcgcacgccttgccatcacgcagcgccgctccagctcctgccgcgccgcgctctccgcccgcgtcgtcgccgctctcgccgccatcaccgcggacacccgcatcgtgcccgctctgccgcgccgcgccctcgccgccgttgcggcagcccgatgtcgactgtcgaggactagaatgtggagccgcaggaggaggcggcggtgtccaataaggccgcgaccagcggcttggctggttcaagagcacgcagcgcagcggcgccgcagcaaccggcgaggatgacgacgccaacgcgaggtggcagctgctgcatcaacgtgcggtggtgctacttcatgggctcgtatcagtacgtgctcgccgacgacaacctgcagtggagcctgggcgatggcattcactggtctccgtcccctctctgcctctctgcctggcccaggagaagatttgaggaagcaagcgagcagtgcgtgcatgcgtgaggagagagcggccaggctcagcagggcttctcgccgtggccgccggagccgacacccgaggcggcaactgctgctgcgaggcctgctgctccgggcggaatctaatgcgcttgcgccgccgccgcaccagacggcggcttcttgatggcgtgcgactccagcacaagaaaaacgacgcgggggcattcggtactttcaacgctttttctctcttcatttccatcgaaaataataaaataatatctccggtatctagtagctaattaccactcttttgtggtgtcctatagccaattcacatttttgaggtgttccacagctaattacacattttttaagtgtcatatagcaaattttgccatttatttaagaatattaaaatttaatggagttttcacatgcgagcccaaacggttgcctgcagagatggcaacgggtatggacccgacgggtttccagtccccgtaccctcacccattgaaactaaatctgcccactacaaaacccacacccgctcgcgggtgagaaatttccccatacccgcacccgcacgggtgataggtacccacactcgttgcaacaattttaattgtgcacaacaataactcaataaggttagctgcagtgatatgtacacactagaattgaaaatctaaggctcaaacaaaccatacaggatacatacagcctgccaggctgccacattgcaaaatcaacagcaagccatgcaaccacattgcaaaatcaacaattataataagatgataattcaaataatgcataacctattaaccaagctccaggcatgcaacatcattccaagctcaaagcatgcagcaatatcatcattccagcaagtttaatgacaacaaatcaacacatcaacctactggtccacatcagtctaaagctctagagttcaactcttcaagtgttcacatacagtgacacatacaaaatcattacaacgaaaatggcataagtagttcaattcttgcagcctcctaggatttcctccaacaacattcaagtgttcacacacagtgaacatacgaaatcattacaaccaaaatgacataagtagttcaattcttgcagcctctctaggatttcctccatcaacatcaattcaattcttgaaagcaaaatacatccatcctcttctagtctcaattctcaaatagtaagttcctacataagtagttcagtacacaaaatataagtcaaattagggagcaatttatttttggctgttacataagagtgacacaagtgaaatgacagagaaagttttagagaggagtaagcaataacctgaagaccctcttgtatgtcttgaagacaagaccaaaaggaagcttgctctttgtccttctcatcaactgcaaaacacagaattataaaagtaaataatttgtttgtagttagaaggaaattaactaattgcataacagcaagtgcaaattaacctttgtacttgtttcgaagccaatcctgttggcacattagagcttctaacaacttagaagtgagccgactacgatgctcactaagaactctcccattagtgctaaaagctgattctgaagcaactgtgctaacatgaattgtaaatatatcccttgctatcctcctcaaaacagggaaccgagttccagccaccttccaccaatctaaaacattgaaattctttgtgcgactgtccaccaaatcctcatccaagtaacggtctagctcacttcctataggtcttttggttgcagcacgggcactaaggctggagaaatacccgcctttgccttgggaaccttgtggactggatcggggacgactacaccggaaaggggttccgttacttcggtgataggaggcagcggcggaagtgtcgcaggagacgccggcttaactcctttaccagtgttgtcttgtgtacccaccggatctgacggtggatggtcagtggaggtggcgtcccttcggacatcgtgggggttagttgatgcgaggcaagggaattagatatatagctgcaatgcaacagttaagaacaaaggggaagaggatcaccagccgtcgtcgttgccggagcctgctgccatgctatgctggtgtggggatgggaacaggaacgaccgattggaatttggaggggacgaatggaacagacgatgcgggaaaaaaatgtggcgcctcacggtcacggccccagccggatccagcgacctactacctcactgcacctgcggcggcgctcctgccgagagctgaccgagcgttcgtgccccaggcggcgaccgacgcggtggctgtcccgcccccaggaggcggcgtccctccccaggcggctactgcccgcacagcggcgcccctactagtccgccctcagcgccccccctcccacgctggcggctgcccgcacggtggcgcccctgctccaccggcgcgaccgagaccggctggtgggcggcggcaggtgctgcggtcgtgcgcgcctatggggtgtcgacgtgtcgtgccgtcgtgtgcgtgctcccgtgcgcggtggcgcgccgtgtgcatccgtgcggtgcggcagtggcttcgccgcttgggtgatgggggccggcggctaaacggcagcaggagggagaggagaggaggagaaggggaatagggtttagaggagtgaggaaaagagtatttatacctagggttttgatggttgtgggccttgggccatttgcttattgggctaggcctacgggtattttcaacccacgggttaatgggttcaggtgacaggagaacgtacccacacccgtatccgatgggtgaaggttttgcccgttgatgtacccacgggtatgatgtttggaacgtatatacaccctaatagagtagaaacccaacgggtttcgggtcgtggggccccgttgccatctctagttgcctgggctagccgggtggtggctccacccctggaagttgcgccgccagtctcgaagctccagtcacgagtctcgagacgcaacgaacgttgagagagagactgagttgggccgggccaggagcgggagaggggaccacaacttaattacacattcccacgtcatcggtttttactgaaaacacctcacggcccgtttggttggagggagtttttaggagggattgggagtttagagggatgaagctattaagtgttttgtttgattgggagacatgtgaattttggtgggatggggcaggtaattgggagggaattccttctttactttgactaagcaaatctcagccatctgtttttattaatgacctaatctccaactaaactccctgtcaattaccatcacctctaccaaacaagatactgggattaaaaatcaaattcccatcttaatctcatcatcaatttcttcgtgtaaactcctaatccctttccctcaagttaccaaacaagccgtcaaaactacctatgcgttaaaaacatattactttatcaaaagttaattggaaaaaaacatatttttgttgaaattcgatgtaaatggatgatgctaatccatatgcctcacagcttgacgatggattcacttatttgaatttcaagtgtaatagtggacaatatggaccacataaataggtaggtggtggtgacacctttgagatatttgaaagaagtgtttgtaaataaattggtaaaaacacacacaaacactaaaaacggcgtgtactaggtaattaaatgtgaagatgtgaatgttatattacattcaaaatcgatatgtgctccatccatcccataatataagggattttgttgggatgtgatccaggtaattaaatgtgaagatgtgaatgttagattatattcaaaatcgatatgtactctctctatctcataatataagagattttgttggaatgtgatcctagtactacgaatcacaacaaaatccttatattatgggacggaggaaatatatataaaaatatactccctccatttaaaaaaagccaacttagaaagaaatatgacccctcctaatacaatgaatctaaacattatgtctagattcattttattagaagaggcgggataagccatcttaggttgttttttttggatggagtgaatattttataaaatttaatcataaagggagagatgagctgaagcattgaccgaaacaactcttccaatatttgatcaaagcctgaatcgtgctcggatgaacgggtagagtgaccaagtatatgcaagagctataatagatttacacttaaaagagaagaaaaaaacagtaattttgtcacatattttgttccaatcttgtgaagtctcagtcatgagcatagacgaaactgttgggcatcagaggtcgcaaactccatcgcgtcccgagccaaaatatgcaactccgacctgccaggcaaaggccggtacagggccacctcgtcggcggcgagcttgaacgcctccgagcctccgagggctcggggcctaaaaaaaaaaattcatgcaactgaaggaggccctaaaactttttgcaaataatgccagaattaatcaagggctt

SEQ ID NO: 16166 - DNA, 2497 bp, Oryza sativa
  unsure (1)..(2497): unsure at all n locations
agtaccaagccccgggcgggcacccgatcgccgtgaagaagtgccggaacacggtcagcgccggcggcggcggcggcgccacgccggcgcggcgccagagcgcggcgaagccggcgaggaggcgccacgcgttgggcgtgagctggctcggcgcgagcccgaagtggaaaagcaccgcggcgaagaacggttgcagcggtaaccgcatcagcctttcttcctccatcgccgcgacgtacacgaacgccgcacccggcggcggcggcgcgcacgccgggaggtcgccggcgaggagcgcggtaancccgcgcgggatggagcacctcccggtgatgtctctcagcgcgtccgccgtgcgcagccacgacgttgtcttctcagccacggtcaaagcgcgcgcgcgaccgccgccgccgccggtgctgggcgagcgggcgcggccgaggcgcgcggcggccggcggcgaccacgacgacgaggagcgtggagaggatggcatggcgagctgtggttgggcttcgcgaggaaataccaaccaacagcgcgtactacgtgctgtggttgagtgtcgcgctttgcacttaatttatgggattgaaatcctttgcctatattgaatccacacgtgtcaatgataaagtcacatgattttaaagacagaggatacttatcctaatttatggggaacattcctacatctctcgtaatatatcatttcattcatttaaacccattcgtttgtatataaaaaatcttattgaatttagtaaaaattatacaatacatataccacttcataaaatctcaagtcttaattcaaacccatattgaaaaataataattaaaaaaggacaaatcaattgtttggtattactcaaacctaaatttcctccaattctttttaaaaaatatgtaggtcaattttgaaattgattttggtggagtgattagtattattatgttgtacattatcaatttttaaaagtaattttacagccagttgcaccaaatttaaaagaaaaatgcgtgcgatgaaacattcgccttaagggattacaatcaatccatttcccaatttatacacgggagattgttttttcaatctcttgaagagatatttccttgtgtacattaacatattaaataaatataaataatgataaaaaatgggaaaaaaactctctctagtttcgcaacataggccacaaccatagataatataagagaatanctatataaaaccattccaatataactctaatataattgaagtgtaattatattgtaaatataattacaatgttactcttatgtaacaacaagcggcgctcggtttcaaactcacagtgagagtatgattccctagcnccacatgcgaagaaaatgtctttctcccctcgaagcacatctaatggctaaaaaattaaaagcttcccctacccgttttctttcattagcagcttaatcattcgaggagaaaagaatgaaggtggtgtgtccaagggccatggtggtgcgacaatcaactccatcgccacatcttgtagcttggagagatgaaccgcgagggatgccgccatcactgcttcgttgacccgagtttatcccaaatcttcgcctcatagacttggctaagaccagtgggttgaaccgtggttcataattgctctcactctcacatttccacatctgtctcttaatttttttttgttaggcttgcttgagctgtggttcgtaaatgctcttactttcacactttcatatttgtttcatatttccacatttgtcgactctccatttctttaatttacctctccagtttccttccccatcatgaacccaacacaacatttgcaccaaaatgtgactgccccctgcagctactctgttaccgtgcaacaaaactactggagacgtgttagttgtcacgttcatcctttccctaccatccacgacaaaaaaaaaaaaaaacagctaaagagcaacgaaagataacatggttagtattttcagtttgtaaacagagtttacagaactcattcccccccttccaattccttttcaccaattgctcagcacaggggagtctacctctcccaactagatacaaaaaatgttttatctttagaggaattctatctttccaaactgccctcatttcaatatccctaatacccttaaaagttaaaattatgtacattgattttgtggtgaacacctcttttttagtatgaggccaataaaccttgtctttatcagtccccaactgagattccccaattatctctacaagctccccaacctctctacccctttgttcattaaatttcttctaaactccaagctccattctccttctaccaccatatccttgacagtagcattttgatcatgactaatttcaaatagataactttcaaaggtacattatcacaccaaacatccttccaaaaactcacatctctcccactgtgcacttcttttgtgaccagcctag

SEQ ID NO: 16167 - DNA, 1600 bp, Oryza sativa
  unsure (1)..(1600): unsure at all n locations
cattgtgcattcgctacacaacgcagcagcagcctaacttcggttcagaggagtttgtccacaagaacaccattttatttttatttttctgtatttgaactcagcagagcaccaaacttatgcagtgacactgaactgcacccccctttttttgtcgtttggaatctttggatgttagtttccatatgtttaagcgtttctgcaaattaaggaaaatttcctggaactattatcaccctagctcccagaattatcttgtcatatctgcttgtgttgcacgagatgttgagagtggatgctgacttgttcttttacctttttttcagttcattcactctgttagtgccacacttcagttatgtcagttaggatttttaccacaattcttatgcctgtttttttacctgagtttgacacgtttgtacaatgtacagtacaggtgactgaagtaaaatttgagctgtacacgttcaacacgttggtacaagggagtaataaaaaactgccgaggaaaactttcatctactatactgtgactgcaatataatttcaccataacttaacaaaattacaaaattatacctaagttatataaatattacaatactctgcattgtacctatagggtaattatattacaattatcctataataattatattataggtacactataactatactatagttaaatttggaagtttggttagcaagttttttaacaattcccttgtacaatgtaaacaaatatgagttgtgacttgtgagtngcacgcacaacagcaagagaagtagccagaaaacaagtacaagcacaaagggccgcagtatgcagacgcagctgcagcagcagcgaagaatattgatagagtaatagtagaattcccatggtcgtacagcttcaaataggcggatttatggnggggcaaagatacatttttcattgagttcgcacaatcaacacagcatgattacacaataaatagtaatctctacacaaaaaccaccctgacctattgcaatggtgttgcaatagttcagcagcactcaccagcacaccacacaaagacatggatggcatctcacctaatacaagtaggcaaggtgaagccatggcacataaagacgagcacaacgtatattattaccgtgaggaggaatatcaacgcaatcctgcacacggagtaatgtgagccatgttagtttctgcagaaggcagatggaaaaggatacaacagcagtcaagtaaacagatctgagaactcattaatataaggacaaatcttcagaaagtgtgagctatgccacatcactgcttgacgcaacaaaaggaaaatgagaaactgacacttgcttgacgcaacaaaaggaaaatgagaaactgacaaactatccagaaccccaaaagtaaaaccagatttcagaaaccagaatgttctccttggctccttatttacacacgataacatggttaccattccaaatcgtatcaatacagttgcttcgatttccaaaccttgcttcttctttagccagaagacttatgcatgaatcttacaaataccaaattacgcagaactactaaacaccaaaataatta

SEQ ID NO: 16168 - DNA, 7777 bp, Oryza sativa
ctctaatagaaggaacaggactctgcttttgttgtagttttaccaaaaatcacagtatttgtaaaaataagcaatgtaaatatgatgacgcttcaagtactgtgtgtacttcaaaaaaaatattgtgtgtgaatccatgatcgttgcacttctatcttacaatgtttgaaaacgcagtgcatacttattataatttttcagataaaatgttttacaggatagcactgcagaatataaatgcaaataaattatgatggatttaagtcatgttcacacatgaacaacttaacagaagcaatacctgactgatttcacccctcatacgatttattctgtctgcgtttgggtcattcgaatagtaatccatttgctgactcaagaccctcgagaactcatcattcatgccataagcaagggatgtcaatgcagcacggccatatgtcttcacgaaccttccatggatatcctcaaggaacgcaaaggggattcgccctacaacagaacgaagttaataagtcgctattaagccattcacatagtaataccgcacaaaaagagtctgcagcaagccatgctcagacaaatctgtggttatcaaaccatttagttttaggtgacgcttaatgtgaaaggcgtcgattgcgcaatacagaaagtcagaaatctgactcttaacacgcataaaccgcaacctttagaggcactaaaatttattgttggtttaggaaggttgctctagcccagctctcctcttgcttcctagctcaaaaagagccttttgaagcattgaatttcgtttgatcaggcaattgcaagacccagctgaaaagctcaactcgtcaagtaccatctattgtcagatgccaattggctagctctgactcgcacaatcccaaccctgtttgtccctactcccgatctaatctaccaatgaccaatccccgaagagaaccacctgcaactgcaaagccagcagctatcggagacgcgcatacagacaaaccccgcaatcaactccaccggacggatccccgcgattccgcccgaaacccacccaaacgaaactcaaaaattcccccaccatacatggcgcggcgagaggtgggatggggaggcttacgtccggcggcctcgtcggccatgcagagcgcggtgatgccgtcggtgcgcttggcgtggaagacgtagcggtcctgcgtgtaggagacgtggctgtcggctcccccgccggggaggcgcttgaggacctgccgcgccacggcgcccgcgttggtcgccgccgcgctgtgctccgccagcaccaccgtcccgcgcgccaccaccgcgtacaggatcgccatctccgccgcgcgcctcgcctcgcctcgcctcccgcctccggctgccgtgcggacgcggaggaggaggaggaggacggcggcgagggggaggttgaattagtactaataataattagaagaaaagaaggaaaaattacaggaagaagaaggttggggggaggagtagtatttggcggagacaggttggatggggtgggctggatggggcccaccgggggggggggcgtgttttgagctgggggtagagccccacctttataatgtagaattgcggtgttggaatgtgtttgggctggaacgctgacgacgtacgccggtcggtcgtttattctattactactaccacttgggtatgagtatgactctatgagccgccgtcccgcggttgggttgcaagttggcaccacctgcacattgctgcgttcgctccgctctctccgttaatttatttatgggattttttcttacacgagatatcgctttattatgattcgtacaatatcatacttttgatgcaagttgactccgccgccgccacgactcgatcgagcaggcactcgatcccctaactccggcgccagcgagaccccctcagtctcccatcccctactttccttcttctcaagcctacaacggcgaggtgcttacaccctaaaaccgtgttttgtgactccccgccgttgccttctaacccatgtcgtcatttgtccttgccacaaacactgacccaccgtcagttgccaacctaatggttctagcgccttgccattcacctgtgtctactgtccactgttggtccttcgtcgctcttggccatccatcttagccctcggaaaaccctatcttcccccacccttatccccctccgaccttaaccctgacctaaaaccctaatctgcatctcgacagtttcataaaatatagttgcatttgaatagcataggtaaaaatgatcataaatttttagctagccatcaaagtaggaaactaaactcggttctacaactcttagctgtatcactaaataaaaggtgatgagaaatagatagtttttaagggtgtgtttagttcacgtcaaaattgaaagtttgattgaaattggaatgatatgacggaaaagttagaagtttgtctgtgtagaaaagttttgatgtgatggaaaagttgaaagtttgaagaaaaagtttgaaactaaactcagcgcaagtcatactccctccgtcccaaaaaaaaaaagctcaacctaaacaatgatgtgacatcccctagtacaatgaatctagataattctttgtccagattcgttgtactagaaaatatcacatccccttttaggtatcattttttttttggacggagggagtactgtacacagcaaaattatgaacaggggtcagaggatcagatcaataggattataggtgtgtcacttgtcaaccactttttgcaagatgttttcgagtcgacgaaaacgtttgtaagaatttggagataaattttgatgtaaacatctgaagttttgtatatttagatatggatgacgaaaaatatgtaggttcagtttagtggaacctcaaccaaaccctctgctgtttggaatcagactcctttgtttattgatgaaatcaaatggtgggtgaagctttgatcgatggtgtgcatccggatcgcagatgatttcacataggaaagaaatctgtagcgaatcatcttgtgtctgaattttgtactacgttacatggttgagtaaatgaagcgataaaaattgtgagattttcagagttcagacaaccatgtggtggagtcttgaattcttgacgttgtgcaacattcgcgacatgtataataatgagagcaagtttaatacttatagtatagctcactactagctccaattcatttatagacaattcatataataactgcttactatactattaatatatggtcccacctatcatacacacactgtgtcttggagtccacgctgtagctggctacagatctatagcccacctgctcttctctcttatcttttgtcttattaaaatatatttacagccggctaatagatgctattgtacctgctctgatgagaaatttcttaggccatccacaatgggtacccctaagcgtgtccctgctcacggccgtcgccgctccgtccgtttgccgtcccccagcagaggggcgcgtctccctccactcctcggtcgcttttcgttgagccatggagctaggggacgcgttgggcgacgtcgtggcttgaggacacggctcccgcacctgatttttcccctttcacccttggcctcttcgctgggactgggaggcccatggcggtggggaggagacggagttggcgacgacaacgaccggcgacgaccccgcgatggagactgctcggcgacgaccccgcgccgctcgccatcggccaccgcgcccggccccgcgccgctcgccgtccgccaccgcgctcggcgagagagaaggagaggtgacgacgggtggctcaagatagagagagaggagagaggcgacggcgacgaccagatccggccaccgcgcgtcgcggcagccgtcggccaccagccggcgacgggcggagggcttcctcgcgcggcggcggcgaccagatctggcgcaagctgtcggcggcgcgccggtggctggggagggcgcaagctgtcggcgcggcgacagctggggagggcgaggagggaggcaatggcggtggctggggagggcgaggatggaggggacggcgacgcgcgcgagagaggggagtgattggcgatgcgcacatgagagagagagaagagaagcatcggtgcggtgggggaaaaatgtcgtcggtgggctggaggatagaggaagggtagtataggaaaataccaaatatgggctttttggttgggacactcattgtgggtttgagtgtcttcatccagttgccttatattttgaggagcccatctagggataccctccattgcaagttgagttcccctagagtgtcctcagttagtgaggacactctaggagtgtctcacattgtggatgcccttaggcctttcacagtgcaatgatgtggcgctttgcttcgttgacatggaggagaaaaggaggtgggtcccgtgccctcgcgaggtttacgcctcctagctagggtgcgagttgctcatgcccaaaaaagcaaaaagcaaacggtcccctctctctgctactcccaaatcttccccattctactcttcttccccgccaactctcaccaccatgccaacaatcgagcgggcttggagtcaccggcgatgctgccgagtgccgacgaggaaggggagaaaccgaaggatgggaaaaagcggcagggcaggttggttcgcggcgatggcgagggaggagcgggcggaaaggaatgagcagcttgccagatccgcggtgccaagctcgccgccgaactcgtcgccgtcccccgctccggttcgccgagctcgtcgccgtcacccgcttccgcgccgtcgacattgtcgccatctcccgctcctgtgccgccgacctcgtcgctgtctcccgccccgcgtcgccgacctcgtcgtcgtccccgcgctctgctccgtgtcgccgagttcgtcgccgtcctccgctcccgcgccgtggagatgagatcaaggacatcgtcgccgtccctgcgctccgctccgcgccgaatccgtcgtcgagccactgccgggggtggaggggctggtgagccctcgcgccgctgcagccctccgcgccctcgtcgccagccagaagtggaggggctggcgagatctcgcgccaccgccgccgaactcgtcgccgtctcccgccccgcgctcccacccgcgtcgccgagttcgtcgccgtccttcgccgaaggagaggagagccggcgccggcggagggaggaggggagccggcgccggcggagggagaagggttgagagagccggcgtgactgtgaggaagtagttgggggatttgggtatagtagtatgggtggagatttatatttttctctcgattttagggtggttactgtaaaatttggactcctttgcaaatttataaacatatgagagctgacatggaaagttacaggggctgaaacaaaaaagtaagtcactcatgaggctatttgcactatgggaatacagaaacttggatccggctcttcatcctacgtggaatgagataggggaacgctgtactgtgagaggcctctttgtgcaggtccatctagtgtgtgctggagggagggaacggggaacgtggcaactgacacgtctcgaccttttttgttgcaggggggcgatggtcttttgccattttggtccaaatgtgagtgcgttgccgttcgagagggaggaggagaaacagtaggagaggttaatgtgaaaagcgagttctacaggtggagtagcggagatggtccgcataatgttcgtttccaggggttgcggctgtgtttagagcagggtgaaaaattttgtcgcgttgtattggttatacggacatatatttaaaatattaaatatggttataataaaataaattatagattttgcctataaactgtgagatgaatttattaaacctaattaatctgttattagtaaatgtttactatagcattatattattaaatcatagagtaattaggtttaaaagattcgtcttacaatttacacgcaatctatgtaatcagttattttttcgtttatatttaatactccatgaatgtctaaatatttatacttcatgaatgtctaaatattttgatatgatgtgaaaatttttgacagggatacaggagtgaatgccccgttgctggatggactgagaaaactcgcacaaaacacgatgcattcctcctcttcctccccgtcgtcctccgttgagatcatcgacgccgacgccttccgctctcgctccaccgaccccgaccaccgtcgcgcagacgccgtcgccgccgactccccgttcccgaggtccgtcgccgaccacatcgcctcgtctctgcgcacgcaggaagcggtcgacgccgtctgcaagaagtacggtgtcctggcggagttcgccgcgcgccccgccggcgacctgcgcgcgtgctcggcgccgccgccgggcgccgcgtgcgtgtacgcacgggcgctggaggccgggatgcgcctcccgctgcacccctttgcctgcgagcttctccggcatctcggcgtcgcgccgagccagatcactcccaacgggtggcgcgtcgtggcggggttcctcctgctctcccaccacgccgccgcgccggcgtcgctcgccgtgttccggcgcttcttcaggctgttcttgtccaagctgaacggctggtaccacttccggggcaagcgcggcgccggcgccgacggggtgctcttcacggggttgcccaagctcaaagggtggaagggaggcttcttcttcgtgtcgtcgccgtcgccatggccgtgccaagtgcgatggggcgggcccccgccgtccaagagctctaccgccgagccggtgctcagcggcgaggagatggaattggcgggaaagcttctgcacttgcatggcggcgccgcggttgatctgaggacgtatctctgcgagagcaacctcgccgcggtgttctcctccaacctcgccggcgccgcaccaccgcagccgccgcctcctcgtcctgctcgtgctaaaggtaagtttcctttctccggcgagttcaacgcacagaaggtgaagaccgagccggagagcgacatgccgtggtggtcgccgttgtccgggaagaagagggggtttgaagcagaggagaataacccgccgccgtcgccgacgccgacgccgcctgctccgcatggcggctcgtggtcgtggtcggcttccggcatgtgttccccgccgccgggcttcgcggcgcacgtgcccgacaagcacgacggcgactcggccgactggaaggccgcgcggcagctgctccaggccatcgtcacgccgtcacgggagcgccggttcccggcggcgaagccctccgacgtcgtcgcgtcgagctacctgacactgcttcaggtacgcctccgccgcggccgccattgacgcgaaccgctcaagaatcgtcgcgtgcacttgccttcattcatgtcgtcgttgtttggcgcaggcggcgaactacgcgtcgttctcgttcggctacgcgctggagctggaggagaagctgcgtgcgcgggagcgcgaccccgccgcggaggcggacgccgtgcggaaggagctcgaggagaaggcgctgcgcgagctcgcggcggcgaaggcggcgccggtgcaggagtacctgcgctccgacgagcacaggcgggagctcgcggcgcacgcgctggaggggtacgagcgcggcatggagcgtcgcgctccgg

SEQ ID NO: 16169 - DNA, 2530 bp, Oryza sativa
atctcatcctgtatcttatcccatattatttccttccaatcggattcgagaacggatatctatttgtatatctaattcatagatattaaatataataaagtaattgaagtattaaaagagatacatcaagaaaaatttatccaatattacatgtgagtatgtaaaatagttattaaccaatcttttatcatattttttatcatatttttaggtgaatcaataataatttttcatacatattttataatacggaacatatgggcggatacatgttttcccgtatcctaacccatatttatggcatgccacatcttaggtactaaaggtttggcaacctgaaaaagcatcaaaacaacccctactagttaaaatttgaagcacccaaccaaaatatattcgtgaatcattttaagcatagtactataaagtcttgttcaacatagttcattcatttcagcccatctcattcacaaaaagagtgaagaaaaattcgagcaaagcaaaaacatctcaaaaccacaaataacaagaaggaatcctgacacaaatcatctatcattctcaacatctcccacaatcataaacaaattaactaaattaaccaaacttgcctgatgttgaggcaatcaagaaagcggggattagataagccaacacacatggagtgacttctatcaaacattctcccgcgaacagtgctggtaaactcgagtagacgggcagcaccaacatccacagttcttaacctcggttgtttttttcttgtgatgcttctccaccttcgcacacagtttcttcgctgtcttgagcatagaacgaagcgaactatgcaaaccccttttttggggcgccacggacgaactcgctaccaaacccgccgcctcactacgagggatgaagagagagtaggggtaatgtatttagatttgaaatgggttggtttctacaacagattttaaagagcagatactatctaattggccttatagggtgcagatggggttttggattattctgctcacttgtttgaggagatggctgagggttatagagtgcagagcgggttttagattattggcatgttttgctcacttgtttgaggagatgactgaggggatggagtgctaatctaaacagtgctaagaaggaattgaaaaatgctttggtagagctggataacaagacatatgacagtggactttttgacagtgaatggaaaatcagatatgagatggaaaaggagatggaaaatatttacattcaggaggagatctggtggcagagaagagtggcagagaagaggaggggaaacttgattttacaaggagatgctaatacaacctttttctataagccctgcaaatggaaggtaaaggaaaagccatatcttctcttaaggggatgttaatatcacaaagctctcacaaattaaacaacacatgcatattataaggggttgcttggaaaagaagaaagcagggaagttcatctaagtcctgaaatctggcaagataagttgagactgactgagaaggaaaaagtttagatggttagacccttctcttcaaatgaagtggacaaagtgatgaagactatgaaaaacaatacagcttctagccctgatgggttgcctgtgggtttttataaacaaatgtggcctcatataagggttttagttaaagagatgttagatgacttacacatgggtgagctgcatatagatatgatcaattatggggtgatttctcctttgccaaaaatcagcgatgcaaacacaatcaaacagtatagacccatctatccacaaaatgtgacttttaggatgattgaagtggcaaacaaagtgattagttggtctcaaactgcctttatacatagaaggaatattttagaaggttgttttattttacatgaggtgatgtatgagttgaaaataaaaagggatactgggattatcctcaaaattgactttgagaaggcttatgacagggtaaaatgggattttttgtatgaggtcatggagaaaacgaattttgactccataatggtgggatggataaaaaatataactgaagatgggagagtgagtattaacattaatagtaaacagggacattttttcaaaacttacaggggtttgaggcaaggagaccacttgtctcctatccttttcaatcttgtgggtgatgccttggctgccattttggataaagccaaagaatggggagtccttgaaggtctggttccaaacttagtggatgggggtttgactcaccttcaatacgctgatgatacaatcctattcattaagaattctgatgagaacatccttgcccttaagttcttattattctgctatgaagagatgtcagggatgaagattaattatcagaaaagtgatgtatatgtcataggggtggaggatagtgagggattaagaattgctaatatgctgaattgtaagattggtaagatgcctttcacatacttgggtttgcctatgacggtcgacagaattgggatgagagac

SEQ ID NO: 16170 - DNA, 200 bp, Oryza sativa
acgggcgtacgcgtctgtcaatgccatgatgagggaaccgcggccgcataaggcacccatggcggcggccgcagtaggaggtggatgtgaagagcgagcctgatttggacggaccggcgtgcgcaccgtcgtcatcgaggaagaagaagaggaagatggtggacgacgacgccattgcagtggagggaccatccgggcac

SEQ ID NO: 16171 - DNA, 798 bp, Oryza sativa
gtgaacacgctcacatatgtgtggtacaaatgttcaccaatgtgtagtaggtaatccctccgtcctattttaagtgcaaatataagtttctgtatccaactttgatcgctcattttatttgaaaaaaatttataattagtatttttgttgttatgagatgataaaatatgaatagtactttatacgtgtcttatgttttgaactttttttaaaaaaaatttaaataaaacagataattaaagttggaaacgtaaaataatagcgacactgaaaatgggacggagggagtacgataattatagtttatgtatagtgtactaggttctgaacatgttttctactgctagctgaccgcacgatcgtgtcgctatcttgtcaccggatcagcttttgttgtacaggctagtaccaaaatttgtacaagatgggaagtgagctccattggttaggaatttttggttgaaccagtgaatccatctgcttcaaccgttggagtgctaaacaggccctaagctcgacacgagtattcgagtatttatatttacagttaattatttttttaatagtagatgacgtatccatcaatagcttttcagaaggtgttcatcagttgtatgtgccgtgtgcgtttgcatttatgttgtgttttgtcttggtcaatagtgatggtatttgccgaaggagatactactagtataacacgaataggtactgctagtattgttacactacaaataattgacacatcttgattattatgtaatcgtactcgatcaatgtccatgaataatccaataa

SEQ ID NO: 16172 - DNA, 2270 bp, Oryza sativa
acggaccacgccggtggagagcttcgtcgtcttcgtccttcgcgccgaggagggagacgctacgaatagaagaaggcctcgctaccgccttccctgcccgctgccggcttcgccgccggcgggctccaacgacagcgaggtggggggagggagggagaaaaggcgcggccggctagggtttttcgcccccgagccacccgacgcgaaagcgacgcggggggcttttttgctttttaactcccctcttccgctcacagtaagttcacccacacacaaaaaagggggaagctcacagtgagacagtgagttttagcaagagctaagatagcatgatgcaatggtgacaagaaaaacagcattcgtggacagatatatttacctccatgtgatctcctaagttgatcagcaaggtgtgaggtttagttgggacatcataccagacaccatctttaagaacttgtagcccaccaacgtcgttatcaaccataagaattgtaagaatggttgcatcagaatgaggcttcatgccatagacaagatcaggccttggacactgagggtagtagttgaatcgagcaatagtggtaggcctgtcagagaattgtctgacaaagtaatcctcgttgagtttcaagagctttgccattgatggaaggagactgtttttaactccatcacattttatgagaaactcatccagaacatccctacataagagtcaattcgcataatggattggtactggcgaaagtgttttattgacataatttgaactataaattttgggacagagggagtactaaatttttgtgacacgttgcaaccataaactaggccttataagttgtttaccatcgccgtaaacaaatcgtaaaacatctctgacactgtgtttgtgatattacctgaaagattcaggatgcttgggccaaacggaaagatttctctcgtctgctggatctactttcagatacaatcgatccaaccaatccaggatttgggtatcagatttcacctggtcatttccatacccttctagctggaaatgcttgccgtcaatcaagttggtgtatttttgcttctctccaagatgctgttgaaaaaactctcttgacacattcatcacgttatccatcagagcatcttctatgccatggttagttacctgagaacacaattgcagatatagaatataagccacgacatcatgttatttaaagaagccaaggcagttcaacaaaaatctatcaaaggtacactgactacttattaccatgaaaaggccccaagactccatcgcctgccggagtttcaccgcctcattggcatcaccatctggttgggacaggcgaccaaggtcaacaatggggaatgatgcagtggctgcaatggtcggttggtcttcttgttgcacaatgtactgtcttggcacagatttgcttctcatgccggcaagctcctgcacaagtagtgttgatctcacatcctccatgctcccttccatacggatgtagctcaggtactgtctcaggacttaggttgttcaatgctgttgagttgatacggagaagttactatatatgagtctgagaccatgtacgaaaaaagagtaaaaatactgccattgttgcacaagtggtcatgtaatgaaaacaatttatacctggtataaaaaaatgctgtaagttgcaaccaaattgctgaattaaccaaaaaaaaaaggcaatttgacatttatggagcagagttaggaactgcccaatagtggctgacaattaagatttaaattcaagctcaacatctgattccctaacttcaatataagcacctagagcgcagctgtgtactagcctggagttggcaggctgtttgttctatccttaggtagttgggctaatttctggtggcacagcaaccttgtttgtttatttattacttgtaacctctccttggtcttaatttgggcggcatacttttgccggacaatgaaaaatataagcacctagaagaataaagattcaatataccatgtgaatcagaaaaccactccatgtgttacacaacatacaacatgccaacttcaacttgagaggttgagcaacccgatgatgcacagcacaggcccttaaatttaagcttgtgataacgtcctttccagaataacttaacatcttgaaggagcatattaactgaacctggcaatatcgcttcttttttatttggaagtggcgtatttcacatcaaattctatgacatcttgtttcttttta

SEQ ID NO: 16173 - DNA, 3540 bp, Oryza sativa
  unsure (1)..(3540): unsure at all n locations
gtacgccggcgacgcgtcagtattggagcccctgctcatctgcaagctaggctggctcggcacgattctcttatattttaaactccttccgtattttgtattttaatgtatgatgttgttgactttttaaccaacatttaaacattcgtcttattttaaaattatgtgtaaatataaaactatttatataatacttaaaaacatttgatgataactcaagtcataataaaaataataataataatatatattttaaataagacgaatagtcaaacgttggtaaaaataaatgacgtcatatattaaaatacggagaaaatattaataatcatatataagaacaaaagatatggttttcacatcaaatgcggaatttagctttagcccaaacggcatgcatgattggagctcgaattttttaaattatttttgaggactcaagtgcgcgtgcgatatttgcttttggctcctcaaacaccactcaattaattataaaaaaaatccgaaaagatattacagtacaacattgatacagttgatctacacacaacgagaaaaaacaggaggacaaattcagttacaaatagtactataaccaaatttatgacttcaggttttcaaatattgcatattataacatatgtttagaaacattttgatgatatatatgcaaagcaaaaatatatatatatactccctccatttcaaaatatttgacaccgctgactttttagtacatgtttgaccattcgtcttattcaaaaaatttaagtaattatttattttttttcatatcatttgattcattgttaaatttactttcacgtacatacatagttttacatatttcataatttttttaataagacgaatggtcaaacatgtgctaaaaagttaacggtgtcaaacattttaaaacggagggagtactactttggttgtaaattgatttccccttcatgtggagagtaaaagatcgatctatttcttcacaccaaagtgaactttatttttcatcatcaacacagttcatgacacagtcgatacaacacattattgataattcatccgtttcacaatgtaagtcattctaacattttccacatttatattgatgctaatgaatctaaataagtatatatgtttagatttattagcatcaatatgaatatgagaaatgctagatgacttacattgtaaaacggagggagtagtagattattagactcacgtaatacgtctcaaccaacctagtaaacaccaacgtgaacatctatcattctatctattattccacatatttttttagtttaagcatgcaggccacgcgattaattagctagattcctccatcacatcacgcgctggtcgagacggccgccgccgccgccgcctccggctgctgctgctggtgctcgaccttgaccttgaggaagtcgatggtgcgctcgccggcggcgaatgcgtcccagaagccgtcgccgaaggccttggccttgagcttctagtacatcgccggccgctcctcgccgacgagctcctccgacggcgccagctccttgtgcggctccggctggtagaacatcaccaccgacatcctctccctctcgctcgtcaccaccctgtgcaccggcgccatgaacacttgctcatgatctgcaacaccaagcaatgcaaacaacttaaatttttattcaagcagatctatttttttactcaaatagctataaaaaattaagaaaatagtaatatcaaatgggatgacataaatttatagaaagactaaatttaatctagaactagaaaagagaaacaataaaatcagctagtaaatgtagatcgaatttaaacttccatgtttacgcatggagcctcactgtagggctatctactggtagtagaaatcaatttaaagtgttaatttcatttgattgaagagctcagatctatttatactaccagcctagttagcggtggtagaaacgtggaggagtattagaaaaaatagatgcgagggcataaacgttatttagcaatgactaaaccttttttttcttctctttttttttctttttcgatgaaatataagcgatgccaacacaatcaatgaatgatcatatatctatttagacaaggaaaacataaataacaaagtaacttttaatcattataatagtaaattactaattatcctttataatactgatggtataataccaccaatagaaagcaccgaagtatcactcttatgtattattattatcataatctatcttaccaactttttataactattacctcaatctcgtcgccggcgacgacgaggagctcgttggtgagcaccggaatgtcgagccagcggccgtccttgagcagctggaggccgccgacgtgcttgtcgaggaggaggacggtgaggacggagttgtccgtgtggggcttgaggccgtacacgagctccggccgcgggcatggcgggtagtaggtgaaccgcgcgtacgtcgtcaccttctcgccgaccttgtcgccgaagaactcctncccgaaccccagcgacctcgccgtggcggcgagcacccgccggaacacctgctcgctccgccgcgtgtactcctcgaggagtccccggagcgccgccgggtgctccggncaagactncagccgncgttnctncttcggctgcacctggaggtagagccggtcgcaccagtcgaggatctgctcgtcggtgtccacgcggtcgatgcccgtagccctcggctggaacctctcngccgcgcgccgacgccgtnngcgtcggcggcggcgaccacgttgctgtacctctncttctnctncggcgggaggtggaagaactcccgcgtcgcggcgaggatctcgtcgaggaacggctccngcatgccgtggccgtcaccgcgaagagcccccacgactggagcgccgaccggagcttggccgcctcgcccgcgtcgtcgacgacgtcgtcaccgctctcggcggccagtcggctcacgtctatggtggggatggcgccgagctcccgctgcgccgcatgcacggcgccggccgccgccaccgggccgtccttctccggcagcacgtacttgctcggcggcgccccgagctagccgctggcggctaggtcttgcaccatctggccctgagctgggtgcaccatggtctgtgactgtgtgtgtgtttgcttcactgtcagtagcctctactcattaagtatttaaatagtctggatttaactccgttatactacctccgtcacaaaatataaactacctccgttacaaaatataaacttctagctatgaatctagatagttatatatccatattcattgctagaaatgcttatattctggagggagtatagattttttttatttgacgcaatcgttaacatgcggtgtagacattggacaacaccacactgtatcttttataaaatcgagtgtggaaccatatgatattttgttaggaaaaaagcttatcatcagttcatcacccgtcaacttggtgatcatgcag

SEQ ID NO: 16174 - DNA, 13743 bp, Oryza sativa
  unsure (1)..(13743): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnactgtgagactccacttcaatggatagtttttgacgatggaacgatgttgcattgagaaagacccggaggtcttcaactgtcatatttttaaccggaaggatattctaaaaagttttattatcccatttcaggcgacttgtttaccctgcaaattgtttccgtcattttctagtctaaaaaatttgctgggcgatctgccatgatctgtatcgatagtgatcgtcttaaatcatttcaatggaaaggttgcacatgctgggattgtatttcagggacagtaaagcatctactttggctgcagcagacgcagcctgccctccatttgtttgccactgcccaagaatctaagatgacatgcattaaacttatgggttgaagtgacaaatggtgaaatggaggcctcaactcagggctggatttgaagatgttaatgagaaaaaaagttggagaagagaaggccagtatatcccctaaacttcgaacagaagttcatctatcaccctgaatttggtttcgactttcgacaaatatgtcaaacaggaagctccaccaaaaataagctcagcgcttttatagtttttgtcaactagttcccctacacttgtatttaagtatactgatcggataaagcagcgtttgaaatgatgtatctatttttcattccagaagccgcttggtgtatacaaaatggcaaaatatacagcgtcacctcttcatcaggacaccaccgtcataaccatgcgtgctgctaactcatgcgtgggaacatactttctctgcatacggcagcagaattacagcattagcatagaagtaccgccatgaattgtccagggtaggataatggattcaggaggcgagcttttaccttgtctagaactgccgcagcacaaacggtcgtcatcaacataagtagtattcagccccatcatccatgaacctactgatatgtcatcatgggcatagctctgtagcgatgcactgcatatcgaagagaaacaaattgctcaaatttcggtcaaattttgactgcatatactcctatattgactagagatatcaattggttactgttgtattattgattattgacaaagaacatctggacagtgttcctgcatcatcaagaccatcaaatagatggcagatggctaacatttatatatcagttagtcagaacagcatttcagtggccggttattaattcataaatgctaaagacagtattagtaacttatatgaaatccagcgaatatagcctgttttctgtaaatcacatatacaggagaagactcatgtaacaaaaaactaatttgtcgtttgaccaccaagaaaacatcatcctaattgcaacatttattctgtattaattgaactgatgcactgcaattgctcagaggggcctggttggtcaccaaaactggtttagcttagcatgactcaaagataaaacaggtggatgcgcaccacttacctgtttatgttaatgtagcgtgccaaattgttagagaggataaacaaagcaccggaagcatggcgaaaatacctgagaattaaaaatcacagtgaacggaaaaaaagtgatatactagaaagttgaaggagccagagaatgaaaacgctgaagaaacagcagagaacacttctcatagatactagtatcacccaggaaacacatctatttaaactaggcgtattccttcaccaaacaaatagaaattacaagcacaatgcaaattaagtctaaatataaaacagatgggcttcaccagatctttaagactcgtaaaccatttgtgaatcaaggagaaaccgctattagcatgaaaaagtagttataatgacatcatccgctgcaagccatgcaaggttatacgagtagttggtaatatgaaaaaaaaaatcattcttaggtttgcattgaaggctgaaactcactatcaggaggttgaaatgtttgtagcctcaatgtagcattagactcagaaatccaaatactaagaaagaacatgagatcggtgcttcattaataatgcccataaaacatgtaagaacaccactagacacagaattattgctaatcacccaacactaagatgaatattaggataatagacaaatggcaaggaccttgaatatgttagtttactcacgtttttgaatctccaaacttccaccattcaggttcataccattgttgacccctgaaattgaagttggtatcaagtggcttcaatgacgggttaacaaagggcaaagcaatccaatgtactgaatgaaatattatccctgaatatataaatgatgcaatgcaattaagagtgtgcaaggtacatgttttctcgatatcaagcaatggtagcacctaaggtaaataatgggactaagcaattcaaaagctatgattccttgattggaccaaacgtttcagatgctcaatgcattccactacatttacatagctttcaaagatggaaggatgtcagcatggaagcatcactgctaaatggatccgcaaggaaaacaaatggtacctcttatgaaatggatggtctagttggtgttaacatatgccatgcatgttgtctaaaatctaaataaataaaaacctactgatgatgggaatgaaagcacatactcttcacttacaacacctcctgatttcatgcaacccatgtacagtccttggctacctcgacgggcttcaagcatctcaattaatccagctaatatatagattgtaatgagtcaaaacattaagccgaaataagccataggtgtaatgtttcaacagaaaaggaattacccaggtcaaggttaatgttgtcatcgactttcacatagaactctgcgtcccaagcttcaattgctgcactgaagaaaaacttaactttgcttggtaactcctctgcagcttcctcatgactttcctgtgtgacaatttattgactatttatgtcacattctgttctccataaagtgcaagcagtttgttcaagatttgacaatgtcacaaaaatggttttgatctaagctgtatatccaaatgtcaaattaaaaaccgacatttagatgaatcaggacagtgagataacttaaaataggtactgaattgaaggcccaatacggacgagaatgtaagatagtcttccatgccagaaaacaaccaagcaaagccaaaagtcttctgcatgtactacagtactaattttttgtgaaggacaaattggaaaaatgatattaaatgttattagatccttacaagaatcaagaaatctttcgtccgacgattttcatcatcgatgttgcggtccaagctatcacctcgatttgcactgaaggaccaaacagaacaatttcagtaggaaaactaaacatgaagaaaagcctgagaatgatatggggcgaatgattgtctaaggtgctagagatgctacatataagagatatggatccagaataaaacctccgaccaatgacaaaacgaatgaccacacccttctcctcaagcttcttcagagcatcacctgaaatttacagtgaggtaaaagaacaattatactcctgtagttgaaaccttataagtaacatagtttgcatcagcaatagctattagaaaaaaaaatgaagctgcattccaaccaaatgttatcagggcgcacacattttatcgccgtaaactggaaactaaaagagcaagaacagcgaacctctcggcatccatgagccacggaaggtgttcctcttgagccgggaaccaaaaccagtgtaaactccaataacagcaaggagcttcttcttgtcagaactaccagtagcagttccattcccccacagatacccctcgctcttcgcctttgtaaggtccatttctgcctccgcaatcttcctcccaattccactgccaccaaacaacccatttcaaatcagcaactaaaattctgaattctgaattcctcttcagagagagagaggggggaattacatgcatcctagattcctcagcttgtcctccaccgacagcaccttcggaagctgcaatttaggcgataccatcacacgaactgacaaatcaagcggaaaaaaaaaacgagaagtgggtggagagggggagagatccgcacattgccggagctcttctcgaggagaccagacaggatcatccgcgtctgcgcgtcctgccacagcctgcaaaaaaaaaatccaatcaacgaaacaatcagaaaactccacggaaattccccccggatctgagcgcgcgggcgcgcgtacgtaccggccggcgacgtagagccacgcgaggcaggagaggaaggccatgacgagggggaccctccccgaggagagggcggcggaggcggaggcggaggaggaggaggggggcttgaagcggcggttctcccgccgcatggcgctcgccagcgtctccatggcgatctggtggcgatctcctcctccctaccagccgccgctgccgctggtagagaagaaaagcttcggacacactgcagctcgcctccaccactcgtaggccgacaagaagacgacgaattcggcccaaattcaactccatttttgcgaaggagataaaaacgggccgaattcagccccaaatcccacgccatacgcaaaattgggccgaaatcagagaaaattggagtaagtctaatttgtctccctgtcatgcttttgagtgaatcaccctcctcaaccgcaaaaccgggtataatgtctccgcttcaaaagccggtgcacatcaacataaaccacttcctaaacccccaaaatagtcaatttgcactggttttcgaagatgggagagacgttatcagacaaaaatagacttatccgcaaaagaatcgacttgcactggtttagatggaatagatgttatatccggttttgtagtcaaaaggacaaaatagacttattgtcaaaattctacgctgttcgctaatttgggccgaattaagccgaagcctgcgccgtttgggctagcccgttgaggcccaactcgccgaatgccctacgaaaccaaccacacgaagcccgcgagttttccgtcaccttctcagttcactcgacctcgccgccggcaatggcgctccttcttcttcgccgccgcatccaccgcggccacaaaacccttctcccgcgcgccttctcctcttcctccggcgagggtatgttcccgcctccgacgtccgaccccgcatccgccgatcagcgcaccaccaagctctcctcccacttcgccgaaatccgcgggcaccttaacgccaccccttccttcttcccgccgngccggattcccgaatcaccgccgcccgacgatgtccggcgcagcctccaccttttccgcaacccccatccttatccggcgcgaccttcgccggcgccggaaaccccagccccttcttcggcgacgttttccgcgccaggcccgcccttcgaccagncgngccaccggagcggacgcctttccctttcagcgcgctcgcgagagcttgaacaagaacctgggaacgagccccacggcgtcggcggtgcccctccccggcgccaccgcaagttcgccggactggagctccatcctctcctcgcggcagagacacgacgggaagccgctgccggagtcggtgttcgggagggaaacgaggggggaggcgaggagaggccgtgacggcaaagtggaggagcagcagttcatccggttgtacagcgacaatgagctcggcaagaagctcagtgaactgcggccaccggtgggtaaggatgggaaggagtggttctccgtggaggagctgagccggcgactcaagaagctgcgagagatggacagggaggaaagggctctgcagtccgggctgggcaccgacgtgctgcgggatgcgatcgtgacgctgcagaccaaagatctgaagacgaacaactgtaatgatacatcgtgattttgctgttcttgtttagtcgccattggtgaatgcctgatgaaactgatggataacctttttgttactgatgatgctgtggttacatttggtttgctagtggctgcagcacagagtatgtcggctttgatggcctttggctctcaggccacaccggcgtacttgctggggaaaccgcaacaggagttggtggagagggtgagctggaagtgttgtgcatttgatgcattttgttgtttagattggatgatgtggtgttgagaattgtcagttggatctttgcagtacttccatcccgatcatatgtcatcagcggagaagatgaagcaggagctccagagtgtaagggatgagttcaaaatgtctgagaatgactgtggttctgcacgggttcaaggtattttttgtttcttctgtaaccatagagttgtgagaaactgacatcttagttatgaggagctttatatgtgatcatgttcaggtctttatggtcttacgtgagaatttgttctcatatcaaacactcacttgctatctattaaaattcattacttaaaaggtacacggtaaagcactgatatgtgttaactggtgcaaatttatgagtaagtttcttttgacatgtattgcactcatatgtgttgactgctgcaagtttatgagtaagtttcttttgacgtgtatttgttccccatgagaaatgacaacgtggtgtatacttttacagtaggggtagttttaaggctcaattttgtgtattgaagatgtcgtgcaataagagttatttgttaatactgatatttaggccatttctgtttgacaatttttgaactttttgttgcaaacttctgctgccatttatttagtcaccatctaagtcatgttccacgcttgggtatgttatgttgagtgttgagtgtgtgaataagctatgtaatatgcacgtcacgttttaaaaccctgaacccagtggtttagttattacgagtttagttaagatttggctttatatccaaactagctaatcttgtcctctaaatttgaagttctcttttccaagcttctttttagctcccaatctgtaatatagtttttcttgattcaaagaaagttcaggttcatgattttttatgatgcttccataatagatagatttgctcggtaattgcatgtgactttgaggtgtttacattggcttgaaaagttcaggcatacgaccaaagcaacacactaggacaattgcatctctttaagatttcacattccttctcttttttacccagaaaaacttcctttgttgtaattggtttcagaaaaagggaaactctgtcagcaaggctttagatgagcttttatctccatgcatgtttatgactttatgtaaaatttcctcttcccttccacctttctggcttgtaagtacatattttaggcttgtatatctgcaattgatgcccgtctatgttttgcagtggcacaacttaccacaaaaatcaagcatttgtcaactactctgcataagaaggtgatcttacatgaccattttcatacagcatcacggtttaccttgccatagaatttgccgggctcgcctgattttcttctggtgaagtgaaagtaatatgtgaacttgacgtgtaattcaggacaagcattccagaaagggacttcaagagatggtgcaaaggaggaagaaatacctcaaatacttgcgcagaaccgactgggattcatactgccttgttttgtcaaaactgggacttcgtgatgtgccggagtacaagcctccagattacaagagcaagagaagcagcagcggcaagaccaaagccaagagaaagatgaagagaaaaatgaaggcataagatctaatggtagatttttcttcccgttgatttggatttcgtgaccagaaaccgatagatagattagaagcccaggataagtgtagattggtctcctggtcactgggagtaactgtgttttattttggagctgagcaaataataccaacaatcaaggttgcgttttacggatcatattttatagaagaaaaatgtttgaaatactaagaatgctcctgatctactgacgatgattcgtgatctcaaatactaattttttgttgattcactcgtgtactttacttctactcacctttttgtctcatggtaacttatcaagggccatcaatgtagagagcttgtttattttgttaccaattctaacattaccaaattttgacaatatcaaattttggtaagttttacattgctaaattttagtagctggatgtatttagcttgatgtcttccaaattttgttagtgtttttgtttgaggaaagtttcagaactaccatattttagtacgatggaattggtaaggtgatggttagtttgttaacatatcaaaatttggtagtgaatttgttaggcaaggtttgggtggagaaactcccaggggtctttcggctagctccacgaggtgtggtgggctagacgacttgggttcgaagcttcaccccttctaattatttgatattatgtcattctctaatatttgtgtcttttttaggcaaggtttgggtgaaagaattgggtgaacaatctagttacttgcaacttaaacccaacatcctgtgagtcacctgcttccctgctaacttcatcccgcttgctgaaccgcatatgctatgcacgccgccttgatccggtatccttgtcgagctccgccgcggcgccgccggcgccgtgcatcctcggcggcgatcgacggagatggcgcctcggctcagcgtgaagaagtgcctgatcatcctcgccctcgccgccgccgcggccatcgccggcttcttgtccgtcgccggcgcgggtcgcggccgttcttcctcctcttctccggcgcgtcggctgtcgaatggtctcgccgcggtgcgtgtggttttcgtgtacgccatggtggagagtacgttagtgtgatgagctttgtgcttgtcttttttttttcgtgtgtcatcaggagagggcccggatggcgatggcgagggcggcgtcgccgaccgtggagcgggagctcgacgcggcgcgagcagcgatacgccgggcggcgcggcggcgtcgacatggtgatctcgccggcggcgagggacgaagcagcagcaacgtcagctcggcgaagtggctgagcttcttcggcgacgcggaccacgctcgcctggagcgcgtctaccgcaacccggcggcgttctacaggtagtacataactgaaatctgtccgtacgccggcgacggcgactcgctgacatgtacgccgccgtgttctctccggtgagggggaagcaggagctacgtggagatggagaggcggttcaaggtgtacgtgtacgaggaaggcgagccgccgatcgcgcacgagggcccgtgcaagaacatctacgccgtcgagggccgcttcatcgaggagctcgagctcatggcgccgccgctcggcggcgtacggacgtgggacccggcgcgcgcgcacgccttattcctgccgctgagcgtgtcgcagatggtgcagctcgcgtaccggccgctgtcgtacgacctctcgccgctccgcgccatcgtcgccgactacgtcgccgtcgtcgcctcccgccaccgcttctggaaccgatccgccggcgccgaccacttcatgctctcctgccacgactgggcaagtacaaatcatttttttcccttattttttcagagaaaaatattttcccaacaccaaatgatttccatacaaatttcgaaacgagtgcaaataataaattcagtacatactccctccgttcaacgagactcaatttctgggtttccgactttccgcgtccaacgtttgatcgtccgttttatatgaaatttttttattagtatttttattattgttagataataaaacatgaataatattttattcatgacttatctttttaattttttaatatttttttaaataaaacggacggtcaaacgttagacatggaaacccaaaaattgagtttttttcgaacggagggagtagtgtggaaagaaaaatagaatgaaatgagggggcatcgaaagatccgaaattctggaaattttcatccgtgaacatttcaaatttgaaaaaaagatctgccaagttcaaaaataaaagaacttccctcgaaataatgtcatatcgggggcacaaaattctccgaatttcgaaattttcaaaccgaattttatgttgcacgtgcgtgcgtagggtccgcacgcgtcgagggggcacccggagctgtacgcgaacgccatccgcgcgctgtgcaacgccaacacgtcggagggattccggccggacaaggacgtcagcatcccggagatcaacctctacgacggcgacatgccgccggagctcctgtccccggcgccgccgccgccacggccgttcctggcattcttcgccggcggccggcacggccacgtccgcgacctcctcctccgccactggaaaggccgcgacccggccgtcttccccgtctacgagtacgacctcccctccatccccgtctccgtctccggcgacggcgacaccgacgccggcggcgagggcggcaacccgtactactggtacatgcggcggagcaggttctgcctgtgcccgagcgggcacgaggtggcgagcccgcgggtggtggaggcgatccacgccgggtgcgtgccggtggtagtcgccgacgggtacgcgccgccgttcgccgacgtgctgcggtgggaggcgttctcggtggcggtggcggtcgccgatgtgccgaggctgagggagctgctggagcggatcccggcaccggaggtggagcgcctccgcgacggcgtgcggctggtgaagcgccatttcatgctgcaccagccgccggagaggctcgacatgttccacatgatcctgcactctgtctggctcaggaggctcaaccttaggctgaacagtcactaacaatctcatgatcagtaaccaaagtaaaaatgccatgaaaaaatataggtctagaattatcagttgcattagcactccatttttactgaatacaacttcattaactagttcttaacatgtttcttggctttcacatctcagagttcagaagaaaaaaacttggtatactcctgtaaatcattttgaccacgaagtgtctgaaaacttccacaaaccatattggtaacccccttactggtagaaatataagagggagtagataaaagagtataagatgtacaaaaacacaagattatgttgaacttgacagaatgtaacacggctcaaaagaggttcatcagtaagcatctcctataccaaatgcaaatgtcttcagttatcattgtagggaatgtaccaaatcagaaaggagccaaggatggttagcgcaaaccacagtaacagcacatataatgtataaaaggtattgaaatcaggaaattccatcaaacacaaggggaaactcctcttgtcctgaaatctgcaagttccagtctttttgccttctcatccgatcccccaaacatctgttctcggagggattgtgtggtcatcttatgctgtgaaataggacatgacggttctagccttctagcctaactatgatacccagattcacagtattgacaaggctgactttgctaatctgaagaactagatagatggtgctggaagattgcttgctatttcagcagctcaccaccttctcatctctccataatagtgttcttgattcactgggttaccggatggaaaaccagtggcagctaatacagtaagcccaacaatttggccagtcaattcaaacctataaatcttcagcctattgtgatatagacaattctacaaaacaacaatcatctttttctaggtaatctaaatgctgaatatgatatatcaatggtagttcgacacttccactgtataacagttgcaggttatcttgctaatactagatagaaaaattacacggcaatttgggttgattctcaaattgaaccatggttggaaaccactgtcagcaattctgccaaactataatggtgaactctatcaggatcacaactcgaaccaataaattctagggatagagaaatacaccatatcccaatacacaaagattagccatttgtgtttctgtcaaaagctgcatactgaattggatatgtccaaggtatttgggctctataaatatactcaatataaccatataatcactaagaagggttcttgctgataagaaataggacgataacacacaacaatctggattgatttcaaaccatagctgatggcaactcttaaaagaaaatttatactaaattcatcaactgtttaccatcacatggattaaacaccaaccgaattgcgagaacaagaagcaaaccatctcagtagatcaagcctcaggcgccggctgcgagaggccggccttggcgagcagcttccccatcgcctcaggcgagcacacctggtactgcacctccccggtgccgggctgcaagaacacctcggcgagctccagcttctcggcggtcaagctggtcgaatccatggtcttgctaagcaccttgagggcgagggcgacggcctcctcccgtgtcatcccgtcgcggtagtcctgcttgagcatggactgcgccgcctggctgttggccccgacggcggcggccttccagccgctgtagttgccggaggggtcgctcatgtagagctggaagccatggtgcttgtcccagccggcgaagaggaaggagacgccgaaggggcggaggccgccgaactgggtgtacccctgcttggtgtcgcagagggattggacgagctgctcgacggggatgggctcctggtaggagagggcgtagcgctgggcgtggaggcgcgccgtgttgaggaggatgttggcgtccgacatgatcccggcgacggcgcaggcgaggtgggagtcgatcttgtacatcttctcggcggagcgcgaggtctggaggagcttggaggtgaccttcttctcgccgacgaggaccacgccgtcggccgccaggacgcccagggccgaccctgcgttcccgatcgcctccatcgcgtactccacctggtagagccgcccctccggcgagaagatcgtcgtgcggctgtcgtaccggcgagacatcgcggcggcgggttgttgctggggattccggcggcggaggcggaggcggcgacggcgagagatctactattactaattcagttgagatgtgaggaggttgtaggttgcaaaggttaaaaaatgatttcttcaggggtccaagtagaaaaacgacagcccagatgggccgtctgactctgaaaatgggccaggcccagagattgtaccatgccagcagggcctgccaaatcggcccattatcgtgagggccaagagaaggaataagttcatctaaggtctcttaacttgtcaacgaatccgattttcgtccttcaaccgcaaaactagatacaacaggtccctcaactatcaaaaccggtgcagattaggtccctcggcggttttaaaggctgttttggctgacgtggcacctacgtggctagtttgacttggtctcgatctgacgtggcattgacgtggcgcttacgtggcaattcgatccgaaaaaatataaagctcgtgggacccacatgtcagttt

SEQ ID NO: 16175 - DNA, 11653 bp, Oryza sativa
ctgcgcgccgccgctcagctcctcccttgccgcctgtcgccctctctcgctctcccgccgccgcccgctcaactcctccctcgctcgtcgccctttcccgcgctgccgacgctctcctcctctcccaccgcccccatcgtcgccagcacctcccttgccgcgccaacggcaccaccctcctccatgccgccgttgccttgtgttccggcgcgccgccgatgcctagtcaccgcgccggctccccaccgacaaaaaggttgagaggtggaagaagaggggagtgagggtgatatgccgccaccgccgctctgcccgcgaacctgctccgtccgccggccgccccactccaccggtcagtgaggaaagagagagatgaagagaggggagatggggagagaggaggaagaagaggggtgaggatgacatgccgagcccacgtgggccccaccattttttttaatttctatgtgaaactgacatgtgggtcccacgagctttatatttttccggatcgaaatgccacgtaagcgccacgtcagatcaagaccccacgtaggtgccatgtcagccaaaaccgccttcaaaccgccgagggacctaatctgcaccggttttgatagttgagggacccgttgtatctggttttgtggttgaaggacgaaaatcggattcgttgacaagttaagggaccttagatgaacttattccccaagagaataaacgaggcagcaacagaaatttccccatgatgaagataacgaagctccagcctccaggagagatcaagcagatggacaaaaaaaaaatgatgtttgttttaagataaactagtgacgagatttgacacaccaaaagcacattaaccgcacgtgaaatgcaaaaatgaacctcacaccgagacctgaaaacagagcgaacaactctagaattgctcagcgaatcaattgttcctcatagaaagctatttcctgacataaacaaatataacttttcctaactttgataatgagatggcagcagatatgttgtgcacctaacagatgagtcaaacatccggataaacagttaatttgctttattaaacaattgcttcagtgacagggaatgccaccatatgtagcaagccgcaaaaataagtttgcaagtcatacatactggagatgcatggaacgatggaaaacagtacatggacaactataactgaaccaaaaatgttatatcattcttggataattttagatcataaaaattccaaaagttgtggcaatctctgcatgcttcacatttagtatctgtgggatagcttctcctgctccttgtagtacattgcgtacctgcatagccatcaaaatagaccaggttatattgtttgtgatgctgtcaagaaaactgatagtcatcaatgtcaaggaaacagtgttactgcacacaaagaaacacaaaaggaagtcatcaattgtttacaacgtgaaccagcagtatacacactccaccatgttcctccatccttggattgaaaagaaggcctacttgcatttccctcacgaaaggcaaaaagagtgaatgctgtcagcgactcagtgttctaaaagttagcaggcgccaggtagccaccgtgtttagcaattagatggtgcaataggcggctagagtgctcttgtgttactattttagtgctatattgtttagcatgtaatatgttgctaatctcttggagtacctaggcagcactaggaacttaagaggccagccctgccaacccaactcctcttttcaattcaagttctcaaaaaacatttcaatcgttaggctcattgttttcaataattcacaatccgaggtgagggtttcctgatattaggaaaaacaagcatgcctataactgccaggcaaaaaaaaaaaaaaggtaactcatcagtactaagaaccatggagactatatgataagctgcatcaatggtcaaaacatagcatattgcatctacttaagacaacttcccaaaaatcctatggtacaaggtaaacaaacaacattcagatggtatttcttcaggcttcgacacatagtgagctcacaacgccaacaagctgtaacatgcagtttaacaagttcacataaagctaaatcactgaaaaatccatgttggaaaaaaatagtataataggctaactgatcattcaggcattcatccgaagacataatctagttttgcatatctcaagcttgggcatagattctccaggagacatgtgagtacaaaagctatatgtggcgctcaaaacattcagtttggaaacagtaacaaagccaatcaatattagaggcaaattcaactaaataatacagtacaagagaagtacttagctaacatgattggatcagcatcatgaccatacagaataccaaatcaatttgggtctggaactctcgattgaaacagcaaaatcgttgtgagaacaaatacaaatataacctcacagcaaataatttgcagcgagtccactgctccaaattctgcctaacctaattggatcgacggggcacgcgtttcccgagtcaaatgacaacccgatgcaacgttgacacgcatcaattcacgcgaaatctgcacaataattccgacgaaatgggagcaaatacagagaaactcatccccgcatcgcagacctaacgaatcaaccgaaaccgcaacgagaagaccgatccaaccagagccaccgaagctaaccatgcctaacaaccctagatccgcccagatccgccgaaaccgcatgcgcgcgagaggaggggggagtggagggaagaggatgggggaggcgtactcgtaggtgccgacgatgggggcgaggaggagcgtggcggagatccagttctcggagaccttgtggtggatcttggtggtgatgtccttccacagccccggcatcaccttctgctggaacggcgacagcgcgtacaccaccgccttcatccgcaccggcgtcttccccatcttcctctccctccctcgccgccgccgccgccgcctcggtggtgtgctccggtgcgctcgcctccgatcacctctacacgccgatcgatcgatgggcttctggattgttcgtcagctagggttcggtatataggatggatagaagtcgtcgtgtgttggggtattgggctttggcccaatcacaaacttggcctcttgggcccggcccaattacacagcgattttttgagtaaatttcagaagagcgaattataatctctaccatggcgagaatgcaagcaaccaaatcgtagatgtgaactctgaagaccttgataaacgatactggtagacctaactgtgcagatgcggtttggtagcatgattgttcactgggaaaaagaattatattagtttttcgaaatcatttttaaaatgtaaggtgttttgtttttgtcttgagttaaacatcctcaagtttaaccaagtttatagaaaaacaccaaattaatttaattatacctactattgaatatgtttagaatgttgctatcttttttcataaacttggtcacctaagacaccttaccacttggaacttggcattgattcgcgtgggaattacagtcagttccctatgaatttctgcatagttcttgtattccaaacctagcattagagttctcacttcttaggattgttaacatatttgtgaaatcccttgttgcctcacaaacaactcaacaaggttgaccaaagctcacatgcaaatatgcaatgtagacaaacaagttgcgtgcaaggtaagaggctaacatccaatggtatgtacaaacactgttctttcaatccttgcatcactgtcagtggttgcaaaattgcagttcaaagaaaccttctataaatatcaattgattaagaccatatcatggtcagttggtcaccatatggtgttaaaaaatttgggatagattgtctttattccctcgatgacacagcagcttattgagttgaccaatgaatcaatcacccacacagatagcacccacatgaccacatctacatccctaacgaacaggaagggcacagaattcacaggctctaagctggaccagaccggagagcatgatcaagatccgctatgaggtcgtcggcatcctcaattccaaccgatatcctgactagatcgtctgtcaggccgcgctcctcgcgaaccgcagaagggatgctggcgtgtgacatgaagcatggcaggctaatgagcgatttcacacttcctgcatttagttttaatttggattagcaagcaggaactgaaaactttgataagaaatgactggatcggttatattggcgcagtttcatcatggtttcttaaaaacaatgactcctgatgatgtatgacagcagaacattgagagaagcagaaatatgggtttgtctgaatgctcaccaaagctaactgttacattgaagtactttgtggtctcaacaacatgttttgagagagctaatgaaccagttaggaaactgagaactgaacccgctccctttgcctgcaaaaggaaagggaaatgttacaatcaaaagttattaggatgttctgaatccagttccaagatgtcaatccaaggaaatatcctaaatagataactatctaaagccacttaatgtaaggcaatttgaaaactactccaaaaaacaacctgggaatagtgtagagatcgtccaggatgatcaggaagtcctgcatagttcactttctttactcttggatgagaagctagaaattcagcaatcttctgagcattagcctgccaataatataggggtggtccgtctcttcagttgaatagatcacattaatgcatatgtaaacataaggattttggaaacagaaatataattaacagaaggcagactacaaagtcttataaattttgttgatactcgatatgtatattgaaatacatgttatggcacatgaaagaagttacacctgctgcttctccacccgcaaagccatggttttgattcctctcaaacaaagccagcaatcaaatggtgccaaacctgatccttcagcattttgtagaaatgcaatctctttagccaagctgctgacaaatgaaacaggtattacatcacagtttccatcagcttcaatttttaaaagtctaccaacttcaaggaatattgagtagatgtattcagcaagaaaaacaaaagagaaaggaattgcccattagcatccaccctggatattcatgcctattcatgccaccagcaatagataggagaagtgtaaagtgaggtccatttcaagaaaagtagaaaaggagggtagtgagaactgaagtactgtttgccaccagacaccaacataatattgaacagcttatagacatgaaatgggatagatgaaatggagaaattgcaaaagagtcaatataatcgttgaatgaagaatttagagcacacctttcacccttcaccgcaagaattccagccataagatcgctatgtccagctataaatttggttgctgagtgcataacaatatctgcagaggaacaagagaattatagatgaaactctgttgtcctatggggatgcaaggatgcttgaaatggaaacctgttgttctagataagtaaatatacaattatatacctgctccaagttctagaggacgggagagcacaggagacatgatgctgttgtctactaaaacaagagcaccatggtaatgagctatctctgctattttctgtgaagcaacaaaaacagtggaaggaataagaatactaccttaaaaccaaggcgaaaaacatctggatgaaataaaaatctagatatacgcttcatgaccaccacatacatcgaccaaatcttacctttatatcagtaatttgtagacggggattggtgggactttcaagccatactagtttagtcaagggcccaattgcagaagttacctcactaattttggttgtatcaattcgtctgtcacaagaaaaaaaatcatataacgcttgtaagtgagaataaagaggcaacaacaaaatataatcttactaaaaatatggagataacactaactttactacaatcccatgtctcggggcaacttgtgagagcagacggtctgagccaccatatatgtcctctccagcaactatttcttgtcctgagaatcataggtttgacaaataattatattcacaaatgcatacaggattccatggcaagaacatgagaaatatggaacagcaaaaaacataacaataccagacttaaggaggtgtgttactgcagctagtgctgccatcccactggtgaagcagaatgcctgatccgccttctcaagcttagccataaggctgaatatgtcctcaaaatcatgaaacaatcaagaaatgcattttttttcaccacagagtaaaaaacggatgagaaattgacctaacctttggagaacatcacgtgtagggttaccacttctagtgtaatcataaggtccattatcggttgctgaaggctgcaaattaacttgcaggagtaagtgtacttggaaatagacaagacaaagtgcaaattatgaaccaccataaacttaaaaggtataatttagttcttcacaaccaaattgaattgcagatattcccacactttttatcattcttagctgcatgtcatgattcttgtataactagagaatagagatcattagatcaattaagaatcatttacattatcaagaaagataaaaaagaaagcaccacgttcattttggaggcccaaaaattaacacattaaacggagaaaaagaaaaatatttacactgttagatcatggtgggtccaaatcataacagtggagattgattgatataattgtattaagaacaattatatctatagaaagaaatagaattctatctttaaaatctattgtatataaagtacaatggtgtcaatagaaatagaagctaaaatttgcatattggatcctattttgcttctgaaatctagctctgcgcaatttgcgcgggaaaatccactagttcatgtgattatctatccaaacattcaatagttgcattacagtggtatgcttaaggacagccaggacaaaatggcacaataaacaaatcaagatgccgtaatttgataattacaacggactcaaagggtctaaaaaactacaaaatcagaaaaccaattttgtatggccagcattcgcacacatcaacaaataggtgcattgaactattcacatttccacgaaattggatttgtcttccaaaatagataagttcaaaacagttgcctgctgccaatttccccataactgcctgactgactatccatatccttctccaaacatttcaaaatgaaaactagaatcctaaaatgttgaatccttacacaccacctaatacgaatcatcagctattcagacattaccgcaactcttcgtctaatatattgacgtgcaatcctttttgcatgttcacgaaaaaaaaaagacattaccgcaacctcatcacaagcattaacatgcataccaagcaaccgtacagccaagcaatgcgattacaaaacagcaattgtaagtgtatcactacattgacagaacagttgcggaggtataatcctcactggctgccaccatttctatccctaattacctgcttaaacgtggccgtctggtacagcggcgtgctcatagacccgaacccatcgaacgagttctcgaagctcgtcagtatcgtcgccacgctaggctccttcatctccacatctacacccccaaaagcaatcaccactcatcagttccaccaaaaccacaacaaaaaccccaaatcccacaaaatccccccacaaacccaccgaaatccggagcggcgacggcgcccagcgcctccgcgccgaccgcggacgcgctcaggtcgccgccgccgtgggagtcggcgatcgccgccggcgcctccatgcggcgagagagcgtgaggcgtgggtggtagctgaggcggaggaggggttgcgctgagctgccgctaaggttccgggaggggttcggggtggggcggaggtggaagaggcggccgagagaggtggggattgcggcggcggcggcggcggcggcggcggcgctcatggttggcgatgtgtcggaagcgggagtggattttgtttggtatcactgtcatgtcgctgcttattttaaaatgatctggtaattaattcttttgtaaatctttaggatttgacatacaaaatacaatgcgggtaattagttacctgatttgtttttgcgcaacgatgaatcagcatttttaatgtatttaaaattctgattcatcatttctccaaataataatcttgactcatcatttcgccaaaaaaatcataattaattaatacagaattactgaggattgagggttcataataccgagcttgccggttaccccgggtgcagtaacggtgcccgggctgtaatctcaccaaatttaaacaaaatttcaaaaaaatgattttttttaatattttttattttgattttcatggtttgtcgttgttaccacggctaccttgtcctcggaaattatagatttataaaagcatgttctttttgaaattgtgtgattgaaaaacaatgatcagatatgtagatcgaaattcgaaaactgtattaatgttctcaatttctctcatcaaagagtaaaaagaaaaaaaaaacagggtatgtagtatttgcgggttaaccaattagtgcattcataaatatggtatatctggactagcacctacaatgcattatccatatgcaaagttctgtaggtagggattttttttggtatatttgccactgaatcgattaatgatcgtatctctatgatctgtgaatgcattgtatatttatgtgcatacaatttatttacccttttcaaattaggaggttgcttcataacttttgtttcttacagaacttattatttttcataaaatacaagtcggatacatacacaccatactcactgccaccatagtaaaaaaacggaccaaaggtcgccccgatctggtcatcggttcacatgttcatcggtcaaaccgccggttttttattttattaatattatatttgatttgcattattttaaatatagaatcatcacaaaatggtgaaaatatgcataaataaactagtatttctattattatatggccacaacataaaaaaacaaatgtagtgtggtaacataatagattcataatgctatattgttaggacaaattaaaaatcggttcgatttttaaaaaacctctaccagttcatcggttttaataaaaaccgcctggttcactgttttttacaggtttgattgcaggggcggtctttttgttgaaccgagccaccaaggtcgccggttccgattttcccggttcaactgccggcccagcccggtttttttactatgactgccacacatttccacatgagttgaggaccctaacaaacgaaaccatgcgcagttcgcttcatagcatatttgtatgtgcatagctagctgattttttagtaaaaacaacgtatttgtatgtacatagttgtgtaacatacttgtgtaggagtagtttgtatatttaaagtgtataaactttatggtatatttatttggcaatgctccggtgtgctactggtacagtagaaataatttgaatcgttcattattaatggtaatttggtactttattaatacaatgattatgaataactttatcatttatatttttgcacgactagatcgatccgtggtcattcattgcactaacattgctcatattccatcagaaaagctaaaaaaggaggaaaaagagcttcatctgctaaatgacgattatactgactgcaccttctttttataataatgatcttccacgtttctactatcgataactgcagggtctttgtaggaagggtgctaggccccacacctttccattcgttagagttttgattaatagatctaaaccattcacacaattttttgctgatagtgagacgccaaagctaaggatcacataatttgtgtatgatgcgtaaaaagtgcaaagcattagtataggatctcgtccagattcaatgaatgcattgaggaaggaaagttttcctttgtggtaactggtaagtgataacaatgtccagattgggatggaataaatccatattacaactgatgaaccgaagctctcatgttcaaaagtctaccgaaacttgaaataccttagtatatatgtagattgtaaaatcaaatgtgtttttgattattattctatgatgaacaattaggcattggagattattggttttgttatttggaatttattcacgaagtggttttagagatgattggatttacaggtgatcgcaggattctatcattttatgtgaccggtcagaccgggctctggtagccggtcagactggcggtgatcgagcggtcggaccggccagcccgcggtctggccggccgacactgtgtcggtttcggtttcgggttgtttatttggatatccgagtttatttcatgattatgacttctagatggatactatacgtatgtaatactatagtttgctgctaatgagtcaaattggagatagcttggtctcggaatatggtttctttgtttattccatgtgtaggtgactcgatgtctcgggagagtatttgcggtgatggaccgggagtcggcttggggataagacgacgtccgtggtggtcaaagatcatgcgggatacttaggcaagagttgatgcacgtgattgatggagattccatatggcatacgatggaattattgtgtgcgtatgggatgcggagttaaatttggaatgagtccaaatttggtacgattggttatgtaaagtttatttcttgtactagtgggtttcctaaggtgtttaggactcctagtatgagtttggttcgtggctttaggctgcctacctcatgtataaatagagggggagcgtgaggcttccctgtatcgctttagagagcaatagagttgagttttgagttagggtttcgagtttagtcaaaatttttgtaaggagtgctgttggtgcactttgtaaacacagagagaatcaataaagtcgtcatccactttaagagttcttcgatttgtgtttaccaggtttcggcggtctaaccggtgatctaccggcggtcagaccggcagcaaacggcggtcagaccggcgggagcacggcggtcagaccggcggcgacgacagcaagcggcaggcgatctcgacggttagaccggtagatcaacaccggtcagaccaacggctacgcttcggtcaaactggctaatctacgtcggtcagactgatctcatcgaaattgagggtaacttttatttccgctaaaagttttcggtttttgggtataccaaccattcactcctcctctggttggtttggttcttgtgattcgatcctacaagtggtatcagagctttgttttcttctttggatttttatcgatctagagtttttgccatggctactcccgctaggttttcaactaagcctcatgttttcgatggaacggatttttctcattggtgtagtaggatgcaatcttatattatggct

SEQ ID NO: 16176 - DNA, 5845 bp, Oryza sativa
ccacaaaatccccccacgaaacccaccgaaatccggaatgggagctggaattggagctgtgacaaacagatccttaaaaaactatattccaaatcaaaacatgtttaaacataccaagttccattaccccttctttctataaagttaaaacccaaagctgcctcctcaattcgccacatcatcaacattatattagctgttcgatcaatatgtaaatcagatttacaccattggatccctcatctttttgcccagcatgcatggtaatcaccttgctccttccctttcccctcccttaatcacatgcattaatttacagcagaaaccgccaaatcaattggaacatgaggtgcgatggttaatacgattcatgtgcctcttgcgattctcttccaaaccttttaataagccctttacaatccccactataaccaagtctcttcccctttgcatgaatcttttcatcatacgttcgattttatttggtaagcctgaatttaacagttattttgaccggattctatttgagtatacattatgattaatttgaaccaagcaggagcactatgaaagttttgtcaattggtttctctaaacttgaagaaagaatcactatcctatacatttactgttgtcttagtttcttaagaaaagattcatcatgcttgcagccaatacttatatgtcatatcactttaatttatttgaacaattaggaatgatacaaaggattgctatatagctgtcctgacatagcgagaagcagcttaacttgctcggtatgtattttgtttttaggttcaaacaatacaatctaattgttcatactaatatgcatatttacatatgttctcaaatgtgcccgcaacgaagctcggggtttcatctagttattagaaagctatattccaccgatccaacaccgttacgacaacaatctcattctgacatcttgacagtgtcgatgactcgtgtccctcttgcaaaagtctcgtagaagccacttaagtagtccttgatcttcatcttggcatactgcctcggcctcttctcatcgtccaccagctccggcgccggctccagctccttctccggatccagcgcgtagaacatcaccaccgacactcgctccctctcggcgttcgtcaccaccctatgcaccgggctctttaacaacccattgctcattatctgcatcccagaataggtgtctgttagtcatatctttttagataatggaaatgatttacatctccgacctctgctacttagtcggactaattccctaaaagatcaaatataatcagacgtgtaaatgatgatgtactcaaaattgaagctttacaggtctactttacgtgcaattcagattgttgttcagatctcccaaatctctgatccctccaaagatttcttcaggagaagataaaaggaatcatgatatactttaggaatcatggtagaatacttttggaacaccgtaatattttggtttgggttacatgggtgcagtatccttggataaacaaccactaacaagtactccctccgtttcacaatgtaagactttctagcattgcccacatacatatagatgttaatgaatctaaatacatacatatgtctagatatatgtgcgcaatgctagaaagttttacattgtgaaacggatggagtaaatgtatatatacctccattccatcccccatgttgatgagcagagcattggggacgacgggcacatcgtaccagacgccttgcctcagcacctgaagcccactgacggtgtcgtcgacggagacgacggtgatcaccgagccgtcggagtgtggcttcaggcccaacacatcctccggcctcaggcagcgagggtagtagttgaacctcgcgtacgtcgtggcgtcctcgtcgaacatgtcgacgaagtagccctctcgcaggccgagcagcctggccaatctggcgagcacaaggctggtgatctccctgcacctcatagtgtactcatgcagaacatctctgtataaaagaaacaggaaatttcagacaaatgtactggcagaacttgacagattttaagttcttaatcatgcgtgtagattgcagagtgaacaatggattaatcaaggttaggaagattcagtgcctgaaagaaggaggctgtgttggccagaggctatgggctatccgggactcaggctcaacgatgtggtagaaccggtcgcaccagttcaggatctgtttctctgacacgaccatgtcgttgccgtacccttcgatcctgaaatccttgccgttcaccaggttggagtacttctgcttctcttccagtgggagcttgtagaatcctcttgtcacattgatcatctcactgagaatgctcccctccattatagtaccaaataaccctgcaccttatagtaccataggtacccaaaaaaaaaaagtaatactcaatccgtttcagattataagtcattttgactttggttaaagaaaaacgtactccaaattaaactaaatttgtagaaaaaaatagtaatatattcaacacaagataactatattataaaaatatattcaattatagatttaatgaaaataatttgatgttataatattaccaaaattgtctataaatttaatcaaatttggaacagtttgactttaactaaagtcaaaataacttataatatgaaacgaatgcagtggtacttttatttaccaggaagaggccccagtcctctaaggcggagcgtaacttggcaagctcgccggcgctgtcttcaccattggaggcacacagccggctgaggtcgacgacagggatgggctcacgcatgtcggatccggcgatggcagggcggtctttctcgccgaccatgtactggctcggcggctcatggacgccggcggcgagctcctgcacaatcggcggtatcttgacaatgttccagtggtggccgtcagccatggttgtctgaacgcgcagtgcttctgttcagtcaggtgattcctagccagccggtttttatcttatttcggcattgttttgtggccatggatgatgacagagtgaaattggtcagggtttagtcaagatgaaagattttatgtaaacaagttggtaggtcagggatgtgggaagacatggtagtgccactcattagtcagagaggatcaaacacacggtccttgtcatgatagacacaggaacggacccatcgaataagcgaaacggtatatttgcaaacgaatagtaatttgtgaataaaacttttatatatgtatttttaacaatctaaaataaaagcaaaggttgaaaaataaacttcaataaaaaacctcaaaatcaactccaatttaagattgaaaaatttaaaatttggctaataagcataagcataagcataagaaaaagacactccggcagtaatatggtatgggtcgttgagctttacatcactgtcaaatgtttgtctgccgagcccattggccttgttcggcagccagttttgctgcagctgctgtggctgcagcagttgaaaatcgctgtagcgtgctgcgtgcagccgtagctgctgccaaaaaatctctttcgaacacacccattataaaaatctctttcgaacacacccattatcagcggggagattttgcagagacatgcaacaattactcccccctcccaattttattttacttactacctccgtcctaaattagtagtcgctttaacttttttttttgcaacgtttgactattcgtcttatttgaaaaattagtgcaaatgtaaaacatgataagtcattaaagtacttttgataataaagcaagtcacaaacaaaataaataataattccataatttttttgaataagacgaatgatcaaacattacaacaaaaactcaaagctaaactaggaatcacggcaaaatacattgctaccctcattatttacattctaattatctttcttaaagcaagcattaaaattttcttgtgagagtactggtactaatatggctatatcgataaaagtaggaaaaaaaacatatccaatgtagttaatagtgtaattacattacaattatacaataattacaatataataacactataatattaataatgtctaattacaataccattaataatattatagttacatttgaaagttttttgttaaaaaaaacttgcgacatgcttttagcaattccctcaaggaaaaaaacatatttattttcccaggaatacttgctactgaaagctgctgagcttgcaacaatcatgctactagtacaaatcagatcttcagggagtcgatgtatctctctcgtcgagagaattttccaatgatcccagccctgaactctccgacgctcactttcctgtatcttgcaggccgattctcatccagcaaaccagccgccggcccaatatctttctcatcattcacactgtaaaacatggccagtgagatcctctccctctcggcgtttgtcaccaccctgtgcactgggctcctgaagatgccattgcacaatacctgcacataaattttgcatccaaatatgcatcaggattcagaaacctgggtttatcatcatattacagatgtctctgcagattcagagagaaagtgttttggatgctagatgccaattacctccatggtgtcacctaagttgatcagcaatgtgttgggagtgacctgaacattgtaccacttgccatccctctgaatttgcaggccaccgacatcttcgtcgacgagaagaatcgtaaagagggagccgtcggagtgaggcctgacgccgaacacaaggtcaggccttggacagggagggtagtagttgaatcttgcaagtgcaggagctttgttgagtcggtcgaagaagtaatcctcatcaagcccaagaagcttggacatagcctgaacgatatcgtctcttattcttttggttcttgatgcgtactcgttcagaacatccctgcagaagaaaaggctctctaatagctcagtaaaaccatttctcgatacatcgtcaagttattctttctgaattcagacaacaattcttgttactttgttagtaatacatgaacaataaaaacaccatcttttgcaccaaaaaaaaagagtaggaagaaattcagacgtgtgtaaactggaaagtaaaacatcgatcactgtaaggtgagtaggtgacctgaaagattcaggatggtcaggccagaaggcaagatttcgctcctccttgggttcaactctgagaaacagccgatcagaccagtccaggatctgatcttgggttaccacccggtcagttccatacccttccacctggaagttcttgccgtcgatcaagttgctgaattttcgcttccgttcgatcggttggttgaagaactctcttgccaagttcaacacatcatccatcagagaggtttctactccatggttggtaagctggatcacacacagccaggaaaattggagaaattgatacaaagtagcaagttttttattaagcaaagtaggatcactgcgttagtagctgaccaggaagaagccccaattctgcagagccgccctgagcttggcagcctcgtcggcgccggctagccggctgagatcaacgacggggatgggctccggcagctcggcggcgaccagctcgtcagaacggtctttctccccaagcacgtaccgactcggtggctcctcgacgccggccgccgccagctcttgcactatcgccggcgtcctccatgcctcgtcagccattagtgttcttgttcttggatctttctttgcttaattttcttcatgcctgaaaa

SEQ ID NO: 16177 - DNA, 2356 bp, Oryza sativa
aaagaaaaaggagatctttcaagtcatttatagcctgttaatatgttgaattggatatacttggatgagaatggattgacaaattaggcacgtgaatggaatctgcttctcagctactattcaacagtagaagaaaggatgcacaatgtacatggtggaaataaaagacacgttgtagataagatgtagatgtagattgagctgaataaagggataggtattcaaactgtttgacatcgtggaatcgagcacaagaaagggaaccttcaaattcattttttgaaattaaaccgaaggtattcaaactgtttaacattgtggaattgggcagaagaagggactggtattttaagtagtttgacattgtggaagtgagctagtcctgactcctgagttctgaatgcctgaatgggggaaaacaagttccattgcttaccttttcttatctccttctagatatttcaactggtgtaatatggtgacacaagatctgcaccagatcaactatctctcggtttctatcaatggttagtaacaggagtagtaacctggagagagctgctattctgctcgaaatcaacacaaagtcaattagtcactcatatcaatagacagaacacaattcctatcgaacaaaagaagatcaaacataataaaagaagataaagatgtattattttctaaaagaaaaaaaaaagatcaagatgtgtagatcaagggaaaaattgaaaaactctgaagctgtcaaatgattatgcttgccttttagatggtccaactgaagtactagaattcacaaggctcagctaaatgattcttgccttcactttcttgctgccttgcaaagtggtggatgcttctcaaatatcaagtactagcagtcttgtgtctggctcagtttctttccaaggatctagaaacaagcaaagaaaaaaagttagttgattagtcacaacccataacactgaccaactgtacttcaatgagttatcttccacaaggttagaattttaacctagcatgcagagctcatcaaactgtttggagtagtacaagtacaaaactcatcattcatcctcagcaaacacaaaatgaaacctcacaataatatttttcttttctgataaacgctacagatctggatggcataattacatgagtatgcgaccatgtgactcatactctacaatagttctttttttctgataaactttacagagtacatatcacaatcactatttattttaactggcatagtgactcagatcttcactgtgtcaatcactcttgtcccttgcaagaaatgttcaaagagccctgcaaggtagtccataatcttcaccctcttgtatcttgccgggtgcctttcatcgatcagctcaagtgctggctcaatctctttctcaagattcataaaataaaacaacaccactgatattctctccttttcaggatttgtcataaccctatgcaccgagctcttaaaaatcccattgctcattatctgtacaaaaaagaatgtgtagttcagtgaatcaagaacttggagatgcatcatggcacaacttgaacatactggtagagacaagctcacagtaagtttttttttttgccgggaaggccgaaggaggccaaccgagtatattaagaaggaataaaagttacaagagaaaaaacatcaaaatgcaccaaggtgcattgccacacaccacacactaccacccaagcacaaaccgctgagggtgaaacctagcaccaaacgacccccgctaaatgtggccgaacgccgctaggcctacggcaacaccacagagacgaggctccgaaaacgatgccaccatggtggtcacgacatccaggatgccgccatcgcccatctaaaaagatgtggttttcacccagagaagctcgccaagaaagggagagggtaaccctcgacaacgctccaaggaaattacgacgcccgaagacgtagccgctgtcggcccggtgaaccaccggactaggctttcgcttgggaccctacaaccttgactgcagatcgccgtccaccaactcagaaccaccacacagacaatatggcagcacgtggcatccaccacaccggaccgacgcccttccatcggccgacttcaacgaaccaccacccttgagagctggcccaggactcctccgttccaccacccgccggccgcctcgccagatttggccgaaggagaacccgggactaggtggcattgcttcggcagcctgagcttcccccactgacaagctaccgcctcaatccaaactataaacttcccgcaaagaaagggaggagctccatgaaggccgagggtgccgaccggcaacgagg

SEQ ID NO: 16178 - DNA, 731 bp, Oryza sativa
ggataagtttgaggcacgctctactgatggattgtttcttggttaccccgcacatactagtggctatcgtgtacttattttggggactaacaaaatcgtggagacttgtgaagtttcttttaatgaggctagttcaggtactagacccgaaattgcaggtacactgtcacaggttcagggggaggatggtcgtatttttgaagacgagagcgactacgacgacgacgacgaggtcggctcggccggtcagaccgggcgccaggccggtcagaccgccggcacacctccggtcagaccggcccatgaggagcggtcagaccggccagggtcgtcgggttcgggtactgttgatgctgatcgtgatggtcctccggaaattactacttcgaccagtactgatacagaacgtggatcaacttcagaagtcgctgctcctttgcacattcaacgacgacatccgccggaacaaattatttgtaatataggtgagcggactacaaggtctaggtaacaactcatgatgtttgtgcaaattctgcatttgttgctttttttgaactcaaagatgtgtcacatgcattaactgatgaatcgtggattaacgccatgcatgaagaacttgagaattttgagagaaacaaagtttgaactttaattgaaccaccttctggacataatattattggaaccaagtgggttctcaaaaataaacaaaatgagtatggtttgat

SEQ ID NO: 16179 - DNA, 2180 bp, Oryza sativa
aaagagcttcgtcgagatctttttaaaaaggagtacattaaatttgagatgaaacctgaagaagctttggatgactatctttctaggtttaataaaattttaagtgatcttagatctgttgattcttcttatgatgctaattatccacaatttgagatttctcgtcactttttgaatggtctcgacatgtctatttgggagatgaaagttacatctattcaggagtctgttaacatgtctactttgactttggattcactttatactaaattgaaaacacatgagatgaatgttctttctcgcaaagttgattctaaatcaagtgctttggtttcttcttcttcttctttggatgttgatgcttcttcatctaagtcgtcttttcttgctgtttttaatgccacatccgatgatcaactcgaacaaatcgaggaggaggatttggctttggttgctaaccgtattgctcgagctatgaataatgccaggaacaggaaaagaggtggttcaaatcgttgctttgaatatggttcaattgatcatcttcgttcgcattgtcctaagcttgggagaggcaaaagagaagacaaagatggtgagaagaccaacaaacaacaagcccaacaacaacaagtcgaagggttctatccaagggaggaagacggagaatcttaggaaggcttttcaacaagtttgcgccgccttcgagccactaagtgatgtagatggtgaaagtggagatgatgacaagggaaagaacgtctccgatatttgcttcatggcgcgtggtgaatctgacacagagtatgaagataatgaggtgagtgcttttgaggaagctattaatattctgagtgcaaaaaataaaaagtgtgagaagatgtataaaaaacaagaatttatcattgaatctcttaaatctgaaattgataggttaaaatcttttattcctaatgatgatgattgtgaaaattgtgaggttttaatgaatgagatttcaaaaattagagatgttaatgttgcacatgatttgaaaaataaatcttctcttgcttgtagttttgctttgcacacacgcactttggatgagttgtttttaaccaaaaagttgttgcaaaaatatcaaattgcttttcatgctagtttgatgtttagcatgatttctgctaaaaagttaaaacaacctcatgatgttttggattgctcaacgtgtaatttgaataagatgaaactaaaagatgctttaggtcgtgttgagtacatggaagatgttgtgaaaaacaatgaagtgctttcttgccctaaatgtcgtaaaagcaaaggtgtcatggtagattgtgaaaattgtgctaatttggaaaaaaatggtttcttatttgaaaaattctttgctaagattttctgatggtaaaaagaacctcaacatgattttggatcaatcaaaggttagcacacataaccatggtttaggttttaatccttatgctcataattctagacatcctcctgttgtgttatgtgttggtgctagaagtggtgagattttaattaaacatgataataataaaattgtgtttaaatctgctggtatcatgtctactatgaatgcatcttcttcaaaatataatgttgtgcatgcaaaacctcatgtttctaattgtgttgctaaatcttctaattctaacaatgtgtctaaacaacgtgaaaaatatatttgttctttttgtggaaaagatggacatattggtttttgtttcagattagctcatgaacagaaaaaggagagagagattgcttttgcaaaatcaaagtggcaaaaatcgggatttccctcgaggaaaccggtcagaccgcagtgggtcccgcagtcagaccggcgaccggtcagaccggctgaacagcctcggtcagaccggcagtacaggagcggtcagaccggcccccagtcagaccggccactgtacctcggtcagaccggcctcggaggaatttttctaaaaattcaaaattgattttgcacgtggatatatgcctattggatcttctggtcgtgtgtctcagtactggattcctaaatttttattatcatctaacctcagtactgaggcttcgacttctgcttgtgtgtaggctttggtggcaaggaaggagaacgtgtggatcgtggattccggttgttc

SEQ ID NO: 16180 - DNA, 707 bp, Oryza sativa
gggtgtgtttagtacacgctaaaatgggaagtttggttgaaattgaaacgatgtgatgcaaaagttaaaagtttacatgtgtaggaaagttttgatgtgatgaaaaaattagaagtttgaagaaaaagtttggattttaacaagggctttattttgataggagtgattttcaggatttacaggaggtaccatattttttttccgtgaaattttaccatccttaaaaagtacccatgttttttagtgtaaaatttggtacctctatatactaagtagcttgatgtataaaaaaatttagtatgaaatttaggtacctcgaggtatttttttaaggaccataaaatttctctattttttaatataaaatttgatacctcttaatatctctgatggtaagacataccaaatttgcaccaaaaattttggtatctctcgatatgtctcaagtattgttgaatttgtgttttgatagataatcatcagatcaaattttgttgttgaatgatgatgatactctttcttgttgcagtgttaattagagttattcaagacgcaaatgaaggtgatgagggcggaattaaattcgatgactccatgtacagatcgattcaaattggaggatagcaaagaatttgcatgaatttgatatggtcttgcgccaatgcatgaatgcagatataagccccctgcttggtacactgaaactg

SEQ ID NO: 16181 - DNA, 625 bp, Oryza sativa
tgaccaaagtaaaaaagactaataatcagttttattttgaccaaagtaaaaacgacttataatctgtaaaagatcatagaaggactaggttttgctttgtgtgatttgatttgcttatgttttttgtgttactttcctaccaatacacatttgtggttttccatcttagaattatgtccccaatcgccttaacaacaagggctgtttgttacaaggtccctatcttgtccactccaagaactgcatgccccaactgaaaaaactatgatttctcccaaccacccccatgacaccagaatttctgttctgttatgcttcatgctgctgttaataggatttacaatccggtggaaaccggaccaaatttcgtaaaatacagacttttcggatcgggttgaaaccatagacactcgatttgatggtcatgtttatttttgcgaacgagtaaaagaattgcacgtcaatatattagagggaaaagagtttttgttacacaatgcaatcaggcagagcggcttataccgagggaaggaataaaaagcaaaacaaaaattgttgctaagaagaaaaaaatacggtggctatacacaactccgattggaggaaggggcaaaaccacagtaca

SEQ ID NO: 16182 - DNA, 1121 bp, Oryza sativa
acttcattcataatttgttttttttggctgtgtttagttccttccaaagttggaagtttgggttaaaattggtacgatgtgactgaaaagttgtgtgtgtatgacaggttgatgtgatggaaaaagttggaagtttggatccaaagtttgtatctaaacacagcctttgtttcggagtaagatttcattcactcagaatttgagagtgtatagtatactctctcacagcattttttggccgcatatgcgccgtcgtcatatccttccttggtggcggcggctggcggccaagttgctcctccacgcggcggcggcgccgccgccctttcctcttgtcccgccgtttgcggtttgtcatgcgtgatctcaggagcgtacacctgccggatatagtggccggcggcgaggtctcgccggagcactcctcccttgagtgtctcaagaatctgcaatgccttgctgatgtacgaacaggatattgttcccatctcaaatctggcatgtagcagccaaatcttggtatgatcacggcaacatcgtcaaggaaattcccaatatctattcttcgtggtttgccatagactttttcataaagtttctactatgttggcatggcctctgtgtcccaaaataagatttttttttaaacgacccacacaagtatagatggtaataaggcccgagagccaacagttgagccgtgtctggaccgatgccttggtacggtgggccgtcccggcacggcacggttaatggaaaatagtagagggactaaatagacttaatgcagccatataagcaaaggtaagccccaaagaagaggaatacaaaatagacttgctccagccatataagacacacccaaagagttcagggacgaaaaatagacttattattatatggagaagtgtgattggttgtcatgccttattagtcacacacaataaatttatatactccatcgatatacttcataaatttaactgtcaactaacgaaagagatataaaagaaaggatataaactgaaatttaggggtatgaatgaaaataagtaaatctcaggatataaaagggattggacaaaatttagggttacgcaggaaattttctcttattctta

SEQ ID NO: 16183 - DNA, 15350 bp, Oryza sativa
  unsure (1)..(15350): unsure at all n locations
tactcccatattttatatgtgaatttccttcacgtagttctttattttcaattcactcctatataattaacttaatgttattttatgaaaagttacttcttttcaaactaagttacttccataatttaaataaattactttcaagtatttgaatatatttaatgttgtacattttgtcatatattttaagaagagtatgatggtttaaacggaatttaaaaataatgcatggtttaaaatatatagactgcaaaaggtttggtattaagaaaaaaatagattagtgttggccctcagtaccaaccatttaccttatttggtacttcctccgtcctataatataagagattttaagtttttgtttgcattgtttaaccactcgtcttattcaaattttttttttggaattattatttattttttgtgacttactttattatccaaagtactttaagtacaacttttcgttttttatatttgcataaattttttgaataagacgagtggtcaaacagtacaagcaaaaactcaaaatcccttatattatgggatggagggagtatataactagccattggcttatttggtatatagctagctagagaaatatttagacaacacactacccattactgtgcacggatgataaaaacgttcgaatcggaaaaaggacaccagggtcacgctgtaagtctaaacagtgcacgtgtacttagggcatctttagcttccaaggataaaggtagatgaacagccatttgatcccccatcaaaatccgcattgaaacctttacacactaatgggtgtaaacaaatagtacgcccctctactaaagtgggttggaaagcctgtatggctaatctatgcagggtcaaagctatttgatgtctgactcaggcctatatgaccgatcgatcgaaatactctaagactccacctttgtcatatattccatatatcacattagatagatatcatattctagccaatatttctctcgtgcctttccgcgttcatggttcgatattctggtgtccagaatttttgaggagccggacgacgaagnnnnnnnnnnnnnnnnnnnnnnnnnnnnnnnnnnnnnnnnnctgctccggaaatacccagtgggagcccataccggccttttggggcgtatgtcctgtgctctccggatggtgcggcgtgtgtcgacaatccaacagcagcggttcagatgctatatgcaacatttgctgcaaggcgtgctccagagacaggcgcggtgccacctgaggctgcacactcctgctacggtgacctcgtgctgagcatgccgcaccacttgctgctcaagaggcgccttggtgccacagtcaccgcacctgccgcgtccaactacgacgtcggcatctccattgcactggaggcatcaggtatcaccggtgaagctacagaggcagcaccggcacggcagtggctgaagacgtcgaagcgcgtgggccggagcccgagcctgaactgtgcgagcctcgcaacgcggttgggacggatcacgccgtgccgagcgcagatcgagtggtacaaggcattgttcgatgccaacaccgggtattacgacgcattcaagcagcggctatcacctaagaagttcagcaaggccaacatgtaccgcatcaagctcgcacagttctgggatggcgtcctctccatgcttgacaccagccagctcccctacgacttccaccgccgtgccaagtgggtcaacgctgcccacttctaccagctccttgttgagccacttgacattgccgactaccaccgaaacaacctacaccgcacacgcggctcttacatcacccatggccgggagagaaggtagaagcagtagcacaaaaccacattgttcattctagataattcatggactccattaggcttatgcactacctgtactctataggtatgagctgttcgacaagtggtggaaacagaagggctgcacagatcccagcactggtgacacctctgccaccacgacagcgaggaggagcaagttcgctgggctaacgcaggacccgtgcttctgggcgagggtggaggaagcgcgcgagcagacagagagtgccaagagcgaacgcgacatgacatcgctggcgaggatgctggaggacttgcacaagtttgagcgccattccagcgagctggtggagaacaaggaggtctccattgatgtcgttgcgccacagtcgagctactccctgtgggtgaaggagtggaatgagctcaagctccgggaagaagttaggacaatattgtttcaattttgaagttgaaacaccttaagaaaatttaattaattaattaattagttagtttgttgagcatttgtcatctagtttaggcacagatgaatgaatgttagcaacataatataggtgattgtaaatagatttagtcctggtagaggcattgcattatgatgtatctgttcttcatgttgaaatttgcaataacttgaagctgattcacttcacttctgtcaagaatttgcttcaaccaaatctgtatgactctgcatgttttacctttatggatatcaccaaatgtacatagtttgatgacagacttgttgaaaggatcttgtaggcttgctgacttctgaccaagaaaattgtgtgtggagttggattcttctctcttcaggttgagctactggtgtggtaactagtacgagtgtatgaccaagaaaatatctgtttccctgatttgatccccaactctgtcaagagtttgtaatttacattctgaatttcaaaaccgtctgaagcttcccagtctgaactcccgaaactgatcaaaccccagcttctgaaactgtggctactctttcagacgcatgtacaatttcagcccaggagtcgcaatctataagtaattttgtttttccttttgcgaatttggtgcatgtaaaaattcaattacgcagcagaagtttgtgaatttctcaccaacagttcaaagttcatcattacttcattcataatttgttttttttggctgtgtttagttccttccaaagttggaagtttgggttaaaattggtacgatgtgactgaaaagttgtgtgtgtatgacaggttgatgtgatggaaaaagttggaagtttggatccaaagtttgtatctaaacacagcctttgtttcggagtaagatttcattcactcagaatttgagagtgtatagtatactctctcacagcattttttggccgcatatgcgccgtcgtcatatccttccttggtggcggcggctggcggccaagttgctcctccacgcggcgggggcgccgccgccctttcctcttgtcccgccgtttgcggtttgtcatgcgtgatctcaggagcgtacacctgccggatatagtggccggcggcgaggtctcgccggagcactcctcccttgagtgtctcaagaatctgcaatgccttgctgatgtacgaacaggatattgttcccatctcaaatctggcatgtagcagccaaatcttggtatgatcacggcaacatcgtcaaggaaattcccaatatctattcttcgtggtttgccatagactttttcataaagtttctactatgttggcatggcttctgtgtcccaaaataagatttttttttaaacgacccacacaagtatagatggtaataaggcccgagagccaacagttgagccgtgtctggaccgatgccttggtacggtgggccgtcccggcacggcacggttaatggaaaatagtagagggactaaatagacttaatgcagccatataagcaaaggtaagccccaaagaagaggaatacaaaatagacttgctccagccatataagacacacccaaagagttcagggacgaaaaatagacttattattatatggagaagtgtgattggttgtcatgccttattagtcacacacaataaatttatatactccatcgatatacttcataaatttaactgtcaactaacgaaagagatataaaagaaaggatataaactgaaatttaggggtatgaatgaaaataagtaaatctcaggatataaaagggattggacaaaatttagggttacgcaggaaattttctcttattcttaacgcagttcaccggcatatggcaacaattttatcacattaattgtttctggctagctagctagttagagtgtgcgactttggtcgatcttgtggttaattattaggctcaaggaaatttctagtacttcgacacgtggtcgtgccgcgccattgacccatgagccgcgcgcctgtctatctccgcaactaagatacgaatcatatctatagtttttatcggtactttaataagttatctgtatatgagtcgggttttaagttcgtttgcttttagaaatacagattcgtatctgagtcaagttataagttcgttcgcttttgaaaatatagaagaagtcatataaaattttttttttaaaaaaactcgcatgctaatctgagatgattgggctcctaattgcaactcataattttctagaaaaatatatatccaagcgaattctcagagtaatttttatcttaactaaaccatataacaataataaaattaaaatagccttcacccgttgtaatgtatgggtattttttttaagtatacatgtagtttgaactaggaggatcggcgggaagttatggcttaagctttagacctaggatccaaacttcatacaaattatgtataaatttaagaaaaaaaatgcttgaaattatatagaaataaggcgaaatgaagaactcaagctctaggtatggctccaagctgattttgtcacttgttagaagttgtttctctctctcttttttaggagggagtaggtgcgatagtggataaacgtaccccatgcttgcaagctacattttttaattttttgagaagggtatttttaacccgatatctatctccaacaggatatatgtagcttttttaaattaagaatgtagcccatcaaataacccaatctaaaattcgcttgtatgaagatttaaattcaggatcttagagcatctccaacagccgctccaaattggactctccaaacacccatatagccaactctccatttgatttggctagtcaaactagatagtcactctaacagactctctattaatcatctctaaaataacaacggacccacatgtcatcctctactcctcttcttcctctctctctctcccccttcttcctctctctccccattcttttcccctttatttccttcaaagccgacgccgcagagaagctcgctgccaatttccgccgcatcctcaccaacctcgcctccgccgcgtcctcctcggccttcaccgagctcctgctacacttgccgtagagggggagatccagcaggcggcgccggagctcctgttcctcaccggatcggggcggctcgagctcaacctcgcgcgggcccacgcggcatcggacgcgagcggtcaagccctcgccgtcgcgctgctgagccggtccaagcccctcgccgccgcatcgccggagggtacctctccatcggcgctgccgaggggctgcagtggcgaaggacgacgacgacggaggggtggcgccggcaaaggacgacggcggaggggtggcgccggcaaaggacgacgacggcagagggacggcgctggcggaggggcgacgcggaggagtggcgccggcggagaggtcgatttgggggagagagagtacaggacgggagagggaaaagcgtgggaccatgcgtggggcccacaattggctaggctattttggctggccaaatttggccagcgcgaggagcactttggctagccagatggcttggccatccggttagccagtttgttggagcacaaaattgagttaaaattgccaaaatttaacttgaagagtgggataaggaggttgttggagatgctcttggggtgctactcggatcagtacaaccattagctatatgcccttccactctactttaattacactttgcaggaccggtcgagtgacgactgatcatgataacatgcattgcatgcgtgcccttttgatttttgcagagagagaattaatgggaagagatgatcgaatcctaccactagcgtgaataccgatcgacgcctaccactggccatggttgctactagtagcaacacacgattagaaaatgaccaactaattatgaaccactaattgtctcacatatacccactgctgatcatatccatcgatggtacgtgatgttgccggccggcccggccggccggcagttagtaggtggatatgttcgcgtaatcacatcatctcaggcttcttagtttcttcctgaagcctcttgatgatcaattaattgcaaagagaatttgcagtgtccatgaccaaagagaccggccacgagcccaggatgcatggacgcctgttcgttctttttctctctttcttttcgattgccctgtcgctatataattattgatcacttttgtttttagtgatcacttttgtttttagtgctgaaattaataattgacccattatatatttcacaaattttctctgctaatagcctagtatagttaatgtaggacttttatcatttatcatgtaatggagcattttttttatataatgctgtctcaactatttgcagtagattaattacttctttttctactgatagtataactataaatcaaccgttgcgattacttctactgatgattaattaccgtttttccaatttggactttggaatgaatcaacatatttgtctcagggaaatatatgcacttaaaaatgataactgtagatttttgctttgggaaatatatacttccatagggcaatagtattaccattcttcaaattaagctgcattttggtacacgtccaaaaaacgaacatcgttaatttatttgtggacaaaagagttactagatgccaattaatcttttgaacacttcaattttagtcaaacttaggtagatatagagatgaggttctaacttgtaagctatgtggcgaatcgatcgatcgtactgaaaagaacaataagtactccctccgtcccaaaaaaagacaaaccatggtttccgtgcccaacgtttgaccgtccgtcttatttgaaaaaaaattatgaaaaaaaattaaaaagacaagtcacgcataaaatattaattatgttttatcatctagcaacaataaaaatacgaattataaaaaaatttcatataagacggacaatcaaagttggacacggaaacccatggtttgcctttttttggacggagggagtacgtggtatagctagctagctagtggggtggtctaacacctatgattaaaagaacctcacaaagcttcattttttgccagctttttatgggcaatgttatcaggctagcatatatgctacatttgacgagttgccacgtcgatacatatgctctcttagctttatactccctccgtttctaaatatttgataccgttgactttttagcacatgtttgaccgttcgtcttattaaaaacttttgcgaaatacgtaaaactatatatatacatataagtatatttaacaatgaatcaaatgataggaaaagaattaataattacttaatttttttgaataaaatgaacggtcaaacatatttaaaaaaatcaacggcgttaaatatttagtaattaacggaggtagtatatagcgagaagatatttgcatacgtacgatcatatctgtagttaaccggtatatcattggagcttcacaattgcttttttttttcctcgctacacctttcatcacttctatgacgtacccaacttgtcataaacattcggcttaatttcacacaaattcctcaattgcttaacttttctgaaaccaaaccggcagaagaactagcaattatatatatttcaataagcatgagtaaaaaccctagacagaaaggaaattagaaaaaaaaaacttcatcctatgaaaattttgagttggattaataattcttttgtgtatgaaatttcttaagtgagaaaaatccttcaatatacaacccacactttatctggattgttcaacttcattccaatttgaaaattttcttaattcaactcaacggaaaaaagaattccaactcaaaatttggtaacatcttaagcaagaatgcacactctatgaaaactgcccagtagatagtacacagttgaacaaattggaattttgcgagcaacatctacactgtacttggctagcttggaaagttcatatgccgtatatatacctgcccaagtttgattggtgaattagacggcgatattagttgtggtatatatgcctaagtcactatatacggcgtgcacgaacagtagtctacggtgagaaggatggccacttagaaaaattcctcacttaattttcggtttatttgatttgcgtacttaaattttctaccacgaagaaatttaaagcatcttgggataaaggggcattgtcgtatgttagcatgtatattattacgcacatgtacagctgtggcatccaaataattcagttaattttctaggtgctcgatctattaatttgacatggctgtagaagcacatattatttccatagttaactgaaaaatttggatttactaatttgttattgttgctgctagaaccttttatattatattgtagaatttcaaaccatatgttagttgttaaatcgaaattctcctgaagtatgatatttatatactccctctgttctagatataaatgtcattgttttacacacgcaaaatcaacatttcaaaattctagctaataattgatcgaactaaataatatatgtatcatgcatatattcgtatttaaaaaactttttattgctattgattttctagtttctgataatatatattatgatatcagaaactagtgtattatttttctcacaacctccaacgtttatatatattatgaaatatatattgctattgatttattgctatttattttctagttttttatacactagttctatattttagaaaggaggggtatctagctacaactgaccagagcaaacatcgattagatagattcttacgcaatacaagtacacaacacaacacaacacaatacaacaaactacaatctctttcagagaaaaaatctcgaaagaggcgagagttttgggcatatatatccggaccaaagacgagatgaagcatatatacctaacattttcccatgaatgcgatgtatatatgatgccggaacgcttcttccatttcaatttgtttggccttgttcttggtcgatatgccgaccatgcatgctactgtagatcaatttggccaagatacacatataagacaatggagataatgcgtacgcgtgcacattattgtgaccaaggttaaccgtctgatcattgacttcaactagtgaagtgaagtgctctcgagaggatataccctcattttttcgttttatctaaatagttatgatttttttaaaaaaataataagatgaaataatatatcatacatcatttcacaaacatgcatggtaaaatttaagttttacaagttgtaaaataaaataaacaaatatgaatatgaatatatatgtatataagctaaagtctattatttactttgttaccacttgtattggtcaaatttgagtttatatgtttgtagaggatatatcatatactaattttttattgtcaactttttctcataactcttttggatgatacgcaagaaaatgaggatatatatccctgtcaagagtttatattccctaaatttctgcgtgtgcacttgagtcggtgatatctccttctcatttagtgtgggcaagcgcattgttttcctttttagcattcggctgagtattttactcatgttttattaataaataggacaaaaatcccgttagcttttcttttataaaaaaaaggctagagataaaccccaaaaaaaaccagagaggaaaatagaatatttttcataaggaataaatcggatgtgacaaggtttcaggagggcatattttgtgtgtgcctcttaggctgggtttagttcccaactttttcttcaaacttccaacttttctatcacatcaaaatttttctacacacataaacttttaactctttttttcaaacttttaattttggcgtgtaactaaacatacccttaaacgtttatttaggtacctctttaaacagttttggacatgtatcaatgcatcttttacttctggtagttgaagacttgaattggcatcaacaaccaaaaaaacaatgtgtacgttgttgataaatcatgcacaaagctggggaacgaaatgggtctgaccgtctgagaccaaacataccatgtgccggaggcagaggatgcattgaaaatacagggcttccattaaatcatattgaaagttcagcatggtgtcaggtctatgctatgaatgagaatgcagatagttcaggccaaacagatcccggctacccaaaaatttttcaccctgtgactaatttgtgagataaatcttttaagcctaattgctccatgatttaacaatgtggtgttacagtaaatatttgctaatgatagattaattagatgtaataaattcatctcgcggtttaccgacggattctgtaattagttttttttattagtgcctaaatacccccatacgacaccttatataatacccgatatgacacaccaaaactttacaccctggatgtaaacaccccgtcggtatgtggcaacaagagcttctccctttacaacatggaatgtctcattccatcttgtcctaaattaattagcatgcaaaaaaagcatgaggaaaacaagtcttgcccttctatattcttttccccacaacatacatagctctcgcaagattggcaattcttatccaaatatctatgtttgtaacagtagttggagccaatggtgacatcaaggccagacaggaaaaatcttttattagctaccaataattttttgtagtggtttttagcggataaccatgtcgcatgtcaacattgttgaagagccacctgaccttgtctgtccaagaggtggctccgttgcttcattatagtgtgtttcagcaaatggcaccctattaagcatgaacctcataagtcataagatcaatacaattttacttctttactgtcaatgttttaccattcatctaattcaaaaaattaataatatgctaaagtataagtactgaaagttcctttgattataaaagatggcacatcaaataaatatatatatatatatatatatatatatatattaaatacaacgaatagtttaacgctatgttaaaagttagcggcatcatctatttaacaaacaaaaagagtatatccttccacatcatctctaaatccatccaaaaaaatgtgaccattaatcctaatctaacacacaggggcgaaggtacagtcaattaccggggtcagtagaccccgatgattttattttaacctctcatatcctctttattttaccagctatgaccccggtgaaaacaaatattagaccccggtgacattaattgttgattgttgtgttaaattccaattgacaactagaaacgatactggcagcagcaaatagaaaattacctagcatttatgattatacgtcagccgaatatgcatatactttgagtttttgagatttgagaccatgcataaggccagtggctcataacttttcaaattccctagcaaaataatttctataggaaattattttaaaaaccatattaatctattgtctttcaagttttttataagctaataatgcttaattaatcatgtggtaacctcgccctattttgcgtgctgggagggaagggttcagatcccatagctaggtctgaacacacccagattgtatcagggttcaccaattcgatttaaaattagattccaaatatagcaatatggctttttttttaccaaaatttgatatttttttattaatttggtttaattttacaatttcaaatttgaattcttgaaaaactattccaaatttcactcaaaatctacttttgtcccaagttggaacatcgaaattgcgttgttttcaatccgttttgtttgaaaacatagaccatggctagtaatgaccccgacgatcatttatcctggcttcgcccctgctaacacaccaaaagattatctgagaagaagaaaaaaaggcacacaaaaggacatgtggtggctatgatcccaggatgcccaggtgcactgccatttgccaccggcctcagtggcagtggcagtgtcagttcatgttggaaaagcaaagctgtccacgcgtggcgcgccatggcgggaggaggaagacgaagacgaagcagccgcaaccctacacgcctctctcacctctcctctcctctcctctctctctatatatagctctcgtcttcttccacctctcactcactcaacccaagcaacgcgcagcacaccatcaccagccaagtgttcgacagagttcttggcgagctagaggtgtcgaacaccttcaagagaggagggatggggaaggcggcggcgatggaggtgtcggcgtcggcggcggcggaggcggggatgatggtgggtcatggggagtggcgcgacgacgacgggcgggcgcggcggatggggacggtgtggacggcgagcgcgcacatcatcacggcggtgatcggctccggcgtgctgtcgctggcgtgggcgatcgcgcagctcggctgggtggccggccccgccgtcatgctgctcttcgccttcgtcatctactacacctccacgctgctcgccgagtgctaccgctccggcgacccgtgcaccggcaagcgcaactacacctacatggacgccgtccgcgccaacctcggcggctccaaggtccgcctctgcggcgtcatccagtacgccaacctcttcggtgtcgccatcggctacaccatcgccgcctccatcagcatgctgtaatcaatcaaacaatttctttgtttcgattcggtttcgatgcaaactccattgatgatgtgattgctgatagcttagttgattcgatcgagcagggcgatcaagagggcggattgcttccacgagaaggggcacaagaacccgtgcaggagctcgagcaacccgtacatgatcctgttcggcgtcgtgcagatcgtgttctcacagatcccggatttcgatcagatatggtggctgtccatcgtcgccgccatcatgtccttcacctattcgacgattggcctctcgctcggcatcgcgcagaccgtcgccaacggcgggttcatgggcagcctcaccggcattagcgtcggcaccggcgtcacctccatgcagaaggtctggcgcagcctccaggccttcggtgacatcgcgttcgcctactcctactccatcatcctcatcgagatccaggcaagcagctcgccgccgccattgccgcatcctctgtttcttggcttcttctatttcttgtgtcctaacagaacagagcgttgttgtgtgtgatgtcatgtcaggacacgatcaaggcgccgccgccatcggaggcgaaggtgatgaagcgcgcgacgatggtgagcgtggcgacgacgacggtgttctacatgctgtgcgggtgcatggggtacgcggcgttcggggacaagtcgccggacaacctgctcaccgggttcggcttctacgagccgttctggctgctcgacgtcgccaacgctgccatcgtcgtgcacctcgtcggcgcctaccaggtgttcgtccagccgatcttcgcgttcgtcgagcggtgggcggcggcgaggtggccggacggcggcttcatctcccgggagctccgcgtgggccccttctcgctcagcgtgttccgcctgacatggcgcacggcgttcgtctgcgccaccaccgtcgtgtccatgctcctcccgttcttcggcgacgtggtggggctcctcggcgccgtctcgttctggccgctcaccgtctacttccccgtcgagatgtacatcgcgcagcgcggcgtgcggcgagggagcgcgcggtggctctgcctcaaggtcctcagcgccgcctgcctcgtcgtctccgtcgccgccgccgccggctccatcgccgacgtggtcgacgcgctcaaggtgtaccggccgttcagcgggtagagagaatgtgagatcgatcggtgaccgtccgatcgaagtagtactagcactagcaaacatgtgtacgtcgtatgggcagcagagcaacactgccgttgccaggtggggcccaggtgtgagataaaaaagaacgaggtaaacaaaaaattatttactgagctttgtgtggtgttttgtcatgtaacaccttgtagattcttgtattatgagtttgattgggataacaaggctttaatggttagtgaagcacagcttactgtacgtctctgttttttttttctcccttcgattttgctattattgtgtttagttccaaataagctaagctaagcttactagtaccagtattaaacggttgaatatttcagtgatattcaagaagtggtaagcaaatgactgcgtatgcaaatacatttgtctgatgaaaatgacttttttaaatggaatttttgttaaaatggtcaatttttttcgatctatgtacttagtgttaattaataattgttatattaagataaataagattgttatatcttaagatcaagattttgttgtgatatctatttctctcaattgtgatgttaacagaagataatttggttatgagaaattggagggagtattatttatatatctatatttcactggaaaagtccacatgcatgtgatatgtcattcggaagatgaaaatgaaatctatacatggcgcaatgtgcttcagtgtgttgtgcactgttgtaaatatattgtgacgttcgaggctactgatatgatggttgaaacttgtatttgtacatttgatgttgtgattgtcagtgagaccattggtggagcttacactacaatttttttccagggatattgcattattacatatacattatccaggtactttgtacaaaagagcaagcacatcacactagcaatgtaaacatactaaaacgaggtgaggcattagcgcatgattaattgagtataaactattttaaacttcaaaattggattaatatgattttttaaagcaactttcgtgtataatttttttttaaaaaaatactccgtttaatagttcagg

SEQ ID NO: 16184 - DNA, 16611 bp, Oryza sativa
  unsure (1)..(16611): unsure at all n locations
nnnnnnnnnnnnnnnnnnnnnnnnnnnnnnnnnnnnnnnnnnnnnnnnnnnnnnnttatgctttgtgtggtgttttgtcatgtaacaccttgtagattcttgtattatgagtttgattgggataacaaggctttaatggttagtgaagcacagcttactgtacgtctctgttttttttttctcccttcgattttgctattattgtgtttagttccaaataagctaagctaagcttactagtaccagtattaaacggttgaatatttcagtgatattcaagaagtggtaagcaaatgactgcgtatgcaaatacatttgtctgatgaaaatgacttttttaaatggaatttttgttaaaatggtcaatttttttcgatctatgtacttagtgttaattaataattgttatattaagataaataagattgttatatcttaagatcaagattttgttgtgatatctatttctctcaattgtgatgttaacagaagataatttggttatgagaaattggagggagtattatttatatatctatatttcactggaaaagtccacatgcatgtgatatgtcattcggaagatgaaaatgaaatctatacatggcgcaatgtgcttcagtgtgttgtgcactgttgtaaatatattgtgacgttcgaggctactgatatgatggttgaaacttgtatttgtacatttgatgttgtgattgtcagtgagaccattggtggagcttacactacaatttttttccagggatattgcattattacatatacattatccaggtactttgtacaaaagagcaagcacatcacactagcaatgtaaacatactaaaacgaggtgaggcattagcgcatgattaattgagtataaactattttaaacttcaaaattggattaatatgattttttaaagcaactttcgtgtataatttttttttaaaaaaatactccgtttaatagttcaggaagcgtaaaacgaaacaaactttcttccaatctcctggtgccgaacgcagcctaaggctgagtccgttttagcgtttaggttgagatttttagaagtacgtgaaacaagacattctattaacacatgcatgattaatcgaatattaattattacaaactaaaaatgaatagatttattagttttttagaaaacttatatatatatatatatatatatatatatatatatatatatattttgcacgacatagtttaatagtttgaaaagcatgcttgcagaggttattctgaaaagctgtatagaacactttactgtttatttgatcctgcagtgattttctagacaagtctagagatgtacaagcatcacatcattacaccatggacacacaccaataatttggagaggaatatcttcatgatctgtgaagtggtgcatccactgttggtggattatgataactgatagagctccattagttcatacaagcctcttttctgttctccccaaaaaggagatagttgagggacgggcaaaatgaagataggattggatttcatgtgcatatatgcatgcatccaagggtaggagggcccaaggggtgtacatggcagtgtttaccagggccatagggtgttgctttctttgattttggcaggtgaattaaggctgtttttggccagggatcttggcaggtaccaaaaagaatggctcacaaaggattggaatctttggcactcctgtttgttagatcctctttctcttgcaatcttgctatcatatgatgggctggtttactttgctcagatttatgattggaagttgatgtttgttgggagctagattttttgcaagttaataccgtagagtatggggttctagatgaagtgctgtttggggccttatgttggcatgatgcttttttggttcagtataaaaaatcaacacttcctcaatcctcatgcatatgaacattgtgcatggatcacatctctataacttaatacaattgatattaatacttgtatggctttagataatagaaacgtttgcatcttcagcctttgtcattaagcacagaaccagtaagttttaatcaatttgataaaacaaaagacatactgacgtgtaattcttctgcgcgttcgtggaaataaaaaaaagacataagaagctgagacaaatccagccacaacatcttataaatgataacttgctgaattaacgataattttttttatagatgccatgtaaagtggaataaaagattataataattgtttgattgattgtataagacaatgaagttgatgcgggctaccattagagaatatatcctatgcacacaagcttcccgtgcacactccgtgcacaccaactatcaaatggcatagaaaattctaaaaaaaaattgaacacacacttccaatagtattgcacctacgtgtgaaatgctatcttaaaattcattatattttagctgtaacaaaaaaagataaaattttgacagatttttacccttaaaactattagatttttcactttttttgatagggataaaatacaataaatttgaatatgagactttacatatatgtgttatactattaggagtaaatgcccatttttttatataatttttcgtgacatttgctagttggtgtgcacgggaaagttacgtgcataggatgttcccgttaccattaagctaataagaataagatgtctgactttttttcaaccaacttttcttcctagaagagagaagcagctagtaactcagtaattgtaacaaaaagaaccaaattaaaccatatatagtaagttgtttttacaacaagaatgagtgagtaatgcacggcaatggtgttttcacaggaaaattaggttgaaaagttgaaagtagcaggcacatattctgtacattcttttcttaaacttgcgcgcacagttaagtccctttccacccaaagaaagaaatcaacaaatattccttttcttttgctgggaaatcaacaaataccgggataagaatatatacggagtgatctacatttgcagacaagttatatatattcttcactcaatgcagtacacatacatcaccagatgagatcaggagggtttacgcttttttttcccatgaaaatcgtgaaattttgattttcttttttgacaccacatgaaattaaagtagattcgaagtgaaatttcaaatggttttcgagaatgcaaatttcaaacaataaaaagttgatcaaactttgctgtaatttgacgaaaaatgtcataccgtttgaggttgaaatccaacactcaatcgaaaagatgaaccctgatcagaggtagtggagtatttgcacagagaagcaggcttgcacgcatgcatgggtagcccatactgtttaaccgagagagatcgatgtgttttaatttaattttgctatctattgactggagcatctgtattctgaaagttgctgcattattgctaccctggatatattctattctactgttgaagtatttcagataagagtagttttttagataagagtagttatccagaaaatgttagacattgtggtccataaacactacagtaaattgttcgatttgagtccacgacaacgaaataaagtatggctgtacatgtatggtcaggattactgaacaagaatggggcagccatatccattaagctaggcttggtatgtttgatgttgagtttatacaccagtgttaagacatgaagttagcacacattaatactatgggctaatttgaaatagattatttgctagattattactacggattaattatctacttgattataggaatagattaaatattttaataaataaacttaacagagatatcttagaataagtggtctgagcaagttttttttttttttttttttttttacaaaacatactttatagatgtggagcaaataatctgtgttaataatatggtgaagtagctgaaaagaaatataaaaagtatagcatctctcgatacattttcaaaggttttatggatgaaaaattaaatatctgccatcaaaataatgtagtctacaaacagttcaagacagtatattatatttgaccatttgtgtatgacactgtcctatccatcatctatgagatcatcacttccaccttctcagaatacaaacaagattacttcaacttttcaagtcatacttccaaaaatacaaaaaaggtgtaggacaaatcttaattcaagatgaactgttcattcgcattttgctttgaaactgcaataggttgcaccctttcttttcatcatttccttgcagtttcagtgtaccaagcagggggcttatatctgcattcatgcataggcgcaagaccatatcaaattcatccaaattctttgctatcctccaatttgaatcgatctgtacatggagtcatcgaatttaattccgccctcatcaccttcatttgcgtcttgaataactctaattaacactgcaacaagaaagagtatcatcatcattcaacaacaaaatttgatctgatgattatctatcaaaacacaaattcaacaatacttgagacatatcgagagataccaaaatttttggtgcaaatttggtatgtcttaccatcagagatattaagaggtatcaaattttatattaaaaaatagagaaattttatggtccttaaaaaaatacctcgaggtacctaaatttcatactaaatttttttatacatcaagctacttagtatatagaggtaccaaattttacactaaaaaacatgggtactttttaaggatggtaaaatttcacggaaaaaaaatatggtacctcctgtaaatcctgaaaatcactcctatcaaaataaagcccttgttaaaatccaaactttttcttcaaacttctaattttttcatcacatcaaaactttcctacacatgtaaacttttaacttttccatcacatcgtttcaatttcaaccaaacttccaattttagcgtgaactaaacacacccaaaggaaacacccacaagagtcaggggagtctcatcccaaaataaatgtggccacgatcttgaaaaatgcgaaaaaaaattcagtataattaggacggtttgcttacagtgagtttcaggagtcggcgcacgagcgcatgctgccggtggccgccggcgccacggcggcggagcccatggcctgccggtcggcggcgcgcctccggacacaccggtacgagcacgtggcgacccagaacgcccacgggagcgcgacgagcgccagcccgacggcggggagccagtgcggcgcctcgtgcggcggcagcaccacgtagccggcgaggcacccgccgccggcgagcacggagaggagtagcagcgtcgtcaccatccacacgcacgcgctcccgcccggccgctcctccccctcctgcatcggcggcgccatcggcggcggcggcgaaagaggatcacggcactaggcggcgacggcggcctcggcggcggcgcgggtcaagaacaaggacgaggcggcgtgcatggcaatggtggcgccaatcgcctctctctctggatttgtgttcttgttcttgttcttgttcttggattttgattgattgaaaaaaaatgtgccaaaaaagttttgatattgttatgttgtttgggttttgtggatcttggaggaggagaaacaacggtgacccaaatttgaagcagaggtgcagaggaaattgcggggagttaataatagcttggtaataaaattccatttaaaaaactaaagcagcgtgtcctaattccatgcagaaacatgcaaaaactggcaaagataacaaaacatgcaaaatctgtagaataccaggtagctttatatggtattcacattaagattaaggctctttttagagggacatttaattattccctctttagaaagatgtaactttacaggattttcgtagaaatttgttcagttcttgcaaagttcttttgaaaatcttccaatccaaaggaggccagaagtgttcaccggctgtgcattctcagtttttggggggaatatgttggggcactgaacttccgaaaaacaaatctactgaaacaaactttaagttcaaacataaagtttaggaaagatatcccatgataatagatttctgaaggttgtgttgctcactttaaattgcttaggtatggttttcatcatctgtgcaatcaaatatagaaaaaaaataaaattcgagaattttcaaaaaaaatggggtaaatattacgttccactgcagagtaggctgttcatgatctgaacttctgaagatacaaacatataaaaacagtcaacttaacagtgctttacatttacacaaactcccctgcacaatccacaccaaaccagaagcagaaagaaatacaaaaccaaaactaaaaaacaaaaacaaatttgctcatccaaattgcacacaaagcagccacaacacatgagcaggttgatgagatcacacacacagagagagtgagatgacgtcagcccagaacgctgtaaagatcgccattgttgccgtagaagccatcgccgcccttgtccttggtgctcttcctcttggagaagatgatgtcgccgatgagaggcacgatgggcttcaccttcctcgccttcctcctcctcccgaccagctcgccgtcgtccacctcgccgaggctcaacgcgtggctgaacgacggcaggtactcgcacgacgtcgcgcgcgacacggccgcgccgacggcgtcgacgccggcccaccgttcgctcctgaacgtcgccaccgtcgacgacacgtcggtctcgccgccaacgctgcgccgcgccgccgctgccgtgtcgccggcctccatctccgccagcttcgagaggccgcggtggagctgcgcgttgagcgacgccacggccatctccatctcgctcccccgcttcttcagctgcgccacctcctgcctcgtctccgccacctccgcctccagcttcttgactgaccgcatcatcgccaccgtcaccccctcgtcgaccacgccgccgtcgcgctcgtcgtcggcgtcgccgccgtcgttcggcggcggcggcgacgactgcggcgaggacggtgccgagtacatcatcggcacgacggccggcgctgcatcctcctccacctcaggctcagcttccatggcatccggagaagaaacagtagcatcatcactatcgccgctagcttcatgcttggcaatggcgatgtcaacaacggcagcagcagcagcattgccgttgctgggtcgccgggagtagccgtcgccgacgaggatgcgctcgccgaagacggcgacggcctccctgacggaccggaaagggcgtgccgtgtcgacctcgacacggtcggtggccatggcgatggagaagcacagcaattaagcagcaacacgaggatcgatcgatcgatcgaacgttcttggctgcaagcaacatgcacgatcgcttggaggattatatgaaggggcgaagatcagtggatcatcgcttggctgcaggtagtttctttgcttccacttcagtagcacactggccaaccagcaactagtttcccaatagcaacaagcaagaggagtgacttgccaccaaaaagaagtcagataaaactcccaagctaacctcatctgtatgtaggagtggagctgaagcagggatgctttctgaccactcttggcaagcatgcaacgcaggcagggtatgcagcatgctattcataattccgatgctggataaaaatcactcatggtaagtgtactgattaaccgaaaaggcgaaaacaactgataaaattcagataaatcttatcaaaattttaaaattcagttttgaacatgactccagggttttcgattatgcgctctcttcggtctcactggctctgcagtccatccgctcgtaaggtcatctgtggcctttaatgggtattgctgcttttggagatttcttgggagtgtactgtggttttgcccctttcctccaatcggagttgtgtatagccaccgtatttttttcttcttagctacaatttttgttttgctttttcttccttccctcggtataagccgctctggctgattgcattgtgtaacaaaaactcttttccctctaatatattgacgtgcaattcttttactcgttcgcaaaaataaacatgaccatcaaatcgagtgtctatggtttcaacccgatccgaaaagtctgtattttacgaaatttggtccggtttccaccggattgtaaatcctattaacagcagcatgaagcataacagaacagaaattctggtgtcatgggggtggttgggagaaatcatagttttttcagttggggcatgcagttcttggagtggacaagatagggaccttgtaacaaacagcccttgttgttaaggcgattggggacataattctaagatggaaaaccacaaatgtgtattggtaggaaagtaacacaaaaaacataagcaaatcaaatcacacaaagcaaaacctagtccttctatgatcttttacagattataagtcgtttttactttggtcaaaataaaactgattattagtcttttttactttggtcaaaataaaactgctttaagtttaatcaaatttgtagaaaaaaaaaagcagtaacaattttaacccaagacaaatatattatgaaaatatactcaattatcgatttagcgaaattaatttgatgtttacatattgctatatttatcaacaaactgagccaaactcaaaatagtttgacttttatcaaaaccaaaacgacttagaaattactccctccgtcccattataagagcaaccataagtttccgcgcccaactttgatcgttcgtcttatttgaaatttttttataattagtattttcgttgttatgagatgataaaacatgaatagtactttactcgtgacttatgtttttaaatttttttcaaaaatttttcaaataagacagacggtcaaagttggacgcggaaaaccatggctgcacttataatgggacggaggtagtagaatctaaaacgaagggagtatattactacttgaactattcccaccagtcaagaatatatagagcatattattatttgggggctgctatataccggtatcccgttgggatactgtcccaacgggatcgctcccagtccacctccctcagatgcgagagcgcaggcccccatgggagcagcgcagacgaggctgacgccggtggcgcagacgcggcggccgccgccgagctccggcgtgaaggacgcggctgcctgcgacgagctccagcgtggaggacgcggccgccggcgagctccgacgtggggcatggtcgcatgaacggcggagaatcctgcgtggtgacagagacggcgccgtcgacgagctccggcgtggggcgtggacggcggaggatcctgcgtggtggtggtggcggcaccggcgacgagctccggtgtggaggacgcagccaccgctgaggcgtggacgacagacacggccgctggtgacgagctcccgacggaggacgcggtcgccggcgacgagctccgataccgtggacgggggaggatgcggctgccggtgacgaggttcgggttcagtacggagcgtcgacgggggaggacgcggccgccggcgacgatgcctcgacacctcgacgcccagctcctggtatctagtaggtatcatatgaatatgatacctcataagtatcacccccgatacatcgtagaaatcacatgatacatgatagctatcacatgatacctcacgagtatcgtctgatacgtgataggaatcgtccgatatctgatacgtggtagaatcgcatgatacctggtaggtatcatccgataccagctagttattaggtgatacctgtaaggtatcatacgattcttaccacatagaagatgatagttgcgaggtatcaagtgatacttgagtaggatcatgttaaacctgggaggtatcatgatcctccttagtatcatgtccggtttcaccaggtttcataggtgatactttgggaggatcatgtgatacctgggaggtatcatgatcctcatctgtatcatgtctggtatcatcaggtttcacaaatgatatcctaggaggatcacatgatcctcctcgaaagtatcattacgtgtgatacctgtgcagtaccgcatggccctacttaggtatcatgtctagtaacaagattctatgggtttcacaaatgatactttagtaagatcgtgtgatacttgcgtttctaccacatatcagatgatacttgcgaggtatcggatgatacctatcaggtatcatgcgattcttaccacgttgtggatgatgcttgcgatgtatcaggtcctgatacctaccaggtatccatgcgattctaccacatatcaggtgatacttaagaggtatcagatgatacctatcaagtatcatgtgattcttacaatgtagaagatgatacctatcaggtatcatgcgattcttaccacgtagaagatgatacctatcatgtatcatgcgattcttaccacgtagaagatgattctaccacactccacagccagccataaccaagttagcaagttcttttcaccccatcttgtctctttgctcccccgaagcagtagatggataggatgaaggcccggactcgcagcgggatcaacggccggcgacgaaggcgccgaccggagagggcccgcgacagagttggggcgccggcggagggcgcaccggccggccacgcggatggagccggaggtgggcgttaacggcggcgccgtggatggcggacggcggtgctggagctccaggcggcaatccggcgaccacatcgctggcagccacgtcctccgccgtcgctccctacgccgggctcgtcgccgcagccacgtcctccgccgtccgtgcctcacgccacgctgaagctcgtcgccgaagtccgcgatgccgggggatcgttgggggtggccgcgtcggagctcgtcgccggcgaccgcgacctccgtcatccacacccatgccacaccggagctcgtcattgacttagttgcagcagcacgcatgagagagatgtggtagaaagaatagctagatagaagaagagtggattggttggtgtctatcctatcccgtcgggacggtataccggtgtttagcatttccgtattatttactctattgagtaaattacattgctgatacacaaatttggattcagacggcagtggcactccggaacgatctcctacgtgcgcggacagctcacccatgacccatctacttaaacgtgctcatcgatgtttcaccccgcgtgatctgaactgagaagcgccgtcgtgtgaccaatggcgcgccccgcacgccgaccccgccccgtcgccatggccactcctcgccggagcgcccgactagccgctcagaggacgacgacaccgccagccgcggcgccgccgagaagggtgcgcaatcggcggcgggagttccgccactaggagaaccaggcgatggtgacgaaatacgtggcgctgcacctggtggtgctcgtcgacgccggccccggcaccggcaagagcagccagatcccgcgcctgctccacgccgccggccacggctgcgtcgtctgccccagatgtaccgcctcgccgccgtgctcgcggcgacttgcgccgcggccgacatgcgcgcctagctcggacgccaggtggggtactccgtccccctcgacgaccgctcctcggacgccgacacggtcgtcaagtacatcacgcacggcgcgctcctccgcgatctcgccgccgacccgctcctcacccgctacggtgctgtcgtggtggacgacgcgcacgacgggatggcgatcacaggtgtcgtgctcagctgcgtcaaggccgcggcggcgcgccgcctggaccttcgggtcgtcgtctgcctgaaccactacagcaccctctgcaagggcgttgtacacggcttcttctccggctccggcatggacggcaaagaactctggttccgtacctactccggtctaatcgaccaacattacctcccggagccggtgacagactacctcggcgcggccgtcgacgcggtgtgccgcatccacacgacggagccgccgggcgacttgctggtcttcctcccgggctgcacggacgtcgaggcagccgagcacgcactcaacgggctgtgcgctgctggggctagctacatgctgcttacacgacggcctcccgatgcaccggatccacgacgtgttccggccggcggccgacggcaggcggaaggtagtgctagccaccgacgtcgccgtctgctcggtgttcgtcgatggaatcaagtacatcgtcgactccggctactgcggaacggacaacgcccccgtacatctgatcggcggcggcggctcggcggcggcgcgcctggttcgaggcctgaaagcggtcgtccataaatggtgccacataaggcgtaaggtgaatgagtcgccgaagatgtgcccgacggggacgttcttctgcctgtgtacacgagagaggaggagaaggggtttccatacgtgtggaatccggcgaacaagatggcggatgtcaacgccctcgtcggcgtcatcctcacgctcaaggcgctcggctcgtcggcgccggaggtgacgacgtcgtggccagcttcgacttcttcgagccgccgcatgcatagttgattcattgggccgtgaggacgctcaaggcggccggggtgctgagccaggacggcgaggtgaccgagaccgggaggcgaattgcgcgggagatttcgggaagatattactaagcgaattcaaacatccgtgcgagccactgaaccgtgggcttgacaggactaaactagtcatcaacctttattttttttaataactataataaatgctcccaacagatgaagtctattttaatcctattattgttatatggtttagttacttaagatgaaattcactgtgggaattcacatgaatatatattttaatcttattattgttatatggtttagttacttaacatgaaattcactgtggaagttctataaaatcatgagcgaatccgattgtctcaaattagcatgcaagtttttttaaacagatttcttatatgattccttctatattaccaaagtgaagatcttaaaaaccgactcaaatacagatatgtatttcaaaaaccaaacgaacttaaaaactgactcatacacgaatgacgtatcaaaaaaccagcaaaaccatcttcaatttttataatagtagagaagagatatagattaaaaccaaaaaataaaattaaaaccgactcaaacacgaatgacgaactgcgaaaacatcttcaatttttataaccgactcaaacacggatgacgaaccgcaaaaacatcttcaatttttatagtagtagagaagagatgggatgaagcattccagtctttgctcaagagctatagccaattattacaaggttcacacaaaagtaaactcacatagtgagtatgtagccaaagtaataaaaccaaacaaggtaaagatcccacgactactgaattctattggtgaatctccatccgaagttgtcaaagagctgcatgatcatcgactcaagtttacgacacacatcttttattagcttgatataatcatcatgccgttttagttgagcccattcccggagctaatgtgttgtcctgaaaagaacatgcaaataagattttgaaggtgatctatcaaaaaccatttcatttttacttaagctagaggagactaacatacagcgaaagctccaacaagaataagttccttgatctttttattaccacctacaagccaattcccaaacatgtgagatatactatgtggatggtataatccaaactcgaattgtatagatctccaaagaaatccggcaaaatggcaatccaggaaatgatggtaaattgattcttttttcataaaaaaacatctcaaactaccacccaattcctcttagccaaattgttttttttgttaaaacaacaagattccatataaatatatcatcctcctctgttaagttaacatgcacaattgaagcacacaaattgtgccatctaatcaagttttgaccaactaattatcacggaacagtactcaaaacacttgtaacttagcagtttttccttctaactatagaatatgatgatgggtatttgtcctttacagaagaattacctaatcaattatcctccgagaatctaacttgttcaccattattgataaaccaggaactcatatttagaaaagaacttttaaccttcatcaatcctgacaaaaaatgggaatccccttgttccgctcaacttagttatagatttagtaccaagatatttccttttcaaaagatcttgccacacacagtgttcatttattaatttaaacaaccacttacttagtaaacactggttttggatttctaaattatgaataccaagtccccgttgatctttatgctgacaaataacatcccatcttgtcaacctatattattttttatgttcatcaccttgccaaaagaaacgggatctataataatcaatttttcgaagaacccttttaggaatctcaaaaaacgaaatcataaacataactaaacttgataacactgagttaatcaaaaccaatcgcccacctacagacatatgtttacccttccaactactaagttttttctcaattctttgctcaattgttaactaatctttattacaaagctttctaaaatgcataggaataccaagatatctaacatgaaaatctcccagtttgcacccaaaaatatttgaatattgctcatgacattcctttgcttgtccaaagcaaaataattcactcttgtgaaaatttatcttcaggccaaataacttttcaaaagcagttaaaatcaatttcatatttttagctttctgtaaatcatgctctaaaaaatgatagtattatcagcatattgtaagatagataaaccatcatcaactagatgtgggaccactccagaaatttaaccataatcttttgctctctttattatatagctaacatcaataactatattaaaaagaattggagataacgggtcccgttgccttaaacccttatatgtttaaaattttgatcccacttggtcattcactttaatgccaacctgtccaccttggataaaagacgcaatcaaatcacaccatttttgtgagaaaccattcattcttaaagtttgttgaacaaaagaccattttactttatcataagctttctcaaaatcaatcttaaaaagtacaccactctttttttcggtgcaattaatgtatcgtttcatgaagaataacaacaccctccataatattcctcccaggtataaaagccgtatgtgtggggctaataaccttctgagccactatagaaattctatttgtagcaactttagtaaaaattttgaaaccgatattaagtaaacaaataggcctatattgttaaattttgaaagcctctttgcacttgggtagtaaaattatagtgccaaagtttagagactaaagatgttaattaccactatgaaaatcattaaataaatcaaccaaatcgggcttaataacattccagaaaacctgataaaactcagctggaaatccatccggacccggagctttattatgctccatttgaaaaatcgcatctttaatttcctcctcagaaaaatcttgtactaaagcattattttctaattgagaaacctggggaatattacttatttggctttcatctaacgttaaagaaaaagcttcacgagggccaaaaaagatctttataataagtggtgatacatgcctttaaatttgcatcaccattaattaccaatcaccatcctgtagctgattaagtccttgttttcctatgcttaccatttgctaccaaacgaaaatatttagtattcgagtccccttccaaaatatctttagtattaactcgctgataccatttaatttgcttttcacttagcaaataggataacctattcctcaaataaagtatagaatcaagctctgagttaacaaagttgattctccatttttatccagaaaaacaagactttttctctttgtaataaaggccactagtctgtttggcccaacctcttaaaaattgtgttaatctacgaatcttagcctgccaacgctctaaatgagtataatcatcaacaacacttaaccaaatttgcttaaccataactacaaaaccatctcttaacagccaacctaactcaaataaggctacacaacgctaatatttttagtttattttatctgatttttcaacattattgttgacattcttatacagatatattttaattactagtcaagtgtaattgatagtaacctttatctctttctctcgtacaactatacattattttaattatgttttattcatgaagtatctttcaaaaaaaaaagtttcatgaagttgatatacactatattataacacgtaaaatgatc

SEQ ID NO: 16185 - DNA, 16356 bp, Oryza sativa
  unsure (1)..(16356): unsure at all n locations
nnnnnnnnnnnnnnnnnnnnnnnnnnnnnnnnnnnnnnnnnnnnnnnnnnnnnnnnttgacattcttatacagatatattttaattactagtcaagtgtaattgatagtaacctttatctcttcctctcgtacaactatacattattttaattatgttttattcatgaagtatctttcaaaaaaaaagttccatgaagttgatatacactatatcataacagtaaaaatgatcaagataaaattgcctagctagcatgttaatatatcactattcaaatttgcagtaacagagaaaccagaataccaaatcactgaaccggtgcaaaataccaaattactgaactagtgcaaaataccaagtcactgaacgagtgcaacattcgtaaggccatacattaatgacttggccaaagagttatactacgtaatgcaattaactataccgtactgcagaagaaagaaacaatcaacaataccacaacttaactttgtctgtaggaactctacaatatccattaacaacatcagaaatcactttcattcttcagagaactttttaggacctccgttagaacactgtataacaacttatgcctctctagttgaatttctaaattatttattttaacttcagcttcattcttcagtaagtcttgtacctaaacttcaagctgatgaagcaaagattcctgtcctggacgagatgcctgttctgatcctgaagaaaatgcactctccagctgtcctattacataagcaacaaacccatcctgcttctgctttggaggcttcattttgatttcagattctttcttccaatgcagtaactcttgtacctgaatttaaagctgaagaagcaaatatgcttgccctgaaccagaagcaattgcactctccggctgcccagtaataaaagcaataggcctaggcctttctagctatctcccccttctggttcgagaccttcattttaatttaatcaaatattttttaaagttttctctaaacttttcacatttttcacaaccgagaagcattataaacgaaggtaccataatgaatgtatgtggttgttgtgattgtgggtagctcgcttaactgtatcacttaaatcttgatctaaagcatgcttttcaaattcacgggctgacagtacatgcaatagaatttataaaatcacgggttgcctttcgaattcacattaataggtagaaggagaagataatggcttatgctaggcaaaatgcaaattaaaagttttaattggaagaaacaacaataccttctgatagaactcacagttctgagaacaataataagccattttatgaatttgaccagtgagcaacacctgcaacaacaaaaaaaaaaacaaaccataattagtgaatacaatggatttggatttcatacaagtaaataaagtgataataagtcataccgggccatctctctttttcttataggcaatttctactccttcgagatatccagtctcaagcatatctttcacatttttaatctgtccctccacataagtcatcccctcctcctcctctgtaattccagcaataagtctctctttctcacttacagtagtcagctcccctttctcagttgtgacagcaggcataccctcctcagcagcacttgcatcctcagtttcagcagccatcagcttctctttcacagctgtgacagcagacagaccctcgtcagcagcattcgcatcctcagtttcagcggccatcagcttctctttcacagctgtgacagcaggcagacccttgtcagcagcattcgcatcctcagttttagcggccatcagcttctctttcacagctgtgacagcaggtagaccctcgtcagcagcactcacatcctcagtttcagcggccatcagcttctctttcacagttctgacagcaggcagaccctcctatcagaacgcaaatgacgcatcctctgcacggcgcgttctcgtcctcgcatctctcatcagtgggccccgcgctcgactttttgagcgaggttctcgatccttcgctaggaaccgaagaagctagtgaagctatgggcccaccaacttttttcaacacataggacgaagtaacgctccacgtagacgaaggaacgcccactgtgaagggcctaagcaacactcgcatcctcattttcagcagccatcggcttctgtttcttaggtgtgacagcaggcagaccctccttagtagtcgtcgccattccatactccacagtcatctctaccgcactgtagcaatttagtggcgtttcagaactctctaagtgttatggaaatatatataaatagagattattttttacatagaaaacccttatgagagtatactacaggcgcgctgactgacaatgaccactatatattgaggattcgattaaaaatgcaagaaaacaatgcgttgtcgcacccttccagtgtggcttacgagagatatataaattggataaaacctagtagtgctaataggaaaagacctgaaatctactagcaaactaatctaaccactaggaaacaaattcaaatatattgcatgctgaaattcagatcacgtatttaacacaaagcatataaaaaaatggtagaaactgacatgctttgatcagtaactttgacattgtaccctcagagctatagctggcatgcgcatttcacatataagaaaagaacagagctaattgcactgtaaaaataataccttgctgttacaagaccacatatctcaattcctattagcactaactatagatggccatgtgggccgcccggcacggcacggcccaggcccggccgtgcctgggccaaggcttgtcgggccggcacggcccgaccgacacatcgggctgtgccgtgccagcccacgtgccgcactcatggcccaggcatggcccaacacgccttgggccgtgccgggccggcccaaaggcacaatgggctatcgtgcttttcctcggaaataagtctaattttcctccctcctattggactgtgacacatatatatatatatatatatatatatatatatatatatatatatatatatatatatatagctaaaaaagtctattttacctctctcttctttgggctgcggtatataaatagctaaaataagtctatttaaggtccctattcttaggacagtgacaattatatgtctattttagtccctatactttgtgtgccgagcctggcctgccgggccagcccagcgtgtcggtggggaggcccaggcatggcccggcggtcgggccgggccagcacaggaccgacccaagtcgggccgtgccgtgcttgggccgggcaaaaagccgtgctgtgggtcgggccttcgggcctagtgctttatggccatctatagcactaaccatacgatgcagatccccacataaaaaatcaatagcattccacgcaaatcacaaccccggcaccggcaagagcagccagatcccgcgcctgctccacgtcgctggccacggccgcgtcgtctgctcctagacgtaccgcctcgccgccgtgctcgcggcgacccgcgccgcggccgacatgcgcgccgagctcagagtctcggacgccaggtggggtactccgtccccctcgacgaccgctccttggacgccgacacggtcgtcaagtacacctcgcacggcgcgcttctccgcgagctcgccgccgacccgatcctcacccgctacggtgccgtcgtggtggacgacgcgcacgacgggatggcgctcaccggcgtcgtgctcagctgcgtcaaggccgcggcggcgcgccgcctggaccttcgggtcgtcgtctgcctgaaccactacagcaccctctgcaagggcgttgtacacggcttcttctccggctccggcatggatgtcaaggagctctggctccgtactactccggtctaatcgaccaatattacctcccggagccggtgacactacctcggcgcggccatcgacgcggtgtgccgcatccacgcgacggagccgccgggcgacgtgctggtcttcctcccgggctgcacggacgtcgaggcagccgagcatgcactcaacgggctgtgcgctgctggggctagctacatgctgcttacacgacggcctcccgattcaccggatccacgacgtgttccggccggcggccgacggcaagcggaaggtagtgctctgctcggtgttcgtcgatggcatcaagtacatcgtcgactccgtctactgccgaacggacaactgccccgtactcctacatctgatcggcggcggcggcgcgcctggttcgaggcctgaaagcggtcgtccataaatggtgtcacataaggcgtaaggtgaacgaatcgccgaagacgtggccgacagggacattcttctgcctgtacacgagagaggagaaggggtttccatacgcgtggaatccggcgaacaagatggcggatgtcaacgccctcaccggcgtcagcctcacgttcaaggcgctcggcatcatcggcgccggaggtgacgacgtcgtggcgagcttcgacttcttcgagctgcccatccagaatcgattcattgggccgtgaggacgctcaagtcaaggcggccggggcgctgggaaaaaaaaattctctgcggcactgccgcaccacgtctcgtgtgcaacactgcgtagatacctgacgcgtgtccatctcccgctgtagccaagcagccgtttctttggagccgagccgctgtgccgaaatactaaagccgattgggatttgggagccgctgttcaggagtacatcaaagctgattgctggagagatttaatttgtccagttcacaactttagataggaacctattgcattgcgacacgtcttaaagccttgaaacttgatggtttggggatatgaccgacattgctaattagcttgtactacttccgaagagttttggttatctttttgcttctgcaaaatataaacggatttacatgcttcaataacatggtgtttgttgtgacttatgaacatggtgttgtagacatggtttaatttttcggattggccgattctatcggacgtcactgatataccgaaaatttggaaatttcagtccaaaattttcaaaattttgagcaaatattggttaaatttaaaaaaaaatattaccaaattcacaaagaataaaaaaataaaaaatcagccgaaataatatcgtatcgagagtccgaaatgaccaaaattcatttcggaattcctaaccctggctgtagacgtacggttgtcttttacaatctatatactattcgtctgttcttcgttagcggcagatttactatctgttctgtcttctaatgaaacaacagctcaactccgcgtgcagtcgctaactgcggcttgatgtccgttccaacgagctgaggaagacatcggcttggctcaaggaaaacgcttggctgcagtaatatgacgggacacgcgtcagatgtgtacgcggtgttgtacagggggcgtggtgcggcaccgccgtagagaattttttttccggggcgctgagccaggacggcgaagtgaccgagaccgggaggcggattgcgcgggagatttcgggtagatattactaagcgcattcaaacgtgcgcagcacatcagtgcgagcctctgaattgatatttttagttttatctgatctgatttacaacaaggggaagattttagtagagcatctctagcaggtcctcaaacataatccctaaatcattattgagagttgattaaaaaaaatatggatctagcagagtccctactaaagcctcagtctaagtaggcctctagatttggctgtgtatatccttcgtagatatagagaccatattaatgaaaatcagcgtcatcgccgtcctctcacaacctcctagcaagcaagccaccaggtcatttgctccggccggagacccatgcctccgattacgcccaagtgagtctggacgccctccccgaacttgctgctcacccgctggccacaaggcctagcgcggcccatcgacagctacctgtcaccggccgcacacatgctgcagtaaaaaaaatcagagatgatggtaattaaaacaaatcacagcactaaagttcagtttcgtatgtctgagtctcgtttgattttgatctttatgggtccatggccattagctgcagtactaaaatatctgtgcaaaaggacaacctgtacgtgcggaagattctttgactaaggacaaaaaaattcagatttgcttcatcaattgcagctagaggtgaaaacgatcgaaatcggtagcatctctttcgaaacaatgctcgatcggtcggtaatcgactatatttattattaaactactcagtatcgatatcagtacgatgcagaaaaaattgtgataaaacaaaatttaaaaataataaaaaacggtaccctatatacgaaaacggcgctcggtcaatcggcaattgcagcagttcatttcctaatcgttaaacacagagggattgtggccgtgtttagttgttttggcaaaaaaaaaattgacgtatacggacacacatttgaagtattaaacgtagactaataacaaaacaaattatagatgccgcctgtaaactgcgagatgaatctattaagtctaattaatctgtcattagcaaatatttactatagcatcacattgtcaaatcatggcgtaattaggctcaaaagattcgtctcgcaatttacatgcaaactgtataattggtttttttatctatatttaatgctctatgcccaaacatttgatgtgacggaaaagttaaaagttcgaaggaaactaaacacagcctgtgtatgttttttttatgtgattggattgaaaaacctgcctgcaacaagtgcccaatgaatgggacaaagaaaaaaatatattactttttctatctttacagcttattatttttttcttgattaatcaatcgcatatgcatattttgtaggaaaaggcaacctaggaagaatgacagaaagcacccacctgaaccttctacaccaataatgatcacaaataggtttacactaacgcatgatagcctaggaatggtgacaagaaggtaaccgaagtatttgtgtgtgcatatatctcattcaaattgttgcttatctttcgtgcttgtgtgtaggcgcttgcaatgctgctaggagacagatcaggcaccattgaataagggtgcaagcggctatccgcgaaaatccacttataggctaaaccaaccctcaaactcacttattttgaattataagtgagttcgtgggtgacccacttgcatccttacgggcactggagaattagcaagaggcctttcgggagcaagcacttgtggaggcggagattgcacttttggagctagcacttctgtaggagctggttgcactttggggtaaaataattatgctatccctaagaagaaaaaattgactcaatttgaccgagattgtctactcaatttatccttaaaattatgtagcttggttgaacaatttgtgtatgcactgtattatgggttgaatggtttgttgaacaatttgtcgcaaaatttgtgtatgaactggattgtgcgtttgaatgcttcgtgaactttttgtttgctgatactcatgaaaatggtgtttgatgctcgtatgttgctattcaattttgatgcattgtcgttggtacagaactacagagagaccacagatcgatctgatctgtttaggaacagccaaaggcatttcggttagttcatgaaagaaaaatgaggagaaaagaaaataaaacagctaatggagtggcaactatcttgaagtggtaattaaactatatatcccgaaggcaacacattgagtggcatttaatcatttgcatcctaacgagtgacattttgttgaagccatacgtatagagtggcatattgttctttttctcttatattgtaatttttacattgaaatccttatgcttgcatgaaatacaatactgtaataccccgaatttcgaattaatatatttcggagaatattagaagaaacgcgcaaaattttaacttttaaactgttgttcgaataggcgatcaggaaccgtggatgcgtagagctcgccgagtagtacaaaatagactataagtttattgtaatcggagtccgaacgaaatccaggtgatcaaattaatatgggtcgttcgatattgattaggctctcggctctctatttaaccaactgaaaaaaagaagaagaaaaggacaccagcagctagccctagcccgtcgtcctccccaaccctgcctccgcgccgccgctgctggtgacggcgtcgccacagccgtcgtcgtccgccgccgccaatcgattccctgctcggctgcctcttggtgtgctactgctgccaaattcctgttgttgctgctgccgatccgatcttttaattgccgctgctgctaatgcatggcttgatgccttgatgtgctgcgatctggtctcttcatcgctgctgctgctgactgctgctgctgctgctgactgctgctgactgctgctgttagggaggagaagggcgcaggagagcaggaggaagaaggaatttggggatttcggtcattttgcaactagcgggtttgttctcaaattctagtatccacgctgcagcggtacttttggctactccctagaagtataagattcaaatagaaatttattcgatagtcgtttgtgcaatttttgaagttattgattataggctaaaaccgtattttcaaatctgatattaaaccgtcgggattcaggttagttgtcctaaataaagtttgtagccatcgtcgatatctttctatcgattccgataaatggtttaggagaaacaacggagacagtactgctgaccgggtccttattttcacgtggaatttatggagctaggatggttagcaatgtgttggttaattcgttattgatctatcatataactgtctgtcgtggatgtccgtatttttagaagagactctgccgaaatttctaataatttcgggagttagtagttttgagtgtttttttagtgtggcactctaggtacgtggctactagggatggcaacgaggacatccccggcggagagtggtcacccgtccccgtccccgggcgaactgaaatcccccactccccgtccccggccccgtcgccggggatgatttttggccgtccccgtccccaaccggggttccgggggccacacaccccgaaacgaggagaagaactatactagtactactcaacgagcaaaacgccgtgtagtcgcttgattttttatcctatgctgcatcttaatactggattctccactgcccctgtagtcgcttggtttgccgtgtttcgatcatatacttgtttgagctgaaattctacgtactttacactcttcattcgtggaacgggaaaaaagaaagggagaaaacgaacttttcctggttttcatgccgtttaggccaaactggagctgtcgaaccaaactccaagaaacactataaaaaaaacattttttcctggacgagactcccttcagtttacaggcgaaccgtaactaatcgcctctgcaaaaatcgacctgcattcgcatacggctttataaaagacccgcatgcaaagatcgatttttacaagtggatatcttaacaggcccacctacgaaaagtccaaccaacctccctccatcctcattctctctcctcatgctcccaccaccggcgaagaagggcgggctgccagcggcgggcggtgagtgaaccgccgccgccgacgggaggaggagaagggcatgagcggctgggctcgatgggtggcaagcgggccgccattgacgacgggaggaggagaacaaaggccggagcagctgggctcgatgggcggtgggtggtgggatccggcggccccgtgatagccggatccgcaccgccaacggcttttagggttagggtctcgggatttttggatttttattttttgcatacggacgacatacgcaccagcgtgccaaaatcttattttcgcgtgcgggtgcgctactcacatgaaaaaagaaagtagcaaatttcgcagatacctgtgtgtgtgcggggctgttcagtcgcctaaaaaatcggatttgaccgcatgaaaaacgatttggctaaaattatgtcgataggttttttttgcctcagttgatttttgagccacttgatattctcctatattcgtgcaggtgcggtacgggtacattgtaaatacatgctgactattttttggtaaaaaatatggcgccataaatatagctgctcccttgattaaagtagaacaaacatgcatggccgtgggtccgtacgtggcacaagctaactgtgagcgatcgctgcatgaatattagtagtacgagacaaaagaatgttactcctttctcagtactgccaatgcagtgaatctagttgattcatttcttttaacaggaagctagtgagtagggaacaaatactcccaaattatagtgtatatacttgagttacatctcaattataatataattatatcctacttacatattaattacatagtgttaactaagatataattacaccgtaagtaggatgtaattacaaaaataggataagaataagtaaacaactgatgtgcacgttaatgatccaccaagattgattaaattaccgctggggaagagctttacttctagttagcaaccttttttagttttggttgtgcaaccggatgccaatccgaaactaaagatgtatatctttagtcctggttaaaatgactaaaaatatctatctttagtctcggttgaaataatcaagactaaagatatataccaagaaaaaaaaacatatatgtgggatgtgagattagttgtccatcataccaagttaaaaaaaaatatgtgggatgtgagactcaaactcaagatctctcacttcagccctcactcgcgttatcatcccatctactacacacatatgatgacttggatacttttgaaactaaccatggaagcatcttttatctgggttggtaacaccaactaagactaaagatcaatttttagttcgaattggtaagtggggggctgacatggcccgacagctattgaaccatggctaaaaatgatctttagtcccgattggtgttaccaaccgagaataaagatcataaagtgccattgggcttttgaaccggggttaaagatattatttagtccttgtttccattcgaaatagaacaaatgtgatttttgccatccgagcaaagatcaattcaacagtaatgaatattgctattatgtattcatctctactatagtggaaaaaatcgaatgatttttactcaaaaattatgtcggcacatatttagatactccccaaaaatgcttttctagaaatggaaaaccagatccaaacagaaggaacatctaatgtaatgtggaataactcatagtacatgtacaatggaaactaataatgcaaaatgcatcgtcaaaggaatggtccgatagaaatttagtactgaggcgttctctctgtgtttttttttttgatttgatgcgcgcacgcacacgtacacatcaatccacacccataacaagtgcgtgcgctagatacaatagatgaaactacagcaaaatttcgttgtaaatgcgatcatgcaactaaattaagttagaaaaagtacctgctttcatgagcaaagcttctaagacaatagtctataaaaattgatttttacatatagtcctttgagctatgcatttccaatggttcattgtttagactgcgtggaaaacaaaagaagtatctacgaaaatagttatatataatacaccatatcgcacatggattcagattgggtgacatatggtaggaatatcacatggtgacatagggtgaatctcggccctccaaaacaaatacaacggctgagattcgtccacgtcatcacgagtaaaaattttactccctgtaaaacttttactcctgaaattttactcccaataaaattttgagtaaattacacttttcaccacttattattgccatagttgcagtttggaccaggtccactgtattcttttcacttaagaccatgaaaacttaccactcattgcagcttggacctaccatatcccttcttctctaattactcctgcaccaatgatggctccaagctccttccgcctccacccattccctagctaggagcctaggagcataggatagcaggtgcaaggacttgccgactactcgactttctccacggttccaccaccttcagccgccagtacatcattatgcagttattcatgctccaccggtccacggacggagcagcacagattgacaactacaccttctaactcactggtcaccatagtgttcacggagttgctcatcgcgctcaagcgctacattgctccaccgcgacaggacgtgcctcaatgtagcaatgcgtagcaaacagtgctcgacgcgagagatctattggcacacaccgcgcatcccctgcaaccagcccgatgacgctgtgctcgtgctcgttgccgccgcatagccataaccatcttctccgacatgttatttgcctatgtcgagttggctgcgagagcttcaagttcaagcctggtccctatctctagcatcttcaagctcgatgacccagcacccaggcaccaagcagtaggctctttcttgcatatctatgttcgacaagctatccatagcaggcaacaacaagcttgttctgtttctcgaagaactaggagccagccatgggggcaggaacgcagcaatggccgctagaaggaactggtccagtccaatgtgcaacaaaatgtaaatttatatggtctaaagtgaaaacagtactatatgcctagcccaagttgcaacaagggtaaaaataactggcccaatgtgtaattgactctaaaatttttactcctgagtaaatttgtgagtaaaatttttactcatgatgatatggacgaatctcagccgttggatttgtttccgttggatttgttttggaggaacgagattcaccctatctcacattatgacatgcctaccctatgtcacccaatcccaatccatcgcacacatataaaaacacatttccctaggcgaacagcttaaccagtccacctatatggcatgtaagtatccgtcagataaaattaatacatgttttcataagccggcgcttaggtgatccatccgtgtaaatcggcctatttcacatgcgggtctttcacacgcccacctctaataatgtatttaccgaggtgcgtgctcattagaagatcatcatgtaaaaatacctactacttaaaggacccatttaaatcgcaggattgagaaaacatagtaatagaaaaaacgttggattttgataggaatgtaaatgtaaaacagagaattgcaaaacgcaggaaaaacacatgaatgaccgtttaattgaaccgcgagaaagatgcagaaattggatgagagagatagactcaaaggaaagttaccagtgcaagaggttgaaacttttactaaatttcctccaaaatatctatagaattgtcaattccatagaaatttcaaaggattggatatgattcaatcctttgtttcataggatatcatagaaaattttcctataggattgaaatcctccaaaatttctatgttttttctccaattcaaaggggcccataactcttgtttctcacaaggcgctccctttagaataatctatccaaccgaaagaagcaatttcttgcctgagaaaataaagttttgctctcgatttactcggaatgggcttttacaataagagcatgagattccaagtgttattttcaagtttccatctaaattgttagctagaattttgcttggccatggacatggagtttttctttaaaatttagagttcaaagctcaaaatttatggcaagcattcaatatatgaagtttcacatggttatttgtataggatcatatcttctaccacaagctttgcgtgcaaacaccatatgaaccaactaaaaaatgatttcaaaaaattctaaaaattatatactcaaaattattatattttggctgtaaaataaataaaaattctaacacttttaagagtactttttatctttttgttgttctctaggtatgatgaatttgcaatataaaactttccacatagatgtaattctactggaagcacatgctaggaattaaattaatccactaacctggttgcctctataacagtaattactgttaagcactggaaatcctttctctgcagcgagctgacgtagccgcccaagaggacgactgtcgaccatgtaaatgcaaggtacgccatgatcgtacatgtgattctgatgtaggcctgcacggcgagagtgcccttgattgccacttccaactcggcgcgcctcttcttccgtcggtcagacccgccgtcgtctgctcctccgccgccgatcatcctccaccaaataagcatgtttttagcttgaatgctaggtatgggatcgatcgacgatgaatcgacaatgacgtgcaaatgtggaaatatgggagaggcggtgctgctgcgcttctcagttttagctggtgccagcccgtagcttgcattgcctagctatatatatacatatttgtgcgcacttagtcaatggaatctcatagtttaaactaaaccgctgttactgttatatatgataatacaggctgccaccaaagcatccgatgaagccaagttaattattaagtatcacctccatatatcccacccgttaaattcaaattttaatgcccgttcggtttgaaagaaaagcatccttcctaatgattaatttctctaagcactactgtattagatttgtaggaattaatgaagtatagataaactaaaggaaattttttctcccctacaagtcatagcaaagaatttgttatttttattacctcctccgtcctataatataagggattttttgtgaatgcgacgtatcctagtacaatgttgtactaggatatgtcgcatccacccatatattatgcgaaattgctaattggcgcatacgcgccatcagcctaatttgccatcagcctaactcgcgcgcgtttcaggcccaatgtctcgcgcgcggcccacatcctcgcttcgctcgcgcagcccatctgttccctttttcttttttctcatttcctttttttttgccgtggggagtcgggcaaaacaatcgtgaattcacgttttgaatagtcaccaaccgaacattatcctcttttttttctttttttcctcccgtgattcctcctccgcgtggcctcgcttctttctttttgtcgcttttttttttgcttttttttccgtgattcttcactttctcttttttttttcttttttataattattaatctacagcaaaacatatttttgtgttaaaagttcttaaatcttgtcttgaaaatattcaaatcttaacttaaaaatttttaaatctcgaattgaaagttttcaaatccgagttgaaagttttcaactccgagttgaaagttttcaaaccctagttaaaagttttcaaatttgagatgaaaagttgaaagttttcaaatccgagttgaaagttttcaatcccgagttgaaagttttcaaaatctcgagttgaaagttttcaaaatctcaattgaaagttttcaaatccgagttgaaaatttttcaaaatcttgagttgaaagtttttcaaaccttagttgagagattttcaaatttgagatgaaaagttaaaagttttcaaattttgacttcaaaaattcaaatttgagttgaaaagtttttaaatctggattaaaagttttcaaattttgacttcacgtatagatttgttttcaatctgttacttaaaaaaatcttatcttaattaccatcgttatctaaaaataacgtgttagttacattagatatactcggaaaaaaacacgggaaaaaatcagtcgcgccacattcgcgataaaaaaatcacggaaaaaaggaaaatccgaaaaaaagagaaattcacgcggtgaaaaaaaaaacaacgaaaaaaagggaaacccacctactgggccgcgtgcgtgttgctggcgcgcacgcgccagctaggagccccctatattatgggacggatggagtacaacactaatagaaaaagtatttttgcaggcggccaaaagtgatttttccagacgggggaggatcgccagcagcccaacgactgtgaaa

SEQ ID NO: 16186 - DNA, 25535 bp, Oryza sativa
  unsure (1)..(25535): unsure at all n locations
tcctcccccactccccacgttggccggcaaaatctcgcccctaccggccacgtccggggctcccctcccctatttaagcttccccgtcgccccctctcgctttttccccatctcgccgaactccctcgtgctccccatcgctcccgcgccgtgcaaccacccgccgccgccgtttccgccactccggccgccgctagccgccgctagggtcgccaccgcaccgcgccgtcgccgccgtcgggttcgcgaggctaagctccaccccggccgccccttccctgtcgggattcatcgccggaattcgcatcccctcgcgctccggtgagttcaacctctaccgccgccttcggccatgaatgccggtcgccgtggttcatctccctccctctaatctctctcttctccttccttagggcaccccgaatcccgtccgtcggttgccgtcgtcctcccgtggctcgtcgtcgccgttcgccgtcgtcttcctccgcgccggccaccctcggtgaggcatccctcccctcttttccccttcctcccccttctagtgccgcgccaccgctttaagtcgcgcgctgacgccttcggccgccgccgccgtcggccgcgtgccgtcgccgctagccctggccggccagccggctttgatgccgagccgagcccggcggccgcctctatcgccgcccccgatcggctcggggccgatctgggccgtcggtcccgtggaccggcggtggaccacccgcgtggtcccggtccacggtgaaccgcccccccttgagtcgctgcccagtggggcccgcctgtcggcgccgcgcctcccccccgtgctgacgtcagccctggaaaatattgcgcaataaattatttaaggatttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcattgtttgccttgtatgtcgctagattccggctcttccgacgctccggtgtacttcgaaatagtcgccgaggttcctccagcagcagagcaaggcaagtcatgcttgtcacttgatcatattgatcctatattgcaaatgtcctaatgttttctttcaaataccgcatttgttttgcaattataccatgctcctttgttagcttgggttataacatgattaaactttggactaggaattgcttagccatgcttagttcaactagcacacaatgggaaaatctcatttaaaacctagactataggtttatttgataatgttggattagtaccaccgctctggtgttggttaaataaaatgaatcacatggtgggctgtgggtgtatggttttgctagtcgtgcccatggcaattaaggaccggttcgcgggaaaccctggaagaacttatcgtacttaccacaaaccagcgtgggcaacggctgggcttgtagtgtagctttcctctagcagacgcatccaggcaagggtgggcatgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatatccgtgcccgcggttatgggcggtcaaccagactcaccgtgattagactcaccttagtttagtctaatgaaattggatggtataggtggatggttgggcctgttgcaacgtggtgtaacattggacagtggatgattaatactgcttaattattacaactgttttcgcattcaattcctgtttataaatgctagtatttatgcaaatgaacctgtttagctatcccttgttgaatccctgcatcataccccccccattccggtatgacttgctgagtacagtggatagtactcagtcttgctctattttcccccaatcccagagctcgagtatgtgtccgatggcgggttctccgaggagtaggcttcgtccgtgccgtcgaggatgcctgtggagtggtgttcccgctgcagttcaagtcaaggattagctccagttatcttttgtttttccgctgcatttatgtaagacttttatattgtttgtaaggcgtggatctgtatgtcaacattgtcgtttgtgtaccccggccggtcctggacgggggttttaatgcacattctgcttggaattctattcgggaatttctaggcatgacatccctccctcctccggccagatctgggagggagggggaggggagccgccgccgccgccccgcgccgccctcgtcgtcaccgccgccgccgagctgtcgttgtcgccgccccacgccccaccgccctttctaggcctccctccagccggatctgggaggggaggggaggggagccgccgcgccgcaccgggagcctcgtcgtcgtcgccgtccacgccgccgtcgccgccccgtgccgccgccggtatagggagggaggggagaggaggggagggggacggcccgcccggtgggaaatgttgagggagagggagagttgagtgagggaaatgagtggtggggagggagtgaagcagaagataagacttagatttttttttctgtaggtatgattttcgcgggcgtcgcttaagtggtacgtctgcgatagcaaacttcaccccgatttatatttttgtaggcggttatttggcttcaagggtcatgttcgcctacggaaatcagacccccacgtcgggaaaaatgcattttctagtagtgcaacttaaaggagtcaaatttgaccgtgcttgtttgtggtgcaactcttttttttaactatttagatggtacacaagaaacaagcgaatgtccacttgattaataaatctaagggattgtttcttcggcacctaactatcaatctgaccctatttttgtagtttgctcattggaccatgctttttaaaaacgaagagtaccctcttccgttaaggcaacgtaatgacattaattcagggcaaaatggcttatatgaaaatgcagtcaagttggagctccgctctccaacctgactgaatgctgctagtggtggcgtggtttggacgaaaatgctcacacccggacgaccggcggggtggagaaaatcggacactgtctgccaccgcagcatgatgcatgcaaagaatcttttcttttcttatttcttcaaaagattttttatcgtaaaatatttatctaatctacgatctgattgcaccactaaattcgttacaattaaatctttataacaagaccacacatgattatatttcatcaaaaaaatattttaatttttttattgattttttttaatgttgcatgtggtctcttttgatgtttcaaccagtagttttacaatgtttcagctagtgtactcatgatgtttcactgtgtacggatcaaatgttacagtggaatgcgccgttgcaataaatcacccacatattttggaaaccttctattaagggaatttggtttatttttttgttccacaaaaaatgtttcacctagtgcactcacaatgttccactatgtatagatctaatgttgcagtgaactgaaatatttcattgcaacaaaaaacccatatattttggaaaccttctattaaggaaattcgtttcattttttgtttcaccgaaaaatgttccacctagtgtacttataatgtttcactatgtatagatctaatgttgcagtgaactgaaacattcttccactatttgttgaaacattgtttttatataaggtgaaacaacaccagatttaaacgagtgaaacattttcgatctacttagtgaaacaattccgatatacctggtggaacatcgtgcaacattttaaaaataattcaataataagctaatttttttcattggaatatatccatgtgtggtcttgttttgaagatttaattgcaacgaatttaatggtgtaatcggatcatgatttggataagtaatttaagagaaaaatcagtttaaaagtagttttgcacgtaaatcgggcgctgacgtcatgctgacgtcagcgtccgatttttccctaaagcatcggacgtccgacgcgcagccctctccggttttggagggaggcctgctcggtatgacgccctgctgggacgtctcaccatggaaaggggttgctgtgttttttttttcctttcagttcgtatatgaaagtatgcaaccttggattcgtaaatttttttgtcaattttatcaaaaatctgtcaaatgtaagttatgtttgtaaagaaatatatcaaatctaagtgaaattagtcaaatttctaaaaaaaatacaaaattcagcaagcaaaaaactttgaaactttgaaaaagtaaagtcaaatgaacaagggcatataagccattttcccctaaattaatgccattatgttgccttaacggaatagggtactcttcgtcttttgaaaaacagggtcaaatgggtaaacttaagaaagtacggccaaaatagtggttagactttaaaatatggccaaaagtacaattgccccaaaatctaactactcaaacctattgaaaaattcatatggattgatgtttgcatgccttcattttttttatctttcctattcccataggttaaaattcctccaaccaaacatgcactaagtgattttattaaaatcgttgtttaaagggacttcctatccatctctaaatttagggtcccctatcatgaccttctttctcatcaaatttggtgagcctatgtcccactcgttatcgggtcacccatctccctagttagcttgttcactgtcactgtgcctgtcagtgccattcactctagattgctacttattgtgatggagggagtagatcttaaaaaaccaaaccctatcattattagcgctaccattttttgttttaaccgtcacccccttgctcgtcccccggccatatcttcactatcacagatttttttaaattatttctccagttacaaccttccgttccgagctattatcgcgtaccctatttacccgaactccatggcccttcctatgttatctattaaaaatataaatatcaatgtacgtattatttcataaaattagtaaaatatggtaaatgtgaaatataaggtgaatcttaggtcgtcagttggagagcaaaggaaaagaaatataaggagggaggttttttagaaagctatctctaagggtgtgaggtttagggagtacgttcggaatgctctagtaagaagcctttattattagttgacaattcaatgtctctgtgtagtttttcgaacaaaaaaaagtattttgcgtagcttacattggggttactgatcggatgaacttagctagctggtggcagcacattggctatatagttagtggaatcattattaactagctagccagcactccgttcttaattatactctctctcggtttcataattatgagacgctttataattttaaatcaaacatcttatcagtttaactaaatttatagaaaaaataataaaacttagaacaccaaattagtttcattaaatttaacattaaatatattttaataccatatttatctagtgttgaaaatatttctatgttttctataaatttgatcaaatttataaatatttgactaagaaaacaaaatcaaaatatcttcactactaaagattggaaggctcccgtgtgcctacgaatattactgggtgtttctctaaacacacggtaacttaccgtgcgtagaacaataaattcgggaaccatcaagcacataccgtgtgttaggattcacgggagcaccggaatccaccgctttccatctgtgcgcgtcgagctctattggcgtgtcgaacaaaatgttaccgtgtgaccccagtgcacggtaaaccaccgttctctgttacgaccgccgttagcccgttacatcgtgagtgctaccgtgagtcccgaatttttagtacactcggtaagattttcaaccatcctgtgcgttttcatgcaaactcacgggccacacggtaaaccgattaagccaccgtgtgagcgttaccgtgagctagaactcgataacggcgttgatgtgtgtttttgcctgttcccgtgggttttgagcacacggaagccttcccatctctagtagttagcttataatataaagcgcaggaaacataattttctcaagtgaatatatttggatatctgaaatatatgaacatataacatggattatatttgtagggcataggaaaatatattgttttacagtctcatattttgcattgtacttcctccattctttttttttttcatatatagtactagttatggacatcgctatattctccatcgtgtacgtttcatcattacttttctaactctatattcctgctggaagtggctggatgttgatattaattatattatattctagttacgtatataagctggaagtggttttgcatatcaacttgacaacaaagtttgctttatctaaaaaggctgcgggctgatctgcttgtatttggtagatttttgtttcttccttctttatgtaattcttttgaggcttgttaaagttttgctttatctatgtgtggggaataggctaaatgcctcaattacagtggatgcctacaacagaatggtgtagcattcagccaatagaatgatgaccatattgttcgtttctccgacaagacggagatgaaattttggatactcgtggcacgcttttcaaactgctaaacggtatattttgtgcgaaaactttctatatgaaagttgctctaaaatatcagattaatccatttttcaatatgatactgataggtatcaggttctgatgtcagcattgatatatctctaaattgttttttatatttatgtgcattaaaatgcataaaactatattaagacttgctaatcattttcatctattatttagtcaactaaataattactttggacatgtttatcatgaacacactagcgtgtgcgtctagcatcgtacaaaatgcacatgtcgtcattgttcctaaatatcccgatggacccacaggattgtttcctttcgaatatcgacacaaagatctccttgattatgttctacgaatgatagatccattagcacccatggtttcatcgacttgcttgtttatttactccctcctttttatatcataaagtcaaacttctataaatttagtcaaatttgtatgaaaatatagcaactctataacatcaagttaatttcattaaatctaaccttcgatatattttgatattatgtttgtttagtgttaaaagtattactatgtttttcctataaatttgataaaacttaaagaagttgattaagggtgtgtttagattcaggggtgtaaagttttggcgtgtcacatcggatatatggatacacatttgaagcattaaacgtagtctaataataaaataaattacagaatccgcctgcaaaccacgagagcgaatttattaagcctaattaatccgtcattagcaaatgtttactgtagcactacattgtcaaattaaggcgcaattaggcttaaaagatttgtctcgtaatttacacgtaatatgtgtaattagttattttttcgtctatatttaataatccatgtatgtgtccaaacattcgatgtgatgggtaggtgaaatgttttttttaactaaacaaggccaaaataatccatatatatagtccataatgcatccctatcattgatcgcatcacatgtctaggtttttctttttcttgagaacacacatgccggcctaggtcaaatattattttgtacgttgcatctccacgcccacgcaacgtaactgcaatctgaccaatcaattctaggattacataactccgtcaacttaccagaactactcactaattaatcacaatcacagtattcgaaatcctacagccactgcttgaaaaatgtttttttcgaataaacacactagttctgcacatgcaattagggacctggggaaccaccgtgcagcatacacaagaatgttttcgtagacggacaaaatcgattttcccaaattggtggagcactcgcctggccgcctggaatcaaatgtactatttgaaaatgaggaatctcacgggtaggccttgcaaccccatgcgagaattaatttttgcagaactctacacaatatttttgatagaaaaaacaaaaataaaaataaatctagaaactcctgtcgtcgtcgtcggatctggaggcacaacatctggatccggcctccccgccactccacggcccaccaccatcgatccgtcacccagccacaccgcggttggcctctcgtccccaataccgtgctacgaatggatggtggtgggcccactgcggtgtggctgggtgagtgaggcagcatgtgtggaaaaaaaaagttgaaatatatatatttttaataatttacgtttatatatccatagagagcagaaatacacataatccgccaatccgaaacgcgggaagcgcagctcggacacgcgggaacggcgaccacatcgtgccatggagcagaagcgcagaacaggaccggatgtcatggagcagaagcgtggaacaggaccggtcccgtggagcacaggagcgggaccacctcgcttccgcggccctgtcctgcgtggtggagagtggccgagtggggccacacgggaccgcctcgctcctgtggaaccgtagcgcggcaccggcgtggtttcgcgtctggatgtgcagctcagatctggtcccatttctccgcgcacgctgcccccttcccgcataaccatcacgtgggagtgtgataatcacttcctaacatttactccctcttctaacatttactccctcaaattcgtttcgcagtttacatacaggcggattcttgttttgttattagaatacgtttaatactttaaatatgtgtccgtatatccgatgtgacacgttaaaatttttttacccctccatctaaacaccctaaggtgtgtgtcggtgcaagtcaataggtgtatgcgtccttttttgattttgtatcagctattacattcaatcgatacctattttacaagcgggcctaatagcataaccgtccataaaaatcgattttcacatatgggccttcaccaagggaatcctacgcattttcacaaactaattttttagcccgcttataaaaataaagggagtgtgtgaaaatgtttttttttttaagtagtgcaccatattgcctgccttggaaatacatttgaacgggcggacaacttaaccggcctacctgtgggccacctaagcacctgcatgtagaaatacgtgtttccgtatgctggtggttatgcagaaatacctgcatgcagaaagatgcaatatttataaaatattaactgcaaaaatgataaccattgcacaaaacattaagggcccttttaaatcaaaggatttttataggaatttcatatgattcaaattctataggaaatttttctatttgaccttttgattcaaaggattgaagcttttcaaatcctatgaaattcctatggaatgatacattgcatgtggattttagaggaaatttagcaagagctccaacctcttgaaaaatttcctttgagtctatctctctcatctgattcctacgtttttcctgcgctccaatcaaacgaccattcctatgtttttcctatgttttgcaatcctctgttttacacttcaattcctatcagaatcatgtgtttttactatccctccattttttcaactctgcgattcaaaggggccctaagtcctaacaagagtggaacacataaaaaaatctatatattttagagaaagtttcataatggaccagtttttgttacctttgttgcatgatggactaagtggtagcacaatttttcattttgggctaggtattattaccaaaaatttagtggcccacatatcagtcagtgttggtatctcttatctccctcgaacactggtggccaacaattaacagatatctacgaaggagcttagccaacgcttactcaacgtctcaacctaatcgtagctgctcaccatcaacttctcccctgcagcaacttgtcggatggaggtttagcttgagagattgtaggaccaggagggttgagcttgatgcagggacgggtgcgggcgagatcaaccgattggcctgagctgacgaagatcgagctcaaacttgagctccagtgcgcaggcagagattggaggaggtcaagctagattggtggcgcaatcttgatggtctgctcaccgccgatagtgagctcgagcgcggcccgggcaacgctcaatgcagctccagtgcaaggtggtactggtgaaggtcgagctcaatgcagcgtagggcaagggcttgatcaccagccggcggcagctcattcgaagtcctagtctcccggagccttgctcatctgtggtagtgagcttgagctagatggcaggtgtggagacttctacagatcggatacaatacaactcaacggagaagagagttggagaagaacaccgattcaatgtgcaactattatagagttagcaggcccaatgtgaaaaggtagatttacctctagtccaatgtgcaaacaaggtaaaaatattagtggtccaatatgcaattcactctatattttataaaaatgtttcatatgaattttttatgtattcatatatatatatatatatataaggacaattattaaaatatccaaaagcatcgctgtaacatttacaaattatatagtgaaacataagagaatacttatcaaaacatctaaatagcactaaatgcaacatttataaaagatgcattgtaaaaaaatcatcgaaatataatgacgtaggatcttgttaaaaaatttaattgcgaccaattcagaagtactcctgctatctagtatttgtctctgtcatgggccccatggtttcgcttattcggaaaataagcgaaacggtatatttacaaatgaaaaataatttgtggataaaaattttatatacgtgttgtgatctaaaagcaaagactgaaaaataaacttcaatgaaaaaacatcaaaatcaactccaaatttaaggttgaaaatttaaattttgactgataagtacaaatataatcgaaaagatgggggccctaatactctagcagaggcagatactagccatgtccgattctttttccccttaggctcgggcgttggagggaaagtattctccacgtagttttacacctatatataaagtcttaaccataaatttattatattttagtctaaaaaataaaaattatgtcacttataaatgtataaatatgttagaattttatttttgtttttgctctttaggtatgatgaatttaaatataagactttgcacatatacgtaatactatatctaaagcacatgcacatttttttttctagaactttcagtggtattcattacttggtgtgcacggttgtgtgcatgggcatcctctatttctttacttaaccccaattagacatgttgaaagcctctatagtgtgttattaagggggatgtcttttggatcatcccaaacgggagttgagtttggacttaaattttagtaaaaatatctcataccaatacctatctctaataatttttcatgaatttaaaaaagaaaaataggtccgattttcatgggatttcacttattctatggttatcggtagatatttcccatatttattgtcattatgaattctatagatctagtctagaactattttttaactaactctagagttggttagatccaaaagtaagtctgtgtacacgacatctatagatcttgacctactttggatagtgatcttgatgagaattaatttatcatgaataattggacttcttaagatttgtacattaagtttaattatgtactaatggtaatattagaatcaatggtattaatactgtcaaaaaaagaatcaatggtattaatgaatatttaccaaatattaatggtactctttgtcagtgcacttaaatatatggtactccctccgtcccataataagcgcagttgtggatttcagtgcctaactttaaccatccatcttattagaaatatttttatgattagtattattattattattattattattattattattattattagatgataaaatatgaatcgtactttatgcatgacttaactttaaaaaaaattcatatttttttaaataaggacagtcaaacgttgagcatgaaaatttatggatgcacttataatgagacagagggagtatatcccgcaacattaggaaacactgttaatcatatagaatactacttttatgcaaaggatactctcatatgtaatgaaaccaacacctgcttcgaaaaaggtaaaatctaattaggaagcagagggtaaaatctaattaggcccggtttagtttcccaaaaaattttcacataatatcacatcaaatctttggacacatgcatggagcattaaatatagattaaaaaaactaattgcacagttaggggaaatcgtgagacaaatcttttgagcctaattagtccataattagtcataagtactatagtaacctacatgtgctaatgacggattaattaggctcaaaagattgtctcgcatttccagtcgagttatgaaattagttttttcattcgtatccaaaaacccattccgatatccgttcaaacatccgatgtgacacccaaaaaaattttttttgccagaattttgaggcttcgtcgtccggctcctcaaaaattctggacaccagaatatcgaaccatgaacgcggaaaggcacgagagaaatattggctagaatatgatatctatctaatgtgatatatggaatatatgacaaaggtggagtcttagagtatttcgatcgatcggtcatataggcctgagtcagacatcaaatagctttgaccctgcatagattagccatacaggctttccaacccactttagtagaggggcgtactatttgtttacacccattagtgtgtaaaggtttcaatgcggattttgatgggggatcaaatggctgttcatctacctttatccttggaagctaaagatgccctaagtacacgtgcactgtttagacttacagcgtgaccctggtgtcctttttccgattcgaacgtttttatcatccgtgcacagtagtgggtagtgtgttgtctaaatatttctctagctagctatataccaaataagacaatggctagttatatactccctccatcccataatataagggattttgagtttttgcttgtactgtttgaccactcgtcttattcaaaaaatttatgcaaatataaaaaacgaaaagttgtacttaaagtactttggataataaagtaagtcacaaaaaataaataataattccaaaaaaaaaatttgaataagacgagtggttaaacaatgcaaacaaaaacttaaaatctcttatattataggacggaggaagtaccaaataaggtaaatggttggtactgagggccaacactaatctatttttttcttaataccaaaccttttgcagtctatatattttaaaccatgcattatttttaaattccgtttaaaccatcatactcttcttaaaatatatgacaaaatgtacaacattaaatatattcaaatacttgaaagtaatttatttaaattatggaagtaacttagtttgaaaagaagtaacttttcataaaataacattaagttaattatataggagtgaattgaaaataaagaactacgtgaaggaaattcacatataaaatatgggagtacctatacatttgtcgacaaattttctcttaaaaatttgtcaaatgtaaatacaatataattatactgtaattacgttataagtatagaataattacactgtaacttacatgtagttacactgtaactatagtataactacactgtaactttagtataactacactgtaacttatatgtaattacactgtaactataatatgacttgcatgtaagtgagatgtacctttagaaaacttatgtttggcactgctcacgtgaaagagggattacgaactcgcaatgtctgtttgtacgatgcgtgtggaggccatcgttcatgcatgcatgttcggctatgccctgccgctttatctctgcccttcgtctgacatctacgcgtgcatgagccgcgccattgccggcagccagcggccctcgaaagaaacaaatcaaagcgttgacgcaaaagcacgaatcccgaggttcatcaagcgggtcaaaaatcgataaattctgaggaagaaatttgtcaacagatttatagcaaaatcgtaaaatatagagaagattcataagtgaatacatagactttcttatttaaagtaatcactatattattttaccttatataagaactgatataagaagtaactcttcataacactaaaagtaactacgttgttatagggaagtaattatgaaaaaaggaagtaactttcaatggcataagaggcaactacactgttaagaaagtaactcatgaaaatatatattcactagtaatatatattcatagtattagaagtaaccacactgataatttattcacagtattagaagtaactacactacaaaagcgaagtaactctttacagtattagaagtaactatattgtttcatgaaagtagcttttcggtactagaagtaactacactgctatataaaagtatttttgcgtttgcaaaaatataaaagtaattttcatggtacctgagacggagagggctcgtttggatgggccggaattctggcccaacccatttacagtaaaacttgaggagatatttccggcccaattgctaattcatttctcctccttcccatttgcatcatttcatacttcatactggcatatgccacatgattacaaatatcactagtagtagtcctcagaggaacaatttttaatcgctcgaggcaatgcctactcatttatttaaacaccatttaaattgttatagaaaatcttaaaagaattgacagtattcatgtgacatacctatacaacatcacaaaatcttacatctaaaatcaactcagacataaaaacaaaagacacattgaaaaattaaaaaaaaaacagattcagtgtatgaatgaatccattcgccgttatatctgaaggaaagtgcactgctcttcaatgtcattgtagtgcctcgatagtcgtcgttattgcaacttgcaagggctaatacgtctatggtttatagccgagtgttagttgcaatgtgttacgataccatatcagtatatcacaaaacaacgaagataacataatgatgatacaatatatcgtgaatttgtgctgaacaacaaagatacaatctcctaaacatttaacatgagtctatagttatctctttatgtttatatgattagtatgtaccaatcattttagaaattagaacaattgtagcatacgacattgtgtttgatcactgaatgacagctactaccattttacaatttctacgtgtgcgcgtgcttttgtcaatcgtgacagcatagcgtcttgatgatgtagttatccatctccctgtcgaattttaattcttttgggttgcaaatctcattcctctttcctgcaaaccagctccatttgctcgaacgatttcagtgtttttgccaactgtgacaccgacttgtggccacatcctgatgcccagtaaaaaccattgcaagtcaagacgctgcacgatgaatggtctctggggttggttgacaaatgagaaccggtgacaacgaatgctggccgtgctcagtcagtctgctggaccccttcctacatgtgtcaccgttcttcaacacaacgtctgaagtttgaacattttttgtgttgaacattgtgcttctctgtcttcatatgttgcaggaggaaagatggagaaagtgctgagagtagccatggaggtgatgagtcggcaccatgctcccgatagaagcctgtgcttactgttactgctgctgttcttgcttcttggtgtgcccatggcagcgtccaccgaacaatcgccagcgcgactgaacaaggcacacgaggacatcatgcgagatattctgagctcggtgggcagtaccaagaactggaacacctgctcaaatccatgccaatggagtggtgttcattgctcttcagttgcatcctctgcgtttgtcactaggctatccctccccggatgtggcctctccaatgccaccatccttgcgtccatatgcaatcttcataccttgcgatctcttaacctctcgagaaactcgttcaccgatttgccaagccaactctctccgtgccccatgaaggctgaattgcaagtgctggatctcagtagcaatatgctgtctggtcaacttggtgatttcgttggttttcacaagctcgaggttcttgatttgtcctccaactctttaaatggcaatataagtacccagctgagtgatttgccaaaactgagaagcttgaaccttagttccaatggttttgaaggcccagtccctacaagcatcgctacctctctggaagacctcgtgctctcgggtaataatttcagtgatcatattccaatgggtttgttcaggtatggaaatcttactctgttggatctctgccgcaataatctacacggtgatgtcccagatggcttcttgagcttcccaaaactcaggattttggtcctttcagaaaacaacctgacaggaaaaattccacggagcttgctgaatgtcaccacactgtttcggtttggaggtaatcagaataattttgttggctcaattcctcaaggaattaccaggaacattaggatgttggatttgagttacaacatgctcaatggtgatataccctctgaactgctctcacctgatactttggagaccattgacctcactgcaaataggcttgaagggttcatccctgggaatgtttctcggagcctccatagtattcggcttggtcgaaacttgctcggtggaagcatcccagaatcaataggcaatgccattgacttggttaatcttctgttagatggcaataagttggttggatatataccttggcagctcagcagatgcaagaacttggcactcatcgatctgtcatcaaaccaggtgcagggtaatatacctattgggctgggcaaccttgagcagctcgtagtcttgaagctccaaaagaacaatctcagtggagatatcccaagttcattttctgacatgtcagccctggaaatacttaacctgagtcataactcattcactggagaactacctttcacaaattctactcagtcactgaagctctgctacttaggtttgcatggcaacaagctcaatggtgtgattccatcgtcgatcagcttgctgcagtctctgatcaccattgatctggggaacaatgagttgattggaattatccccacaaacattggaacctttctgaagttggagcgtcttgatctttcaaaaaactacttgtcaggtcaggtgccatcctcagttgcaaacctggaaagattaatgtgtctattcctttcagacaataacctttccggaccattgcctgagctacctaaatgggtgatggtcaatgtaactggaaatccaggcatcatactagacacggaagaaaatagaacttcaggcagtatgaaaggctcccaggatgatttcagatcagctatatgggtcgcagcagcttcttttgtacttggattcagcttgtccttctattgggctggaccaggggaaaaattgatgccaaggttggagactcttcactgtgacgattgatgatcattaaatccatacctgtgtaggtgacaaagttgatccatgtattagtaatagttgcagataccttcaagtcactacgagatgtactaggtgacatgaaaaaggattaaaggccattattgtatcatccttaatgtacaaatgctgaggtaagcctaaggttgatttgcatagtcctattgataaacggaggtggctgtttttataggtggttattttcaagttgctttggttactgaattttttcttgaatttatttatgcaaatattgaagtctttagttctttacattattcattctggctgaatcatcacaatccagtcactatattaaacccaattttttattgaagcattgttggtgtacctagccaagaagaattaatttggtagagtttatgagtgagcaagtagaaatattagaaccaaagcaataccaagtttaggaaggaaagatcaagaaaaggaagtagtttagattgcgaagagcagcctcaaatttaagaaaacgtacagttcactggaaaacatgttctttgtcttctgtagatgacaaaagtagtagcaggattttttagaagaggctttgtcctatacgcaccagccatttccattcatttctgtaatcaggccttctccgaacataaaaggaatcacaaacaccacattaaaataattcatgaacgcggattgtgctgtgtctgaagagcatgtgcttcattttatcagatagaaacaaacttttgcatctatcctaaacatgtgcatcactgcatatcaaagggtgattaacagagtagtatgagttgggccagcaaatgttcactggaagtgctcctaaggcagtatgagtctggcttctccatcgttcatctcaaagggtgattaacagagtagtatgagtctggcttctccatcgttcatctctaaggcagtttcttttcagttttcacaagcccttgtcatgtacgctaccacctttgggattgttgtttggtcaggaagccttgttgggtttgttttacagcggaatatgatgcactttgctgaacgatatgaatattcatctgttgttggttgcattgtactactacacaattcttcagccaaattattgtcatagtaatcaacgcatgatccacagatatgttttgctgtaaaagggtgtatcattacttctttagtgcttgtaccgtgtgcagttgtgcatcaatttcaagaacatggactgcttaattaacttttgtcaggcaggagggccattgctggttgcaacttaccttgttctcagaatggttgcaacttaccttgttctcagaatggttgcagctttctttgatcatttggcctccctttatgcattcatctgcacaagcacaacacaggatagagaaataagtggtgactgatgaatgaggaagagcagcaacgcaggggggttaggcggatctgatgcatggtcacgccggccgccggcgtgggccgctccgaggctgccggtcgccggggcggaggcgccgcctcgctgacgagaacccgcgggcgcagagctgggaattcgagagatttgttgcaaacctgattacgaactgaagctttggttttctctgaatcttcggaggtggaagacgcggaggggcgcggggaggcggatttacaccggagacggaggaggcggccagcacgcggcgacggctgtagtggagtcgtcgccggagtttggagcggcggcggcggcggtggatttcgctccgaggaaggaagaaagatgggctgcttgggctgaagcgggaaacctgaaacttgttagcccagaacggggaagcggcccacgtggtgcctatactagttgggcccataacgggattgcggcccatcctacttgggctggaaggaggaattttttttatttataattttttttattaaaagttttacaaaaataattttccaatttgaaaattaacggaagtagtcgcctaccgccctcaaatcgccctcccagagggcggcgaaaatgacatggcagacggccgttcgctctcgggcgacggccgtcaacgaaatttgcaggcggcccccttgccgtcctccgcgagggcgattttgtactgtgcggggggccgcctgcaaatgggcggcgagggggggcatggaattttgcaggcggcccccttgccgccctccgcgagggcgattttgtactgtggggggggccgcctgcaaatgggcggcgagggggcatggaattttgcaggcggcccccttgccgccctccgcgagggcgatttttgcctcaccccctataaagcccagtccctcctctgtaaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattataagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaacagaaagatataaatgtttcaatgcaaaccgaagatgtagagggttctatcaatgcaggggatgttgttggaccatcgatgcaaaatgaggaaaatcaaccaagggaggagcaggctatgggcatggcagatgagggggagagagtcggtataattgttgatgaaatggagagggaagattcggagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattacttcatttttgtttcagcttttgcacgattatgtcaccatgttttaactgcacgtttcctcatcgcaggacctcgtctgccttcgagcgcgttcgtaagcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcaatgaaaacgacgttatataattgacaatctgaaggcaacctcttaatattttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctcgcggtgggcggcaagggggccccctgcaaaattccatgccccctcgccgcccatttgcaggcggccccccgcacagtacaaaatcgccctcgcggagggcggcaagggggccgcctgcaaaattccatgccccctcgccgcccatttgcaggcggccccccgcacagtacaaaatcgccctcgcggagggcggcaagggggccgcctgcaaaattccatgccccccctcgccgcccatttgcaggcggccccccgcacagtacaaaatcgccctcgcggaggacggcaagggggccgcctgcaaatttcgttgacggccgtcgcccgagagcgaacggccgtctgccatgtcattttcgccgccctctgggagggcgatttgagggcggtaggcgactacttccgttaattttcaaaatggaaaattatttttgtaaaacttttaataaaaaaaattataaataaaaaaaattcctggaaggagagagcggcggagtgcgtgcccatactagttgggcccataacgggagtgcggcccacgtctggctcatcctacttgggctggaaggagagagcggcggagtacgtgcggcccataccagttaggctcggaacgtggcttttgatgggcccataccggttcgctgtctgcaagaaccgggtgttttccggtgatcatgtcagcggtagcattcccatgtatggaaatcttcctctcttgcatatctcaactgcctccgtcccagaaaaatctaacctaggccttttttttttttaccaagagagtagtgagcaatgaaagttctaactttttttttaaaaaaaatgttcctctcttggatgacctcagccagaataatctactccagttggtgacgtcccagacgggcttcttgagcttccacaactcaggattttgctccttccatgaaagggcaacctgacaagcaaatttcgtttgcatgtaagaaagaagacttgaggtacgacatgattactggtgccgaatttttttcattaaaacaaaacagaaaacaaattaaatgaataagacacgcatccccatatctaaaaacaatttgagctctaactgtgatggcgggtaatcattttctatctagcctcctctagcagcaaccaatagaggccattgcttcatttatcagaagggtgatctcatgcaccatattcgatcagttttcatggcagtttacatcagaaaaaaaaaactctggacggatctgattctggtgggtacagaagaacaaggttttctacttttcccttcattaactaataatttgatagattttagagggatgcaattaacaatcagcattggtcattttctattccttctatgatgcctaaatatttcccctagggaacacttaatgttcagactgaaaatatcagggtagagtacataatccctcctaagtttgcaaagctacaacagtttatctagaaatacagtattgtagcaaagtaatatttcatcgatcacaccctcataaccagaaaccatatattgataaaaatgtaaactacaaccggcattaattgctcagcaatgattattcagtttatttaacatttgaccacccaatttctcaacttatactgtagatgataagttatccagcgccaagtttccagaagcgatgcatatttagtttagtatgtaacgctattagcatctagtaatgggatcctctagagtcgacctacaggcctgcaagttaacaaggatagagaatatcctacggttataaatatgnnnnnnnnnnnnnnnnnnnnnnnnnnnnnnnnnnnnnnn

SEQ ID NO: 16187 - DNA, 1538 bp, Oryza sativa
  unsure (1)..(1538): unsure at all n locations
nnnnnnnnnnnnnnnnnnnnnnnnnnnnnnnnnnnnnnnnnnnnnnnnnnnnnnnaatatgatcagagcaggattacttactatttaatttatttctgcttttggcttatggagaaaaaatcagttagtggtgagatgatctcctcatacctgatagtatggagttcttttgaaaaggtaaatattgatatcatctttatggtgccttttcacccgtttctttgcaagtcatctcttatcttgaccgttcctccaaaccagctcaaattatttcagtagccacaagcccagtaaaaagggacaaaggctaagccagtgctggtgtcaaatgtgatgccgacggccacaacatcctgaatggatccatctgccaggtgaaatcagtgcaagtcacactgaacggtgagtgttctctgctctgctccattcacacgccataaaaaaatttacagtgtcacacaaggtaaagtggtgaaagcaaacttttgaccccttcctggatgactctttggcatttccctctaatgcaatctctatatatgtataattcacaacttcacataagcaactaactgaaaattgcaccagtgtacttcagatgtaaccagtcgatatcttgaatcgacagagttgccgaggagagtggagagagaactgagaagtagccatggaggtgatcagtcggcaccgcgctcctgctagcagtagcagcctgtgcttgctgtttctgacctttcttctgagcgtgtcgatggctgcggccaccgagaaatcgccaatgcaactgaacaaggcacaagagaacatcatgcgagatatcctgggcttggtcagtagtgccatggattcatctctcaccaagagctggaacaccagctcaaatccgtgcgaatggagtggggttcattgcacttctgctgcatcctcttcttttgtcaccaggctctccctccccggatatggcctctccaatgccaccatccttgcatctatatgccttcttgatacattacactcccttaatctctctagaaactccttcactgacttgccaagccaattctctccttgccccatgaaggcagaattgcaagtgctcgatctcagctacaataggctatccagtcatcttggcaatttctccggttttcatgagctagaggttcttgatttgtccttcaactctttaaatgacaacataagtacccagctgaattatttgccaaaactgagaagcttgaaccttagttccaatggctttgaaggccctatccctacaagcatggttacctctttggaagaactggtgttctccggtaataatttcagtggtagaattccgatgggtttgttcagatatgggaatattactctgttggacctaagccagaataatctagttgatgacgtcccagatggcttcttgagcttcccaaaactcaggattttgctcctttcagaaaacaacctgacagggaaaaatccacagagcttgctgaatgtcaccacaatgtttcggtttgcaagtaatgagaaca

SEQ ID NO: 16188 - DNA, 1681 bp, Oryza sativa
  unsure (1)..(1681): unsure at all n locations
actaaagtactaaacaaagtcccccttttatctttttctctctttttttctggaatagttttgcagaagtctatttcagccaaagtagcaaaaaaaaaggctactaatataagtacaaaaccttacatgcattgcatgcttatattaataaccttataacataacacttgttggtattgcactattgctgcatacaggttagttgcaattttttgctagcaacaacagaatagagtaatctatcactgtcagctgcaggcctgcagccatccaaaaatttggaacaacatgtcctcctgaccaccaagtgatactcatggtcaggtagtcagcattcacatttgtggatgagctgccgtgcaagtaccatcaattcaaatgacagttacagggccagacaatgcttggtatggattggaatttccatagttcgaagtatccaaatcagcaccatctcgcgcagattcaaaacaaaattcatagccaggaaacctagctaatttggccaaatgcagcacgcaccagagagcgttgcgcagcagcggcgccagcgagtaggggagcaaggaacaatcacctgtcacattaggcgagcaccggagacgaaagcgtccgggcagccgtacgccggcggaggcgccgccacccgccgcctcgtcgcctcgtcggagacggcagatgcaaaactagagaaagacaatgctttccgtaacccttaggcgaaggcggaattgagtttctgaggaaggcttccttgggccgaagcgatgccgcagagtatgtgaggcccatataggtgggcccgaacgggataggggagtacgtgtagcccagaatagttgggcctaaacggcagagtggagtattttaggcccatgtatcctggtgaacgaaaaataaaggaaaaagtacaccgaaggtccctgaacttgtcatcgagttaccaaaacgtcctcaaagcgcaaaaccagataccctgcgtcccttaactaatcaaaaccagtcacaaaaggtgcttcggtggttttgacctcggttttatcaaacgtgacggctgagtcagcgtgagacccacgtagaccccacatgtcaggatgccacgtcatctctctttttcccctcttctctcccttcctcctctctctctctctcactcgtctctcgcaggcctgccgacaggtggagaggagaccgacggggtccggcggccggcgagaccggacggcagcctgcacagccatgagccccatcccgaaagccatcagctcctccggcgacatgcggcccacatccgcgtctatcggcggccacctccccgccgcgcgctccatctctatcttctcctccctctcccgccgtgccttgtgcgcctccaccatcgcgcacaggtcgccgtacgctctagttggtgatgtagcgtgcgcaacttatggctctgactggatgcatatactccagcgtgattgattggcgattggcaccaacgagagcgtagcagccggatcaacacgcgcacagtcaagatctgcaattctgaacttctgatgaagttctgaactgatgaattaaaattataacaggggaatctctctgctactcgtagtacccatctaatggcctggttgatctctgtattaggagtnnnnnnnnnnnnnnnnnnnnnnnnnnnnnnnnnnnnnnn

SEQ ID NO: 16189 - DNA, 692 bp, Oryza sativa
gccttccccttgtcaattatataacgtcgttttcattgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggaacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaagccccaataccgaagatcccggttgcaaatctgctggaca

SEQ ID NO: 16190 - DNA, 988 bp, Oryza sativa
gttttcatggcagtttacatcagaaaaaaaaaactctggacggatctgattctggtgggtacagaagaacaaggttttctacttttcccttcattaactaataatttgatagattttagagggatgcaattaacaatcagcattggtcattttctattccttctatgatgcctaaatatttcccctagggaacacttaatgttcagactgaaaatatcagggtagagtacataatccctcctaagtttgcaaagctacaacagtttatctagaaatacagtattgtagcaaagtaatatttcatcgatcacaccctcataaccagaaaccatatattgataaaaatgtaaactacaaccggcattaattgctcagcaatgattattcagtttatttaacatttgaccacccaatttctcaacttatactgtagatgataagttatccagcgccaagtttccagaagcgatgcatatttagtttagtatgtaacgctattagcatctagtaattctaatggtcttagcaactaataactctacacgttaacaaggatagagaatatcctacggttataaatatgatcagagcaggattacttactatttaatttatttctgcttttggcttatggagaaaaaatcagttagtggtgagatgatctcctcatacctgatagtatggagttcttttgaaaaggtaaatattgatatcatctttatggtgccttttcacccgtttctttgcaagtcatctcttatcttgaccgttcctccaaaccagctcaaattatttcagtagccacaagcccagtaaaaagggacaaaggctaagccagtgctggtgtcaaatgtgatgccgacggccacaacatcctgaatggatccatctgccaggtgaaatcagtgcaagtcacactgaacggtgagtgttctctgctctgctccattcacacgccataaaaaaatttacagtgtcacacaaggta

SEQ ID NO: 16191 - DNA, 1432 bp, Oryza sativa
  unsure (1)..(1432): unsure at all n locations
atttcagtggtgtgatcccaccttcgatcagctctctgcagtttctcagcaccctcgatctcgggaacaatcagctgacaggaaccattcctacaatgccaaccaaaatcggtgctcttatactaagtcacaaccatctccaggggtctattccatccagcattggagctttaagtaacttgctgttacttgatctttcagacaaccacttgtccggtcaggtgccatcctcgtttgcaaacctgaagggattgatctacttgtctctttgctataaccagctctctggccccatgcctgagttgcctagaggggtaaaggttgatgtatctggcaatccaggtctcacaatatgtacagaagactctgacagtcaatacaatatggctagcactgaagatgacttcaggtcaactacatgggttgcaacagtttcttttgtagttggcttcatcatctccttctattgggctggtatcaggaagtattgctattgatgtttcttatgatcataaagtagtgtcagtgggaacacgataacaactcaaaacctagctgcatatccctgcaagtcacaagtagaggtattgtaagtttatagatcatgtcagagacaagactattctctcacaagtagggatggattgtacatgaatgtgtgtggaataacaaattactgataataaaaatgaccatgctcagaccgggctttacctcattgtgctagaaagggtgttactctttcacatgagattcacatgaaaaaccatgtcaacatactacatagattcacgataatcagaaactatttcagtatggtgttttttcttaagttcctccaatgtctgtaccaggttgcaagcaaacacttcatacaaaggtacggtcgcacctatggcaatcaaaatatccaaaaagtgtaatgatttcacgaaataaaatgctctaaaaatagaaaaatgcagaagagcaatattcaactaaagtactaaacaaagtcccccttttatctttttctctctttttttctggaatagttttgcagaagtctatttcagccaaagtagcaaaaaaaaaggctactaatataagtacaaaaccttacatgcattgcatgcttatattaataaccttataacataacacttgttggtattgcactattgctgcatacaggttagttgcaattttttgctagcaacaacagaatagagtaatctatcactgtcagctgcaggcctgcagccatccaaaaatttggaacaacatgtcctcctgaccaccaagtgatactcatggtcaggtagtcagcattcacatttgtggatgagctgccgtgcaagtaccatcaattcaaatgacagttacagggccagannnnnnnnnnnnnnnnnnnnnnnnnnnnnnnnnnnnnnnnnnnnnnnnnnnnnnn

SEQ ID NO: 16192 - DNA, 1895 bp, Oryza sativa
  unsure (1)..(1895): unsure at all n locations
nnnnnnnnnnnnnnnnnnnnnnnnnnnnnnnnnnnnnnnnnnnnnnnnnnnnnnntcctcctctctctctctctcactcgtctctcgcaggcctgccgacaggtggagaggagaccgacggggtccggcggccggcgagaccggacggcagcctgcacagccatgagccccatcccgaaagccatcagctcctccggcgacatgcggcccacatccgcgtctatcggcggccacctccccgccgcgcgctccatctctatcttctcctccctctcccgccgtgccttgtgcgcctccaccatcgcgcacaggtcgccgtacgctctagttggtgatgtagcgtgcgcaacttatggctctgactggatgcatatactccagcgtgattgattggcgattggcaccaacgagagcgtagcagccggatcaacacgcgcacagtcaagatctgcaattctgaacttctgatgaagttctgaactgatgaattaaaattataacaggggaatctctctgctactcgtagtacccatctaatggcctggttgatctctgtattaggagtatctgagtatgatgctagtacatctttccagtgatgagtgattgaatgattggctagtacacatacgcgcccatctgatctgatacggccagcagaatccatccatccagaggcagcaccacaaacaaaaggaagcccatatctttgtgttcttcatcgtcctgcacctcactcaatctccatttagatagctgaattgagtgatagacgattgctggatcatctgcagattttacaaagttgcgagtaaaattcagttgtaatctgaactagctacaatattctcctatcttagtgatgcagtttgttgtctcgtccaaattcgcaggagatcgcttcttaatctgcaaattcgtggttagcggttaatgtcttatcaacattttcttgctccccgaccatcccaccaccattcactcctcgccgcacccgcgtcgctggcgaagacaacgactcctgcaagaatcgctccaggaggcactccacataggggtggccgaaggattaggccttgccggcgggggagcaagcgcgcccgcgtaaccgccagcggcacagcagcactgcttcgccggcgcccggcggctcgtcgacctggacctcccagccgcctccggaggctgcacctcgccgacgtgtcgctcggcggccgcttcgccgatcaggtcccgtcgcggctccccgtcctggaggacctgcggctcagccgctgcgccacgggcttcgccgagattgtgtcgcggacgctgacgaggctgatcatccacggcagcggcggcgagctggccgtcacagctcctcggctctcctccctgtgcctcctctctcgctggcctccgccgtaggcctcggagccgccgtgcttccctgcttcagccgcgccgacctcctcctctcccgccgcagagaaaactgagagagagagaggaagggagagaagagggggagagatttgacgtggcatcctgacatgtggggtccacgtgggtcccacgctgactcagtcgccacgtcggataaaaccggcgccaaaaccatctaaggacctattatgaccggttttaattagttgagggacgccggatatctggttttacggttagaggacaattttgtaactcgatgacaagttgagggaccttcggtgtactttttccaaaaataaattggtattgactcaactgccaaacggtttattttttgaaccaattttctgtagaaaagttgtttcatacaatcatattaatctatttttttaaaaaaaaatagctaatgtttatttaattattttttaataagtcgatctgcgtgcggaattcccaatctaatg

SEQ ID NO: 16193 - DNA, 2109 bp, Oryza sativa
ttgatacttacagtcccagtcaacatattgacaactatgttgggcagcagtttatcaggtaggtacaggtaaaaaataaaaaatggaggcctgatgtccctattttacatcttcctagaaaaatcaggtaagctcaaattgcagcacaactgcatgactgcctaaaaatatgtttttttttaaaaaaaaagaaagtttaaaggatgccaccatgtgcaactgcacttcatgttcttttccagaactggtattctggaacaactttctctcaagtttcaactggctttaaggttggaacaatccctgttttcctccatattagagcaatcatcatccagaaaagagttatcaacagataatttcgtcatatgcatagactttgtaaaagctccacctccagttcttcatcatcaagttatgtcatgtctgagcattgtgtgaggcgccaattttccgaaaggttcctagcatgtgatgtcgaagaattatctttatcaggcaatattcaagtctttatatctaactggaaagtcttccattaggtagcgattatcagctttgggaagtgacaatggcaaggtctcttcgtccacagaatctcggtatttcaatggaacgacttcaatcgaaaacctattttggctggccgactttgaacgacttgtgggtaaagatggtccagtacctatttggaaaaatctcattagacatgatgacatagtagtatctatgaaaatgtgtaaaatgacagattgtggcatactgtcagtcatgtcctttgtcttgtggaggagaaatgtcccagaaaggatggtcacaaaaccacacagctccgtgacaatttgtgttggattttgtcgatcccaatcctgcacgtaataaactatgctatcacaaattgaggaaataaactttccataaggcatcaattgtttcttgaagacagcaacattgtgaaagaaaattaaggtgcgtagtgcacggtaacaacattgtgcaaaattataatcacagcagcatagttagcggagcaggacacatgtagaactacacattaagccaaaaaaaaaaattgttcatagctttctgcaacaagaaagttgagtgtataagggctgaatgcctaatggaagtgatagaaaaagcttaccttaaacattatcacactggctaaaattgttagtgaagtaaacatcacgtaatatattggtgagacaactgctgtattaaaggtgtccaatgcctgcaagtcacagagataaaagaattactattgcgttaatgtaataagcccttatgtgatatgttacaataatggtagctcaataagctacatgttctgtactattgcccagagtgacatttcaatgccccagtgacgagccaggaaagttttacagcctgaagccctggaaaaatctaactacgctgagtatatgctgcaattctattttcaatccctacaatgatattaaaattctattgcacattcaccaacgatcccgggtggctccaccactgctatgccctacatattatttgagctagtgaagattcttttaaggacaggtgcgatgaagttgtatgaatgagacaagctgttagaagatcccttaaactcaagttaaatctcttcatgtaccttatttagatagtttatctgggtgctcacacaggtggctacaattagggcaaaagcccatgtctgaggatagaataactggttcactcctgagaatgttaacttcaatgcaatgccgagagcttttacactcatcacctgttaaattctcaccatcagatagaacatggaatttagttgaaacaacagtagaaaaaacaacaaaattgattatgattgggtcatatatttggacaggaagcgtacagtgagagatcctagaagagaacagactccgatgtacaccatgatgtttgtttgtccatgttgagggacaacaaaatatataagcaccagtgctgcggcaactactatagcagcgtagcaaagaaaacctggaaacaaagggaaaacaataatgaatcagacattcagtctagcccgtggaacttacagtaaggctgctgagggctatgttatgaacatat

SEQ ID NO: 16194 - DNA, 6467 bp, Oryza sativa
  unsure (1)..(6467): unsure at all n locations
nnnnnnnnnnnnnnnnnnnnnnnnnnnnnnnnnnnnnnnnnnnnnnnnnnnnnnnnnnnnnnnnnnnccccgtcctggaggacctgcggctcatccgctgcgccacgggcttcgccgagattgtgtcgcggacgctgacgaggctgatcatccacggcagcggcggcgagctggccgtcacagctcctcggctctcctccctgtgcctcctctctcgctggcctccgccgtaggcctcggagccgccgtgcttccctgcttcagccgcgccgacctcctcctctcccgccgcagagaaaactgagagagagagaggaagggagagaagagggggagagatttgacgtggcatcctgacatgtggggtccacgtgggtcccacgctgactcagtcgccacgtcggataaaaccggcgccaaaaccatctaaggacctattatgaccggttttaattagttgagggacgccggatatctggttttacggttagaggacaattttgtaactcgatgacaagttgagggaccttcggtgtactttttccaaaaataaattggtattgactcaactgccaaacggtttattttttgaaccaattttctgtagaaaagttgtttcatacaatcatattaatctatttttttaaaaaaaaatagctaatgtttatttaattattttttaataagtcgatctgcgtgcggaattcccaatctaatgagctgcctaaatgtagaattaaaataatgcaacgcacatgcattttgctagtgaaggagaaaaaatgtaagcttgtaatcatttgcttgctggtttaatcaatggttcagtgaatccctcaaaaaaagaaaaaggaaaatgatttagtgaatcgtttatttgaagacaaaaacgacacaagaaaatttggcagaatgaggcatcatcaacaaattatttacgacagaaatatgaacattagatccaccagttatctgtcaaaaaaaagtatgatttgatacttacagtcccagtcaacatattgacaactatgttgggcagcagttttatcaggtaggtacaggtaaaaaataaaaaatggaggcctgatgtccctattttacatcttcctagaaaaatcaggtaagctcaaattgcagcacaactgcatgactgcctaaaaatatgtttttttttaaaaaaaaagaaagtttaaaggatgccaccatgtgcaactgcacttcatgttcttttccagaactggtattctggaacaactttctctcaagtttcaactggctttaaggttggaacaatccctgttttcctccatattagagcaatcatcatccagaaaagagttatcaacagataatttcgtcatatgcatagactttgtaaaagctccacctccagttcttcatcatcaagttatgtcatgtctgagcattgtgtgaggcgccaattttccgaaaggttcctagcatgtgatgtcgaagaattatctttatcaggcaatattcaagtctttatatctaactggaaagtcttccattaggtagcgattatcagctttgggaagtgacaatggcaaggtctcttcgtccacagaatctcggtatttcaatggaacgacttcaatcgaaaacctattttggctggccgactttgaacgacttgtgggtaaagatggtccagtacctatttggaaaaatctcattagacatgatgacatagtagtatctatgaaaatgtgtaaaatgacagattgtggcatactgtcagtcatgtcctttgtcttgtggaggagaaatgtcccagaaaggatggtcacaaaaccacacagcttcgtgacaatttgtgttggattttgtcgatcccaatccctgcacgtataaactatgctatcacaaattgaagaaataaactttccataaggcatcaatttgttcttgaagacagcaacattgtgaaagaaaattaaggtgcgtagtgcacggtaacaacattgtgcaaaagtataatcacagcagcatagttagcggagcaggacacatgtagaactacacattaagccaaaaaaaaaaattgttcatagctttctgcaacaagaaagttgagtgtataagggctgaatgcctaatggaagtgatagaaaaagcttaccttaaacattatcacactggctaaaattgttagtgaagtaaacatcacgtaatatattggtgagacaactgctgtattaaaggtgtccaatgcctgcaagtcacagagataaaagaattactattgcgttaatgtaataagcccttatgtgatatgttacaataatggtagctcaataagctacatgttctgtactattgcccagagtgacatttcaatgccccagtgacgagccaggaaagttttacagcctgaagccctggaaaaatctaactacgctgagtatatgcggcaattctattttcaatccctacaatgatattaaaattctattgcacattcaccaacgatcccgggtggctccaccactgctatgccctacatattatttgagctagtgaagattcttttaaggacaggtgcgatgaagttgtatgaatgagacaagctgttagaagatcccttaaactcaagttaaatctcttcatgtaccttatttagatagtttatctgggtgctcacacaggtggctacaattagggcaaaagcccatgtctgaggatagaataactggttcactcctgagaatgttaacttcaatgcaatgccgagagcttttacactcatcacctgttaaattctcaccatcagatagaacatggaatttagttgaaacaacagtagaaaaaacaacaaaattgattatgattgggtcatatatttggacaggaagcgtacagtgagagatcctagaagagaacagactccgatgtacaccatgatgtttgtttgtccatgttgagggacaacaaaatatataagcaccagtgctgcggcaactactatagcagcgtagcaaagaaaacctggaaacaaagggaaaacaataatgaatcagacattcagtctagcccgtggaacttacagtaaggctgctgagggctatgttatgaacatattttaatacagtaaatacctggttcagttgcaagatcccaaacttcccttacagaatcgatgttgcgctcctgtggagcatggagtacaattgtgatagatccaactacacaaagaacacaaccaagtatgccaaaggtgtgtagtttctcctgcagaatggcgtgtgcaagtgcagcactgcacaaattgacaaaagattatggttttgatttagcaactagatagcaaaaacaaattttagcaagtttcttatttgattcatctgaaattacctgatgattatactgagtgccccaagaggagtaacaagaatagcaggagcaaatgcataagcagcaaaatttgcaatttctcccacaatcactgttcacaaaggtcatgtaagatgccattagtcaagtttctttccttagtgacattttttgtctaaaaacaaatgaaacagtaacttcagtatattagaaaatacacatttctgttcacttccaaccaataaattccaccaaatatcttactgaaagaataacaaggaaaaacaacagccctaggagcagacagtagtaagagatattcatgctaaggagccatattcaggtgacaggaaacactttgctccgtacaatcacttttcatgccccagttaagctcaaaggttctactaatatctagtcacatacttgtatcaatgtaattatctagaatatcgttttggcttcattgaattcagccccaattaaaaatgtttagtttctcctaatacaaagtaactgtatttatcctgattctcaagacacagaaacatcttattacaggtcttagggagttgacaacttgacatcaacacgagtttacatgaccaactaaccaggtaacagacaataaagatctcatcataatcaaagtgacatcaataaggaaaaaataattgcaggataatgtttgagcagagcaagctatatgttaagatcaaaggggaaaaaactgataaatccaatgatagaaaaaaaatattgtgcacataatgtgacagaaaagaaaggaacattttcaagaagtacaaaatattgtataatttaaaaaggaatcaaatgtggcttactagaaatcatgcctatccaccatagaggctccattaagtaagaaaatcctccatatcctgtttaatgcaaataaagaaaacatgtgacctcctgcattgaaacttgtagagcttgcaacacaatagcttatgaaatatcacacgaataatgaaagtgcattgatctgacatcaatcatttcaggtaagtgcataaggacatagatcaggttgagatgtaagtgcatgttttgttcatacgttaccactaggctgtcctaaagtaagctattatagagtaaagtatcatagtagttggttggtttgataaaatattgcacatgtgacatcgctatcatggaagtgaaccactagccagccaaaaagatgtaatttcgtcctggcatactgaagaaccatatcggttagccactaatcgcagaagcaccacaaccacctagcaatagaaacaacaacccgaaatttgacttgactttactctttccgcaaaccgaatcaaacaaaatccacagtaatcatccatgactcgatcagatacagcttacgatccagaaattcaaaataagcaaagcattggtaccacaagcattgaacatcatcttgtataaatatttaataatggaggacaattgcaaaaggccaaggataccaccacaaaagacaacttttttccggactcactcatcttagttccaataaaaaaaaatctcacaagtaacaaatgccgtatcaaatgaagcaagaaaaaaaaattcttcagagagtcaactgatcctccttgcaagtaaagtaaagatccttagactcgattagaactacttttgcaggtagaactttccagcttccacgcccaaatcattgcaatccttttcacccgcgagaaaagaaaaaagaggaacaaatccatccaatcgcgaagcaaaagatgtctctgacaagattcactacttgaatcaaagctatatttttcacatcagcagaatctacccgccaaaacggcgtcacctgtgcccccaaaaattttcaccttttcccagcctctctctcctctgacgagtgacaaccaaatcaagattctaaagaaaaatttccaaaaaatatttctactcccatgagaaatccccttgactcaatcagactatcaatttactacccaagaacaacaacctcgccaaataaaaaaaataaaaaaccaaagcagaaacagatccctctctctcccaccgagcaaaccaacaaagcaaggaaagaaagctaaccggaaaccgcgtcgccatggaaagcaagatcctccgctcgattccactgcccacgaatccaacccaacccaacccaactcaacccagcgaggaaaccgcgtagaccctaccctccccaaccaccgccaccgacgaacctcacaccggcgcgcggggggagatccaaacacccagagagcacgcgcgcgcgggcggccgcgaactcaccagcgcggacgccggagtcggcggccctcctgagccccatcttcttgacgatgaagctcgccccgatgaaggcgctcgacgacaccgcgaggaccagccccttggcgttgtcggtggacatccccgcgagccccgccgccgcagccgccgacgcgggcgccgccatcgctgccgcagccaccgccgcaacctacacttcgcccccgccactgcacggttactactccaacgccgccgccgccgacgaggaggtcatggaggtggaggaatcggaagcgggagggaaaggtagaagaagaagaagaagaaggtgagaagaagtgggaattttaaggggagggggtgtttttgcgacggggtcctcgaggattcgctttattaccaaatcctattcttttttgggttagacaagtagtatccgtttttagaacggtttacctaaatattaaaaaaaaacttgtctaactcttctagtttttgttggattaggcattgcattctcatctcagatctactatatgtgttgttcttgttgtaaaaaatactatccttttataaattattaaattattgctcgtgttcgcaaataaatacttgctatagtttattttatataagtactcgtacaaacgaagacaccaaaaccacattgggaattgtttatgtaagtgttcgtaaaagactcttgtatgtatgtttaaaattacttatatttgaaatcaaaagtgtaaatttctatgaggcagcttnnnnnnnnnnnnnnnnnnnnnnnnnnnnnnnnnnnnnnnnnnnnnnnnnnn

SEQ ID NO: 16195 - DNA, 1327 bp, Oryza sativa
  unsure (1)..(1327): unsure at all n locations
ttgtgatagatccanctacacaaagaacacaaccaagtatgccaaaggtgtgtagtttctcctgcagaatggcgtgtgcaagtgcagcactgcacaaattgacaaaagattatggttttgatttagcaactagatagcaaaaacaaattttagcaagtttcttatttgattcatctgaaattacctgatgattatactgagtgccccaagaggagtaacaagaatagcaggagcaaatgcataagcagcaaaatttgcaatttctcccacaatcactgttcacaaaggtcatgtaagatgccattagtcaagtttctttccttagtgacattttttgtctaaaaacaaatgaaacagtaacttcagtatattagaaaatacacatttctgttcacttccaaccaataaattccaccaaatatcttactgaaagaataacaaggaaaaacaacagccctaggagcagacagtagtaagagatattcatgctaaggagccatattcaggtgacaggaaacactttgctccgtacaatcacttttcatgccccagttaagctcaaaggttctactaatatctagtcacatacttgtatcaatgtaattatctagaatatcgttttggcttcattgaattcagccccaattaaaaatgtttagtttctcctaatacaaagtaactgtatttatcctgattctcaagacacagaaacatcttattacaggtcttagggagttgacaacttgacatcaacacgagtttacatgaccaactaaccaggtaacagacaataaagatctcatcataatcaaagtgacatcaataaggaaaaaataattgcaggataatgtttgagcagagcaagctatatgttaagatcaaaggggaaaaaactgataaatccaatgatagaaaaaaaatattgtgcacataatgtgacagaaaagaaaggaacattttcaagaagtacaaaatattgtataatttaaaaaggaatcaaatgtggcttactagaaatcatgcctatccaccatagaggctccattaagtaagaaaatcctccatatcctgtttaatgcaaataaagaaaacatgtgacctcctgcattgaaacttgtagagcttgcaacacaatagcttatgaaatatcacacgaataatgaaagtgcattgatctgacatcaatcatttcaggtaagtgcataaggacatagatcaggttgagatgtaagtgcatgttttgttcatacgttaccactaggctgtcctaaagtaagctattatagagnnnnnnnnnnnnnnnnnnnnnnnnnnnnnnnnnnnnnnn

SEQ ID NO: 16196 - DNA, 728 bp, Oryza sativa
aggcctccccctccctcctccggccagatctaggaggaaggcaaggggagccgccaccaccgccccatgccgttgtcgccgccgctgcccccgccggcctccccctccctcctccgaccagatttaggagccggcctcccccctccctcctcctcctcctcctcccttgtcacaccctgaagttctcctcctaagcctaaaatcgaattaataagagaccctaagaaaataccggtgcaaagcaagagttaaccctattaaatcaatgcaaataataatcggaattggcatgtggaatttttcttgagttctacaagtcgaaattcactaacaagatttttagtggaattttcagagctctcgaaataattttaaccaattaaaatcgagcatgcaatattttaaatcccagggaaattcttttcctcctttctttttttccttttccctcattttcctcttcttgggccgtcggcccagtccaccccgccgcgcgcgcgcccttctccttgtgggccggcccaagccgcccctccctctctccccggaacgccgacaggtgggccccacctgtcgggcccgtctccttccaccagccggcgctgccgcgcccgcaaccgccgacgggtacacgcctgcgccttctccgggccacgtcagccacgcctgcgcgtgcgccgcatttcccgcacccacttacccctatctcgcgctcgcgcccgtgcccg

SEQ ID NO: 16197 - DNA, 574 bp, Oryza sativa
  unsure (1)..(574): unsure at all n locations
cctgacaaaaaatgggaatccccttgttccgctcaacttagttatagatttagtaccaagatatttccttttcaaaagatcttgccacacacagtgttcatttattaatttaaacaaccacttacttagtaaacactggttttggatttctaaattatgaataccaagtccccgttgatctttatgctgacaaataacatcccatcttgtcaacctatattattttttatgttcatcaccttgccaaaagaaacgggatctataataatcaatttttcgaagaacccttttaggaatctcaaaaaacgaaatcataaacataactaaacttgataacactgagttaatcaaaaccaatcgcccacctacagacatatgtttacccttccaactactaagttttttctcaattctttgctcaattgttaactaatctttattacaaagctttctaaaatgcataggaataccaagatatctaacatgaaaatctcccagtttgcannnnnnnnnnnnnnnnnnnnnnnnnnnnnnnnnnnnnnnnnnnnnnnnnnnnnnnnnnnnnnnnnnnnnn

SEQ ID NO: 16198 - DNA, 656 bp, Oryza sativa
  unsure (1)..(656): unsure at all n locations
nnnnnnnnnnnnnnnnnnnnnnnnnnnnnnnnnnnnnnnactttgtaaaagctccacctccagttcttcatcatcaagttatgtcatgtctgagcattgtgtgaggcgccaattttccgaaaggttcctagcatgtgatgtcaaagaattatctttatcaggcaatattcaagtctttatatctaactggaaagtcttccattaggtagcgattatcagctttgggaagtgacaatggcaaggtctcttcgtccacagaatctcggtatttcaatggaacgacttcaatcgaaaacctattttggctggccgactttgaacgacttgtgggtaaagatggtccagtacctatttggaaaaatctcattagacatgatgacatagtagtatctatgaaaatgtgtaaaatgacagattgtggcatactgtcagtcatgtcctttgtcttgtggaggagaaatgtcccaaaaggatggtcacaaaaccacacagctccgtgacaatttgtgttggattttgtcgatcccaatcctgcacgtaataaactatgctatcacaaattgaggaaataaactttccataaggcattaattgttctttgaagacagccacattgtgaaagaaaattaaggtgcgttatgcaccgtaacaacatt

SEQ ID NO: 16199 - DNA, 1621 bp, Oryza sativa
  unsure (1)..(1621): unsure at all n locations
nnnnnnnnnnnnnnnnnnnnnnnnnnnnnnnnnnnnnnnccaccatccttgcgtccatatgcaatcttcataccttgcgatctcttaacctctcgagaaactcgttcaccgatttgccaagccaactctctccgtgccccatgaaggctgaattgcaagtgctggatctcagtagcaatatgctgtctggtcaacttggtgatttcgttggttttcacaagctcgaggttcttgatttgtcctccaactctttaaatggcaatataagtacccagctgagtgatttgccaaaactgagaagcttgaaccttagttccaatggttttgaaggcccagtccctacaagcatcgctacctctctggaagacctcgtgctctcgggtaataatttcagtgatcatattccaatgggtttgttcaggtatggaaatcttactctgttggatctctgccgcaataatctacacggtgatgtcccagatggcttcttgagcttcccaaaactcaggattttggtcctttcagaaaacaacctgacaggaaaaattccacggagcttgctgaatgtcaccacactgtttcggtttggaggtaatcagaataattttgttggctcaattcctcaaggaattaccaggaacattaggatgttggatttgagttacaacatgctcaatggtgatataccctctgaactgctctcacctgatactttggagaccattgacctcactgcaaataggcttgaagggttcatccctgggaatgtttctcggagcctccatagtattcggcttggtcgaaacttgctcggggaagcatcccagaatcaataggcaatgccattgacttggttaatcttctgttagatggcaataagttggttggatatataccttggcagctcagcagatgcaagaacttggcactcatcgatctgtcatcaaaccaggtgcagggtaatatacctattgggctgggcaacctgagcagctcgtagtcttaaagctccaaaagaacaatctcagtgaagatatcccaagttcattttctgacatgtcagccctggaaatacttaacctgagtcataactcattcactggagaactacctttcacaaattctactcagtcactgaagctctgctacttaggtttgcatggcaacaagctcaatggtgtgattccatcgtcgatcagcttgctgcagtctctgatcaccattgatctggggaacaatgagttgattggaattatccccacaaacattggaacctttctgaagttggagcgtcttgatctttcaaaaaactacttgtcaggtcaggtgccatcctcagttgcaaacctggaaagattaatgtgtctattcctttcagacaataacctttccggaccattgcctgagctacctaaatgggtgatggtcaatgtaactggaaatccaggcatcatactagacacggaagaaaatagaacttcaggcagtatgaaaggctcccaggatgatttcagatcagctatatgggtcgcagcagcttcttttgtacttggattcagcttgtccttctattgggctggannnnnnnnnnnnnnnnnnnnnnnnnnnnnnnnnnnnnnnn

SEQ ID NO: 16200 - DNA, 1151 bp, Oryza sativa
taggttttgagttgttatcgtgttcccactgacactactttatgatcataagaaacatcaatagcaatatttcctgataccagcccaatagaaggagatgatgaagccaactacaaaagaaactgttgcaacccatgtagttgacctgaagtcatcttcagtgctagccatattgtattgactgtcagagtcttctgtacatattgtgagacctggattgccagatacatcaacctttacccctctaggcaactcaggcatggggccagagagctggttatagcaaagagacaagtagatcaatcccttcaggtttgcaaacgaggatggcacctgaccggacaagtggttgtctgaaagatcaagtaacagcaagttacttaaagctccaatgctggatggaatagacccctggagatggttgtgacttagtataagagcaccgattttggttggcattgtaggaatggttcctgtcagctgattgttcccgagatcgagggtgctgagaaactgcagagagctgatcgaaggtgggatcacaccactgaaattgttgccatgtaaatcgagataacagagcttggacaataggaccaatgttgaaggtatctctccagagaatgagttcgcactaaggttaagtacttccatatttgtcataccagaaaatattcttgggatatatccactgaaattgttggtttggagcttgatgacctcaagttgctgaagatttctcagctcatcagggacaacaccttgcagcttgtttgttgacagatccatgagcaccatgttattgcatttgccgagttgtgagggtataggtccacttagctgattgtcatccaactccaggtaagccaatctgatggcattacctattgattcagggatgctcccgcttagcaagttgcaaccgagtctcaggtggtagaggctccgagagaaattcccaggaatgagcccttcaagcctattggcagtgaggtcaatggtctccaaactatctggtgagaggagatcagagggcatctcaccattgagcatgttgtaactcaaatccaacattctaatgttcttggtgattccttgaggaattgagccagaaagtttgttctcattacttgcaaaccgaaacaatgtgg

SEQ ID NO: 16201 - DNA, 672 bp, Oryza sativa
atatctgccatcaaaataatgtagtctacaaacagttcaagacagtatattatatttgaccatttgtgtatgacactgtcctatccatcatctatgagatcatcacttccaccttctcagaatacaaacaagattacttcaacttttcaagtcatacttccaaaaatacaaaaaaggtgtgggacaaatcttaattcaagatgaactgttcattcgcattttgctttgaaactgcaataggttgcaccctttcttttcatcatttccttgcagtttcagtgtaccaagcagggggcttatatctgcattcatgcataggcgcaagaccatatcaaattcatccaaattctttgctatcctccaatttgaatcgatctgtacatggagtcatcgaatttaattccgccctcatcaccttcatttgcgtcttgaataactctaattaacactgcaacaagaaagagtatcatcatcattcaacaacaaaatttgatctgatgattatctatcaaaacacaaattcaacaatacttgagacatatcgagagataccaaaatttttggtgcaaaattggtatgtcttaccatcagagatattaagaggtatcaaaatttatattaaaaaatagagaaaagttatggtccttaaaaaaatacctcgaggtacctaaa

SEQ ID NO: 16202 - DNA, 682 bp, Oryza sativa
cgaatccgattgtctcaaattagcatgcaagtttttttaaacagatttcttatatgattccttctatattaccaaagtgaagatcttaaaaaccgactcaaatacagatatgtatttcaaaaaccaaacgaacttaaaaactgactcatacacgaatgacgtatcaaaaaaccagcaaaaccatcttcaatttttataatagtagagaagagatatagattaaaaccaaaaaataaaattaaaaccgactcaaacacgaatgacgaactgcgaaaacatcttcaatttttataaccgactcaaacacggatgacgaaccgcaaaaacatcttcaatttttatagtagtagagaagagatgggatgaagcattccagtctttgctcaagagctatagccaattattacaaggttcacacaaaagtaaactcacatagtgagtatgtagccaaagtaataaaaccaaacaaggtaaagatcccacgactactgaattctattggtgaatctccatccgaagttgtcaaagagctgcatgatcatcgactcaagttacgacacacatcttttattagcttgatataatcatcatgccgttttaggtgagcccattcccggagctaatgtgttgtcctgaaaagacatgcaaataaattttgaggtgatctatcaaaaacatttca

SEQ ID NO: 16203 - DNA, 714 bp, Oryza sativa
  unsure (1)..(714): unsure at all n locations
nnnnnnnnnnnnnnnnnnnnnnnnnnnnnnnnnnnnnnnnnnnnnnnnnnnnnnnnnagtagatggataggatgaaggcccggactcgcagcgggatcaacggccggcgacgaaggcgccgaccggagagggcccgcgacagagttggggcgccggcggagggcgcaccggccggccacgcggatggagccggaggtgggcgttaacggcggcgccgtggatggcggacggcggtgctggagctccaggcggcaatccggcgaccacatcgctggcagccacgtcctccgccgtcgctccctacgccgggctcgtcgccgcagccacgtcctccgccgtccgtgcctcacgccacgctgaagctcgtcgccgaagtccgcgatgccgggggatcgttgggggtggccgcgtcggagctcgtcgccggcgaccgcgacctccgtcatccacacccatgccacaccggagctcgtcattgacttagttgcagcagcacgcatgagagagatgtggtagaaagaatagctagatagaagaagagtggattggttggtgtctatcctatcccgtcgggacggtataccggtgtttagcatttccgtattatttactctattgagtaaattacattgctgatacacaaatttggattcagacggcagtggcactccggaacgatctcctacgtgcgcggacagcttgaccatgacccat

SEQ ID NO: 16204 - DNA, 709 bp, Oryza sativa
  unsure (1)..(709): unsure at all n locations
nnnnnnnnnnnnnnnnnnnnnnnnnnnnnnnnnnnnnnntctagtgttgaaaatatttctatgttttctataaatttgatcaaatttataaatatttgactaagaaaacaaaatcaaaatatcttcactactaaagattggaaggctcccgtgtgcctacgaatattactgggtgtttctctaaacacacggtaacttaccgtgcgtagaacaataaattcgggaaccatcaagcacataccgtgtgttaggattcacgggagcaccggaatccaccgctttccatctgtgcgcgtcgagctctattggcgtgtcgaacaaaatgttaccgtgtgaccccagtgcacggtaaaccaccgttctctgttacgaccgccgttagcccgttacatcgggagtgctaccgtgaagtccgaatttttagtacactcggtaagattttcaaccatcctgtgcgttttcatgcaaactcacgggccacacggtaaaccgattaaaccaccgtgtgagcgttaccgtgagctagaactcgataacggcgttgatgtgtgtttttggctggttccgggggttttgagcacacggaagccttcccatctctagtagttagcttataatataaagcgcaagaaacataattttcttaagtggatatatttggatatctgaaatatatgaacatataacatggattatatttgtagggcat

SEQ ID NO: 16205 - DNA, 813 bp, Oryza sativa
  unsure (1)..(813): unsure at all n locations
nnnnnnnnnnnnnnnnnnnnnnnnnnnnnnnnnnnnnnnagcttcttttgtacttggattcatcttgtccttctattgggctggaccaggggaaaaattgatgccaaggttggagactcttcactgtgacgattgatgatcattaaatccatacctgtgtaggtgacaaagttgatccatgtattagtaatagttgcagataccttcaagtcactacgagatgtactaggtgacatgaaaaaggattaaaggccattattgtatcatccttaatgtacaaatgctgaggtaagcctaaggttgatttgcatagtcctattgataaacggaggtggctgtttttataggtggttattttcaagttgctttggttactgaattttttcttgaatttatttatgcaaatattgaagtctttagttctttacattattcattctggctgaatcatcacaatccagtcactatattaaacccaattttttattgaagcattgttggtgtacctagccaagaagaattaatttggtagagtttatgagtgagcaagtagaaatattagaaccaaagcaataccaagtttaggaaggaaagatcaagaaaaggaagtagtttagattgcgaagagcagcctcaaatttaagaaaacgtacagttcactggaaaacatgttctttgtcttctgtagatgacaaaagtagtagcaggattttttagaagaggctttgtcctatacgcaccagccatttccattcattnnnnnnnnnnnnnnnnnnnnnnnnnnnnnnnnnnnnnnnnnnnnnnnnnnnnnnn

SEQ ID NO: 16206 - DNA, 675 bp, Oryza sativa
  unsure (1)..(675): unsure at all n locations
nnnnnnnnnnnnnnnnnnnnnnnnnnnnnnnnnnnnnnnnnnnnnnnnnnnnnnnnnnnnnnnnnncttataccgagggaaggaagaaaaagcaaaacaaaaattgtagctaagaagaaaaaaatacggtggctatacacaactccgattggaggaaaggggcaaaaccacagtacactcccaagaaatctccaaaagcagcaatacccattaaaggccacagatgaccttacgagcggatggactgcagagccagtgagaccgaagagagcgcataatcgaaaaccctggagtcatgttcaaaactgaattttaaaattttgataagatttatctgaattttatcagttgttttcgccttttcggttaatcagtacacttaccatgagtganttttatccagcatcggaattatgaatagcatgctgcataccctgcctgcgttgcatgcttgccaagagtggtcagaaagcatccctgcttcagctccactcctacatacagatgaggttagcttgggaagtttatctgacttctttttgtggcagtcacctctcttgcttgtgctatggggaactagttgcttggtggcagtgtgctactgaagtgaaagcaaagaactacctggagncaaccgatgatccactgatctcggccctttatataattctccaa

SEQ ID NO: 16207 - DNA, 611 bp, Oryza sativa
  unsure (1)..(611): unsure at all n locations
ctttctggaacatttctcctccacaaaccaaaggacatgactgacagtatgccacaatctgtcattttacacattttcatagatactactatgtcatcatgtctaatgagatttttccaaataggtactggaccatctttacccacaagtcgttcaaagtcggccagccaaaataggttttcgattgaagtcgttccattgaaataccgagattctgtggacgaagagaccttgccattgtcacttcccaaagctgataatcgctacctaatggaagactttccagttagatataaagacttgaatattgcctgataaagataattcttcgacatcacatgctaggaacctttcggaaaattggcgcctcacacaatgctcagacatgacataacttgatgatgaagaactggaggtggagcttttacaaagtctatgcatatgacgaaattatctgttgataactcttttctggatgatgattgctctaatatggaggaaaacagggattgttccaaccttaaagccagttgaaacttgagagagnnnnnnnnnnnnnnnnnnnnnnnnnnnnnnnnnnnnnnnnnnnnnnnnnnnnnnnnnnnnnnnnn

SEQ ID NO: 16208 - DNA, 599 bp, Oryza sativa
  unsure (1)..(599): unsure at all n locations
atcgtgtctcacataacatcacacacacaaacgctctgttctgttaggcccaagaaatagaagaagccaagaaacagagatgcggcaatggcggcggcgagctgcttgcctggatctcgatgaggatgatgcagtagaagtagtcgaacgcgatgtcaccgaaggcctggaggctgcgccagaccttctgcatggaggtgacgccggtgccgacgctaatgccggtgaggctgcccatgaacccgccgttgcggacggtctgcgcgatgccgagcgagaggccaatcgtcgaataggtgaaggacatgatggcggcgacgatggacagccaccatatctgatcgaaatccgggatctgtgagaacacgatctgcacgacgccgaacaggatcatgtacgggttgctcgagctcctgcacgggttcttgtgccccttctcgtggaagcaatccgccctcttgatcgccctgctcgatcgaatcaactaagctatcagcaatcacatcatcaatggagtttgcatcgaaaccgaatcgaaacaannnnnnnnnnnnnnnnnnnnnnnnnnnnnnnnnnnnnnnnnnnnnnnnnnnnnnnnn

SEQ ID NO: 16209 - DNA, 9195 bp, Oryza sativa
ccctcatctacacgcgcacgggtgagcgccagctctatcgccgcgcttcggccatggatcccgatcgccatggtccatctctctctctctaatccctctcttctccttgcttagggcacgccgaagctcgtccgctagccgacgccgtcctcccgtggcttgccgtcgccgtccgccatcgcttcgtccgcgccggccaccctcggtgaggcatcccctcccttcttttccccttcctctcctcctagagccgctagccgccgcttcgagtcgtcggccgtcgccttcgactgccgccgccgtttcccgtgccgccggtagccgccgtcgtcgcacgcgtgccgtccccgtttaacccagccggccggtcggctttgatgccgagccgcgccggcggccgcatttatcgccgcccgccgctcctcctctagccgccgctccccgccgccggtcggtcgccttcggtcgccgccttgcgccgctgccgcatgcgcgccgccgccgtgtgagcgccgcgccgccggcgccatggtcgccgccgtctcgcgccgcgcccgcgcgccccggccgcgaggtccccgtcgccgtccgatctacccttgggtagatcggggccgtcggttcggccgccacgtggcgccgccgcccctccttttccccgtgccactgaccagtgggcccgcgagccgccacccctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgttagattccgatccctccgacgctccggtgtacttcgagatagtcgccgaggtccctccagcagcagagcaaggcaagtcatgcttgtcacttgaacatgttgatcccattttgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagattataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccatgattagtctcaccctagagtaatctgttgaacttggatagtttaggtggatggttgggcctgtcgcaacgtgggttagcgttggacagcggagatttaatactgcttaattattacaaccgttttcgcattcaattcctgtttataaatgccagtttttatgcaaatgaaccactctagctcttctttgttaatcccctgcatcatacccctattccggtatgacttgctgagtacagtgggtagtactcagtcttgctctacttttcccaaccccagaggacgggtatgtgtcagatgaaggcttccctgaggagtaggcttcgtccgtgccgtcgaggatgcctgtggagtggtgttcccgctgcagtttagtcaaggcttagctccagtttcttttgttttccgctgcatttctgtaagacctttataatgtttgtaagacgtggatctgtatgtcaacattgtcgtttgtgcaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttccttgcaattggattttgttccgggaaaatggggatctgttcttgtggttcaagggaaaaatcttggtcgctcgtttaaagtgagttttttaaaacgagtcagtctagggttttagtaaaattattgggatttattcgtcagtcagttggggtttgaggggtgaaatgcattaggtcctagctcggtaacatgggttgtaaggtgtttatgctttgttcgttattattattatgtatctaatttcccattattttatcgttatgtgagtcttatttattcgcactcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgattgatttcgtggcagagttggcacgcatgaccctggtggtgggctaccccgacgcgccggagtacacgaccatcccaccgctcagtggcgagcttcctcaccgtgtccgcttggaggtccatggctacgtggggacttgcctcgctaacatggcggttgaggcgtcaggaggcaccgcagatcatgcctgtcaggaggcagcctacttgatgatggccaggttacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggataggatgcactcggacctgcacaaggcgaccaaggccttgaacgatgggaagctcatgaggatcgtcgctctgaaggacgaggtagcgcgcctgaagaaggagaatgctcagttgaagggtcttccagcaccaggaggagtccggatcccactacgccccgtaagaggacgactgcacccgtgcgcatccagcttgcgcccaggaacccacctccaccagcagctccgccagcaccttcagttctgcccgcagttcctgcagctccagcttcagctccagctccagctcccgcgttcactctctccttcgctccagcatcagccgccagaggttcagccagtggtaccggaggttggttgtccgctactcccagtggcagcggcgagactgatctgtcaggctccaggagtcgctcagagggaccaggtgacgagcaggaggacgctttcgactccaccgaccgcaggagccgttccgagcattaggctcgttttcccattagtttatcgattgtctagtttctgcttgttagtttgtgtgtttaggttgcttgtttggggtcagttgacggtcgatatcatgtgcctatgatatggctgtcttaataaggatttttgcttgcctttttaagtgttttaattcagatcagaacaattgcagttttaattcctatataataaagcttagtccttgagcatctgtttttcttcttttccccgtctgctttcccctcaagatggtctacaccaggactggtagccgcgcaacaggcgagggcagcaacggtgaagaacgcgctgatggtgtgcaccccaacggtgattctggcaatggtccgccaccacttcccgagaatccgacccttgcccaagttatggcacatcagactcagatgatggcagccatgatgcagcagatgcagcagcagcaccaacagatgcaccagaggatgatgcagcacgccgaacagcagcaccagcagtttggtccccctccccctcagtccaagttgccggagtttctacgtgtcaggccacccaccttctccagcaccaccaaccctatggaggcaaatgactggctccatgcgatagagaagaagctgaatctcctgcagtgtaatgaccaggagaaagtcgctttcgccacacaccagcttcagggtcctgcgtcagcttggtgggacaaccacatggccacccgcccaccgggtactgaagtcacatgggcagagttctgccgtagctttaggaaggcacaggtgccagatggggtcgtggcacaaaagaagagggaattccgggcgctccaccagggcaacaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgtcaggaggatcagcgcaacaaaatggacaggaaaagaaaggcggcgcagttccggtccaaccaaggtagtcagcaccgaccgcgcttcactcccggacagcagggtggacctaccaccatgatcgtccgccagcaccgcccgttcaaccctagcaacttccaccagggcactagtggcagtcagaaccaccatggaggccagcccaaccgcggtgcagctccacgcccaccgatggcaccggcacagtcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggtcaccgtttctagccaacctcatccttctcgaatccaaagacctagatgtcattcttgggatggattggctgaccaagtttaagggagtcatcgattgtgcgagtcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaagtgttccccgaagacctcaccaccatgccacccaagagggagattgaattccggattgatttggcaccaggaaccgctccaatttacaagagaccatacaggatggcggccaacgaattagcagaggtcaagaagcaagttgatgaacagctgcagaaagggtacatacgaccaagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattcttcatgaatctgatgaacaaagtgttcatggaatttctggacaagtttgttgtggtattcatcgacgacattcttatctattcaaagtccgaggaagaacatgaacaacatctccgtctagtactcgagaagttgaaggagcaccagctatacgccaagttcagcaagtgtgacttctggttgacggaagtcaaatttctgggccatgtcattacagctcagggtgtagcagttgatccatcgaacgtggagtcagttaccaagtggaccccaccgaagacagtgtcgcagattcgaagttttctaggactggctggttattaccgtcgtttcatcgaaaacttctcaagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggtccatgctttgaagatctggaggcactatctgatcggcaaccgctgcgaagtatatacggaccataagagtctgaaatacatcttcacccaaccagacctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcggcaggagtttgagcatctcaacgtgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagaccccgtactccattcatccaggcagcactaaaatgtatcaagacctcaaagagaagttttggtgggtcagcatgaggagagaaatagctgaattcgtcgcactctgcaatgtttgccagcgagtgaaagcagagcaccaaagaccagcaggtttactccaacctcttcaaatcccggaatggaaatgggaggagattggaatggactttataacaggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaattggggacccgtttgaatttcagcacggcctatcacccgcaaactgatggtcagaccgagcgagtcaatcaaatcctggaagatatgttaagagcttgcgctcttgattttggtggagcttgggacaaaagcttaccatatgcggaattctcgtacaacaacagctaccaggccagtctacagatggcaccgtttgaagctctatacggccggaagtgccgcacacctctcttctgggatcagacaggcgaacgtcaactgttcggaacagaagtattagcggaagcagaagagaaagtcagaatcatcagggagagattgaggattgctcagtctcgacagaagagctacgcggataaccgtcgaagggagctaacttttgaggccggagactacgtgtatcttcgtgtcactccgctccggggagtacaccgtttccagacgaaaggcaagttggcaccacgcttcgtgggaccatacaaaattttggaacgaaggggagaagttgcttatcagctagaacttccatccaatatgatcggcatccatgacgtgttccacgtttcccagttaaagaagtgcttaagggtacccgaagaacaggctgattcggaacacattgatatccaggaagacctgacatatgtggagaagccggttcgcatacttgataccagtgaaaggagaaccagaaacaaggtcacccggttttgccgagttcaatggagtcatcattcggaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaattgtaaattacaaatgaccccaagaaaatgcagaggaaatcaggataaaaccctaagaaaacaatgcatataataatcggatttgacatgtggaatttttcttgaattctacatgtcgaaatgcattaacaggatttttagtggaattttcagagctctagaaataattttaaccaattaaaaatcactaaagtgcaatttttaattccagggaaaaccctttttccttttcctttttctttttcttttccctccctttttcctcctttttcttttcggatgggccgccggcccattcccctccttcctccccctcctccttgctgggccggccgcaggccgagggcccagcctggcagccgccgcccgcctcctctctcggggtcgccgacaggtggggcccacctgtcgggtccttcccccacctcccgccgatcccggcgcaccgccgcgccgaaaccgccgccgcgcccacgcctccgtcgctcccgggccacgtcgaccacgcccgcgcgtgcgccgcattccccgcgcccgttcccctccctctcccgc

SEQ ID NO: 16210 - DNA, 9136 bp, Oryza sativa
  unsure (1)..(9136): unsure at all n locations
aaatgccagtttttatgcaaatgcgaccactctagctcttctttgttaatcccctgcatcatacccctattccggtatgacttgctgagtacagtgggtagtactcagtcttgctctacttttcccaaccccagaggacgggtatgtgtcagatgaaggcttccctgaggagtaggcttcgtccgtgccgtcgaggatgcctgtggagtggtgttcccgctgcagtttagtcaaggcttagctccagtttcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacaattaacaggttaatttggagcgtcacgggctagttccggtcgggactagttcggggcgtgacatgaagtctctagaaattggatttgtgtcttttcttttcttttatctattttttcttatgcataatttccttagatttaacctaaaatttaacaccaccatgtgacccaatgaaatggctcgagacgagccagctttagaagatagactagaaaataagcatgtcagttggcacgccaattagtttatagcccgtgtgtattttcttttataaaccatatattcaaaaggattatttaatgggttttaaatttttttgtttgtaaaatgttgtggaacaaatcaaggcagaattctaattagtggtcttgtcatgctgaacgactatttaatttcaggaaatggctaaagatgatatatattagtgaaaaaacttgttttatttatatgcatcattttttatacatgtaagtcatagatgttgcataattagtaggaaatacatatctaaataaatgtgtatttgattacccatttcattttctagaaataaaaataaaggacaccaacatggtaaagatacttatcttgattttatatatccaggatatactaagtgtagatcggttggttacattccgtgtggtggaacatgtctattcaggattaaggtatagagttaacatgtgtggtcttatttacagctatttgttttttcagtggtaggtgatgtaccagccattatcaattcctagatatgaatgatgatttaatcttcaaagggataaatatggattgaaatttcggaacaaatttcggaaatttcagtaattttgcccccaccggcaagcacatatcttgcccgaaactttcctttttttttgcaaatttatgtgaatttggtaaaagtttatttacattcatttaaagttagttaaattttcaaataatttaggccaaaaaataccaaaacttccgaaattttggtgatttcgtgaattcggaacccctggcaaaaaaaaaccctgttcaaaattgaaaaccctgggtacagtagtggtaggatgtgtatgtggtgtgtctataggtatgggtgtacattacatagtagtttcacacgcttagaaattcctttaagaaggacatattacgggaatttaattttgtgtttgtcaaagaatgagaaaaaccaaattatgttaattgtgacaaacatgtaattaggggtgccaaaattacttctttcgtttattttttatgatgttttttatatattcaaatatttttacgaaattatttgtatttatttttccctactatttcttctcctatttctgtttgctcatgggtgcctgttagtggccacgaggagccaacgtccaacgtgcgaattctagcatgaacagcatgaaacgaccagcccaggtacacatgattgggctgtatagcccacagctcggtgtcaacctcagccctgtgcgtgcgcccgttcttccttttttttttcctttttgccggtgttacgtccagtttaaaccgctgctagctagagatgcgtattcacgagtcacttcgcaaaatacggcgccacgtggaccaatcaaacttagaaagaatggccagctttagattagtagactagaaaaaaacacgcgtgcaacactcgatgggccacactatttggtcgtattgagacagaatgatcagtttaacaacaatgcaagttgtagcaaaatactatattgcacaatcatgattactacagcagagtattaaattttaaaaattaatctatggcatataatgtgatatagactgtataatctgaacaaaacacaatagttatcctatatacttatatagttcatctccattaagtgtagttaatgctatttctctcttctcattaacccacatcaccctaattatttctagcctttggatgatagatctatggtctaaattatttcttctttcttctctcttaaaaacatgcaatctcaattacttttaggctcaaaattgtatcaaattgtttttagttttgtacatattatgcaacttaattttccgcagcaacaccgcggggtatgagtatgtgacatattatagacatttgatctggaacttaaataatggaagattttaataaagctccctatcaattttgtattagagtaactggaaagtagatgagtgtaggttcttggtgagtgctaaatacatcaaaaataaattggctggtagatgagaggataacaaaagtatccagcttgggctataaatagcaaaagtcagtgttttcttcttcattattttcccaaaaaaaacaataattagaatccttgtcaaagtatgttactgaggaaccagcaattctttctcatgcagtacttaacacgatgcagtagctaggttgggcaagtatgaggtttctatgtagtgtcaggtatatatgtgaatactacatgtaaacagggtatctggtaggtaaccgtgaaattgaagcagccatataaggtaatacacttgcttgaaatggtgccaagcttatgcacagtacagtagtaggttaattatatgattgaaaaacaaatgattttaaatatgagcaattgtttacctgatcattactgttcggatcttcataagctcttttgcctgacaaactgcttgtctctaaattacatggctcagcttccatgctctgaatatcttggggtggttctcactaaattaagtgtgtcaatttttcactatagtggcagaacagagaaatttaaccaccagataatcacaggaataaatattcgaggaattaaattaagttaaccaactgaaagtctgaaacttcttatgcatgggtagtctcctagtcaatacaagccccaaagctggagctaagcaaagacttaacaaataaaattcaaatgttataattaatcattggcgaaattgtcaaacaaaaacagaaaacctcatgatattggaacttggtagagtaggagtagtaccagcatcactaaacaaaatatattctacaagggttctatcttcttaatgaagatggtcctcattatgcgtttacaataacaaagggacagtaaaacttctttccgaatgcttccattcccaataacttatactataacaaatagtctaatatatatcagtgaagtaacagatctagctggtttttttttaagaatgaaaaatctgcaatatttatatcactaatacatgtgattgccattcactgaactcgccaacgtcgtcctcgcggtgcaggacgtgctcgccgcagagataccggccgaaggccaccgcctcctcctcgtggtgttgtctctgtgcaggacatgcttgccgcagaggtaccggccggaggtcgctacctctttctcccggtggatcagacaagatggagaatgaatgtgaaacaatgacaagagaaaagaggaacgattatagaagatgaagagtgaatcaagattgtagaagaccaagagtcgtgacccttccggaaacatcaggtggctttgcactttttgattttactccaacgtaagattgttttttatattttagtccttctcaagtgtgggagcgcacgcacgaaccacgctgtgccacgtggcatcgctaattgctcgataatttgcacggatttcgatagtaagagattagcgatgcctagaaaatcagcgtgccgggcggcaaatttgcacaaaattcgtgttataagattagagattgaccgcatatatggcaatattgcgtggagaccgattccgtgagtgaagacgtgcgccaacgattaatttatacagaatttgtgttataatattattaaaggttgaccacatgtatggctggttgtggtaaatctggattctttctgatttctctagaatcgtctagtgatattccatattttgcaagggattctttctgatttctctagaatcgtccagtgatatttcatattttgcacggcctgttaattttgcagttgtccgtgggcctattttttagcaaaagtcacgccaacacaagtgcgaggtaggagctctttccggcgaaaccagttaagccacatggcacgagcagctgctagagttttgcacaaatttcggtattagagattagtgatgccttgttgagttccacggtgaaattcgcgagagctgtggtcgatctcgacgagagttcatcactaacacacaactagctattgccgatcgaaatcacaccaactagatgtgcacaaggttgttgtaaagaatcatatttgccgccaagcatcgggaaaatcacaagattttacaagttactccctctataaaaaaaaagtgaatataggactagatatgatatattttagtacaacgaatctgaacaaatgtatgtctagattagttgtactaggatgtatcacagtactagattttttttatgggacatagggagtagttagctacagtggacgatggacagaaaagtagaagaaaaagaagaatggacgagctggggggttttgggacgagctggggtttttgagagagcatcggcgaggagtgccttgcttgtctcggaaatctgcctcacgggcctcctcgtcctgacccaagactaagctgcaaggtgaacagacctctacattcgccacgcactgtatcgcctcaaatactataaggtataaatacttacatgtaatacttctactcgtaatacttctacttatgtttgttggtttcactaacctccaattattttcattgaataataataatatcttttctgatcaatctcattgccatcatcatcacttgtcaaaacagcgactacagaagaacaagcagcatggtgactataagctgaaggaggattattgccttctgtatgttctcctggataaggataactatgcattaaagcataatggcagtaagctcgggcttttcagaagcatggatattttaagcactctgaggaagatggcatattagattggtcctttcgccctgaatactgattgcttgcttccctgaatgactatcaacgcctagtccctgtggacactgtaagtagttctgattatattcatcataacactatttgatcttgtactgtattccgtagtgttagtaagatattatgacctacttgtggttagtggttaatatttaataacagttccaaactatgaatttaagatagtttttttctcagaaatttaattagtggtacattcttattgtgaatatctgggtgatctggtttctgcaccaatcgcaaagttatttaaggacccaaattgtcgatatatatgtggactcatgatgagcttttttgtggaaaatgtcatgctatgtccgctgaatgtaattgtatagcattatttgggtcgtaaaggaaaataaattgaattacacctcaagactataaacgaattatccctcccaaattaaataccaaacatttcacacccctaattcttcaaatggaacgagttacccactaaataaatcaggagtggttttggttctacgtggcagtttattcaacaaaagtaatattttaaaaataggttgacacacatgttagtatattctcccctatattaactattcatatcttcaataccttgcaagtgacgccgggtgaggcgaggttaagcgaaaccaccgtttctccgccacgcggaggaggctatgttggatcgagatatcgactagagggggtgaatatgcgattgttgggttcttaaaatatgaccatattagtaaaactctgntatggattactattactattataaacagatttaggacttggatgttagagtaatattgctttagcacggaggaggctatgttggatcgagatatcgactagaggggatgaatatgcgattgttgggttcttaaatatgaccatatcagtaaaactctactacggattaaccttaccacccataaacagatttaagacttggaaaaaaatcttgctccaaaagcttttaggggtaacctcaccacccataagaacaagtatctacacacaagatgtacccatccaactaaacaacatatcttgtatgcaaccatcccatcctccctttgctacaaccaaccaaacaacattttatcatatccagctatatgtcatgcaagcaatcaaacacctgcatgtgtatcccacatacacgtacttcagcttcacaagatgcaacggctgtaccaacccagccgttcgattaactgatcactcaagcccttgtcactttatcaacgtagattagcacattcatgcaacacaacttcaattgcaaggcccgattagtaacaactttagatatatagctggagttgcaacgatgttagtagtagcatcttaagaagaagctggaggaggaggaggaaatggcacctccaaacggccttgcagcatcaagatgacaccattcatggatggccgagactgcggctccgcttggacgcaccacatggccaccctcaccaccctctccacctttgccgcctccaccgtctcgtcgctgctcatggcgctctttgcctcgctcttcaccagcagccactcgtacgcccactccgccagcgtccgctcctcctcgccgggggcctcctccatctccatgctcctcctgcacgccaccgtctcgagcagcaccacgccgtagctgtacacgtcggccttcaccatcaccgggccggcgccgcggtaccactccgacgcgaggtacccgcgcgtgccacgcacgctggtgaaggtgcgcgtctggtcgggctggagcagcttggccagcccgaagtcggagatcttcgtcgtgccggccgcgtccatcaggatgttctgcggcttcacgtcgcagtggatcacccagctgtcgagctcgtcgtggaggtagtggagaccccgcgccacgtcgagcgcgaccgatatgcgaacaaacgataaagaacaatagatcaatcacagaagacacgagatttaacgtggaaaaccctcccaaaacaggagagaaaaaaccacgggcgctagccagcaaaatatcttcactatatctggggtgaggttacaacgccgcacgacggcttacaagaggtatatatatggtagaaccctaaaagggatgacgatccgtttcgcccaagcctcccggcgacgggcctccgctccactacggcagaagctggcctttattaagtgcaaatgaatttggatcacaactcaacaaactccaccttgagacaaattccttcttgtagcatgaaccaatccttcaccctgaacacaacaaagacaaaaaacactttcggcgccaaatagcctcttgggctaaaccactataccaactaagcttgagcaaagctcaaacttagcaacaggaacatgctttatcatcatatcagcaggattatcatgagtacttatcttgcatacctttagcttaccttgcgcgactacatcgcgaacataatggtacttgatatcaatgtgctttgtcctctcatgaaacatctgatctttagtaaggcatatagcactttgactatcacaaaacaagttaatgcaagaatcaactccacaaagctcagcaaacaatcctttcaaccaaactgattctttacatgcttcagcagtagccatgtattctgcttcagtggtagactgggcaacaacaggctgcaatgttgcattccaactcacagcacaactgccaatggtaaacacataacctgtgagtgaccttctcttatccaaatctgcagcaaaatcagaatccacatattcaacaagccccttatcagtcctgccaaacttcaagcaagcatcagctgtgcctatgaggtacctgaaaatccactgaacagctttccagtgttctttaccaggattagccatgtatctactaaccaaactcatagcatgagataaatctggacgggagcaaactatggcatacatcaaagaacccacagcactagaatatggaactctagacatgtattctacatcctcatcagtactagcacattgtaaagctgataatttaaaatgaggtgcaataggagtactaacaggctttgcatcatgcatgttaaaacgctgaagaaccttcttaatgtagctttgctgactaagaaataacaaaccagaatttctgtctctagtgatttccatacctagaattttcttagcagcaccaagatccttcatatcaaactcactactcaactgtttcttcaatgtagtgatttgttccttgctcttggcagcaatcagcatatcatcaacatataacagcaagtatataggtgatccattaacaaatttaatatacacacagctatcaaattcagacctcttaaagccatgtgacaacataaatgaatcaaaccttttataccattgacgaggagactgtttcaaaccatacaaagatcttttcaacttgcaaacataatcctccttaccaggtactatgaacccttctggctggtccatgtatatctcctcctcaagctctccatgtaaaaatgttgtcttcacatctagatgctcaagctcaagatcatgcatagcaacaatactgaagaatgtgcgaattgaactatgctttacaactggagagaacacatcattataatcaacaccagcaattcgactgaaaccttttgctactaaccttgccttaaacct

SEQ ID NO: 16211 - DNA, 28432 bp, Oryza sativa
cttcatgttaccctgagtacagccatccagcaggttcctcttcatcaattctgtcataccaagttcactcatatgtccaagatgcatatgccacaggttagtcttactaggttcatctttagaaacagcagcagcggtaacaaaaccatgtaatgtacttcctctaaggacatataagtttgtagaattcatatcaccaatcatataaacgagagaacctttcgatacctttacaactccacctgaaccagagtatttgtatccttctgcatcaagtgtgctgagagagatgagatttctcgccatccctggtatgtgtctcacatcttttagcgtgcgtgtcatgccatcatgtatcttgatctgtacggagccaatgcccacaatctcacgtgggttatcatctcccatgcgcacaacatctctattctgcacagacttgtaagaactaaaccaatctctgttaatgcagatatgaaacgaacatgcagtatcaagaatccattcatcataactagcaacacaaccagcaaaaacgacaagacaatctcctgaatcagagttttcagcactggtaacaacagaggccttaccatcagatttccttttctccttattctgtagcttccaacattcttcaatgaagtgatttttctttttgcaatacttacagaactttttacctctggacttggaacggcctctactttggctcttgtcacgatcattgttgtcgttgtaggttctctgctcagatctgcctctgacctgcaatgcttcgcccttagaggacgacgcattagactgaaccatacctttcatcttttccctattttggagcgcctcataaacttccgctagggttagttcatcacggcttaaaagtatggtgtcacgaaaatttgcatatgaactaggcagtgagcataacagtaaaagacctaaatcttcatcatcaaactgtacctccatcgacactaggtcggcaacgatctccttgaagaccgatatatggttcaacacagaaccactctcctacaacttgtgcgagaacaacttcatcttgatatgcatcttactggttagatctttagacatgcaaatcgattccagtttgagccaaagttctgtagcagtcttttcctacaacacttcttgcaaaatatcattagatagatgaagttggatcagcgacagagccttacgatctttccgcttctccatagcggtccattcagtcgatttcttcttcccgaagctttccagcgcctcatcaagatccgaagtttgtgctagaacaacccgcatcttgacttgccacaacgagaatctcgtcttatagtctagcagcggtagatcatacttcatcgacgccatcgcgaaaccctaatgtgggaacaagctctaataccacttgttaggaaacgataagcgaacaaacgataaagaacaatagatcaatcacagaagacacgagatttaacgtggaaaaccctcccaaaacaggagagaaaaaaccacgggcgccagccagcaaaatatctccactatatatggggtgaggttacaacgccgcacggcggcttacaagatgtgtatatatatatatggtggaaccctaaaaaggatgacgatccgtttcgccccaacctcccggcgacgggcctccgctccactacggtagaagctggtctttattaagtgcaattgaatttggatcacaactcaacaggtagccgccgccgccgctgttgaagaggaagtcggcgagggagccgttgctcatgtagtcgtagacgaggaggcggttggcgcccacgtggcgcgcacctccctctggaactcacgctcgccgtcctccaccagcttctccagccgcttcacggcgacggtcctctctccgccgcgccgcagcgtccccttgaacaccgtgccgaacgcgccgcggccgagggggtgtcggaagctgtacgtcgcgtgctccagctcctcgtagctgtacgagcggagcggcgcctcctcgtccagggcctcggcgtcggcgagcgcgacgcgccgtcgcaccatcctctggttcagccagagcagccgcgccgacgcgaggagggcgcacagcgcgacgaacgtcaagagcccgacgcaaaccagcgcgacggtgctcgctcgcctgaagcggtggtggtggtggttgccgccgccgccgccgccgagcgccgggctcgccgctccaccggtcttgacgaacatcgtgtagccgccgcccgcgcggccgtatcgaagtgggagctgttgcttcgtgcacgtgccgtcgttggtgtcgagcagcgcggcgacgcagaagcagtctgacatgcacgccgcctggcagtcggcggcgctcgtgcccgcggccagcaccccgcacggcgtgtccgcccacgacacgttctgcatggtcgccatggacgaaccagggtcggctctctgccccccgtgcactcgccggcgccggagctcgccgtgcacccgcccgcggcgtcgccggcgtcgatcaaatcgaaccccggcgggcacaagcagctgggctgcgcgtcgcgatcaagcacgcagtagctgttgaacccgcaggcgcccttgacatggcaccgatcgctcggcccgatccactcgacgtcggtcttccacccgccgctcgacagcaatccatggcgatacgaacgcaagacgccgtcgggatcaagcgtgacgcggtggtagtgagcttgctctacggcttgagctgcactggccttcgtcaagttcttggtgtagctgccattgttgccgacgaggtagagcacgccgctggcatcgaggcgcaaggtgagggggaagcctatctggaacgtgccggtgtcccagtacgcggcggcggcgacgttcatggtgcccgccgggtacatgacgaggttgccgtcgttgagctggttggtcagccggtacttgccggtggccctgctcgtggcggagacgctcgagaagagctgtgcgccgggggcgaggtcctggccggcgagcagggtgtcggtcggcgccgcgaacgtcgaccacgccaccgtcgcgttcgcggcgtacagcacgaagttgccgtcgtcgcgcatggccgccgcgacggccggctggggcggcgcggcgacggtcctgtcctggccgttcgcgccggtccagagcaggcggccgtcgtaggtgagccgcagcgcgccgccggtggccggcgtgtcgttgcggctcgccgtccacgtcaccgttatgctgggcgcggtggcgagccagacgcccacggcgaggccgccgtcggtggcgtagaagccgaagacaaagtggcccgacggcgaggaccagccggcgccggcgacggcctgcacggaggcgcccgaagtgacatttgtttgggcaaatgacacgctgatgaggataacaaccatgaccggtatcagcaacaacggcaaatctaatggtttggccatggccaagagcaagctaatcaatcaactgattaatcaagccaatctttgctcaattacaagcttcgatcatattcgattacaagtatcatgtagcagtgaatgctgaggtggttgcatacttttcttctgcgatgtgatgtgtataagattgttctattcttagtccaagatttgtgtgttgttttgacctgccaatgttgatttttgtaggtccaaggtgatctatgaaatacactactttagttgagctttccaagctcttaaattattcagttgttctgctaaatggctcgactggtcaatttcatattgacacgcgaggtagatggcgacctgcccgccttgacttgtgtagtactctctgttttcctggttataacaccttttgattttggttaaagtcaaactactttaagtttgactaagtttatagataaatatagtaatgtttataataccaaattagtttcattaaatcaatagttgaatatattttcataatatttttttgttgaaaaagttattatttttttctacaaacataatcaaacttaaagcagtttgactttgacaaaagtcaaaacgtcttataatctgaaacagaggtaacttcaacagcaggtgccatttctttgagtaatggaattcaacttgtataagacggtgcaaaattctattaatagagcaggagaaaaattacaagattacaaccctaggtcatgtcgtaaccagaaaaaaaatagcggcaaacctaacatgcaaatatagtatcagaaaatggcatcattggttagagtgttagacacgagctgattaagctgtaacgatttttttaattgagaagtcgtaacacttattagcgataaaaaataacttttaacgatttttctatatatatccgtagcgatttaaaaggtaatgctgaaaataataggctgaaaaaaatgaaaaatactctaaatgaattcgaaaattaagttttaaaatttaaattttgcctactacttattctttataggttaaacgatgaggccctgattttctaacgctagcagcagtgcatgcatgcaactcacaattatcagccaaatgtctttgctcctctttttttattttcctagatattactccctccgtttctaaatatttaacactgttgactttttagcatatgtttgatcgttcgtcttattaaaaacttttgtgaaatatgtaaaactatatgtatatatataaaaaagtatatataacaatgaatcaaatgataggaaaagaactaataattacttaaagtttttaaataagatgaactgtcagacatattttaaaaagtcaaccgtgtcaaatatttaaaaacggaaacggagggagtattcaaagtcaaatgaaagtttctcatgcataaacaattttgctacctaacgtatatggatctttatcgtcaactccttcataagccctccaatctttagtcaatctaatattaaattgtctcacctgcgtagctcggatatttatgattttttctccacttttatcaaggacaataacgacaatttgattgaacaatggcaatgacaattcactcaaaaactggtttagccaatgtccatatgttgctttcgtagcaactaatggctgatgttgattattgaaattaaagcaagagatgattggtcttcttttgttaaagcaaagcaaattctataaacatatacagttgatccctacctatataattgatccctacctagtttaggtattgctattttcctgacatatggtgcttctacatcaccccatttgtttggaccgttggatcttcattgcaaggttaggatgcaggattggctaacatgtacagtatctgcacgtagcatgtatgggccaacatttagggcacatcgtttgcctagaggctcataagctaaagccaaaatttaaattttaaaacttaattttaaaattgattttgatgtttttttaacatagttttttttcaactttagcttttactccttctgcctcaaaatataagagcttttgggtggatgagacacatcctagtgctacgaatctggacatgagcctatctagattcaaattactaggatgtgtcacattcgcccaaaagcctttatattgtggaacggagggagtaagtcgctaagtacatatatacaaaagttttattcacggatcaatttttaatcattaataagccgtgagcaaccgatggggaccttatgcccaatttagatcacacctataagcccatcagttagagttctgtttgcctcgtcccttcgagtcgttttgcattaaagccgaaagatgccttatcaaaattttggtaaatgtgcaagtttagattgaagccaaaacaattgatagtgaccactgaccatgctcaatttagctacattttagaaacttctttatcatgctactaaatttaaattgttatcaaaccaaatatgagctagctaactttaccttataaaaaaaagtagtatcaaaatttacctatatatataatatcttatgtccatctcccatgtaaatcgcgacctgagctcgaaactcgcctcctgaccgaatctctaaggaggagtgctcacttccccgttagaggagtttcatactcagacatatccattttcctattttccttgattatttatgttcagctgtattcacaagatatggaaagaaaggcgaatgttatcatactattttaatattcaatttgtttgtttttttacttgacacaactatgcatcttttctctccggttagtgtcaaatagtaaaaaaaaaaaagtcgtgtaccacactagaacctaaatagtgcatacttaaatgttaaaatatggttcaatatttcattattatttattttttagcaagtcaaaacttataaattaaacattatctctcgctgcaatacggggagttttatctagtatattcagaaattcacaacagctagccctagccattcatgcaaaatcctttaattagacctggcccagttttatgcatagcctcacacagtccacattctggcccatgataggcccaactgcatttaatttttctctcccaatttggggctcaacattatcaaatatcattgactcattttgtgcttaattatgtgtccttgtgttgtacagttagctcaactaacaacacaccactagcataagccattacatctcttatcattatcattgcctctttggcatgttcatgtctgcatccatggacaagaaaataattgtcttgcatgcttggaattttgcccaacttgtagctaatagcttgatctgttagaggggcaaaaaaaaaaggggagcaatttggaaagatcttatattgatatagtcctccctccgtcccattttaagtgtagctatagttatccgtgtccaaccttgaccgtccgtcttattttaaaaaaaattaaaaaaaatttaaaaacataagtctcgggtaaaatactattcatgttttatcatctcataacaacaaaaatattaattataaaaaaatttcaaataagacggacgattaaaattgaacgcgaaaacttatggttgtacttagacagagggactactacatagcagacgacatgaaatgcttagctttttcagttggcatttcatggttacggaagcacatgggtctcatcaagctgtgcccttaattacctacagattagaggccatggcccttaagtacatggaccatctaattctaagcacatgtgaccccaaaattcggatttcgtacaagcgtgtgaagcttttggtcttgttgttcaacaaccaaataatgatactactagctcaaggttagttagagaaaaagaaagagaaaaatatacagatatatggtttaataatctgtctgaataaacactcaaagcttgctgctttgttcagactctgaccaaaatgtaaacttcaaggtaccagttatttgcatgaacctgacagaaaacttagatgaagcaaatgtcatgtgtactttaccttcagaagatgcaacggcaataccaacacagccatcatcatataatgtatgcttcattaattagtttttagcaagttgacaatttgtttagcaccccaaaacacaacagtgttctttctctagatgcaataagctactaaaaacgacaagcttgtttatgcaaatcttaccagtcgtcacctatttaggcataggtcaactacctaacctacttggtctgctatgattttattatgctgctgtctaccactgctgctgctactatgatactatcccaccatgtgaagaacactgtactccatgccactgtcttatttgttaatcaatccaatttaaaactgctaattgcggtttcatctttccaacttctattgaaaccttagattttattttagataatggaaattaattcagccttagcttcatagaaactacaactgcaactcacattactgtggttgaaaatagaaaattgccaaggaaactaaataaagcgacaccatgtagatggagattatacaatcagaaattaatccttattactaaacattcatccatggtgacgaaaatcttgtatccttgtttccttcaatagggcccagaatcgaaaccaacacttttgatttttattatagtttgtgaaatgagagatagttaattacttggtacatatataatgtgccaataacaaccgtgcacggtaagaacatcccacactggaaccaaactaaagctcaaatcaagatttgtgtagggatttgttgaaatgacaacactaagcgtgcacactaatacccatataaacaagacagtagaatctaaaattttatcctcactaacgatctgctgctcgttaatgggagacaagtgtgcaacacatcacagtttgattacttcatccgaagaaaagtatcatcatctaaaagacacctttttgctctctgctcttgtcttcctccataacaggtagctagcacaaacactcgattctatcaagctgtataattaagcttagtgcctgcattatcttgatctcctcaaaagcaacaccacacgattaaatttgtttagctcatctatctgaacaaacgataaaaaagcaaaagttttgtttaggtagtagtactgaatagaactggttggttgatacaaacaacatgtggtttacgcttatgtactacaccatacaccacatggatcttgacatgttagggaaaatagcttgtagaaactagtagaaagcagtgaacataagctgtcacagtttatctagaagcaattacaataaactgaattcctgaaaaaaaaaaaaggatatttgaactgaataggtcagtgtcccatttcttccttaatgactttgtttgtgctaaacctttcaaaacacaattgacatatcctaaatatatacttcctccgtcccataaaaaactaacttagaataagatatgacttttttatataataaaactgattttttttatgcgactaagagggtatcttaaaagtttgttcggaaggatatcgattttttaagatggccctagctagcccctagttggctaggtaggtcatgtgcaagccgtgcctttttctccttggaaagacatgatccggatccttgtgaaggaggacatacatggccatgttatcatgcttcatgccccgacaagtgggccccaccggatcaaagccatgtcaccagggtccatgatccagtcaaagacagaaaaaaatgaatagtaaaactcatcctctggcctggtccaaagtccaaaccttcggtaggttgtgctaattaatcaagtcagtgtcattaggacatttattaattgcttttctagaatggtgttttcgttacgttgatgttattactgcttcctccgtttcacgatgtaagtcattctagcatttcccacattcatatttgatgctaatgaatctagacatattttatttatatttatatatatatatatatatatatatatatatatatatataatatatatatatatatatatatatatatatatatacattagcatcaatatgaatgtggaaaatgctagtcattatatatatatatatatatatatatatatatatatatatacattagtatcaatatgaatgtggaaaatgctagaatgacttacattgtgaaacgaagggagtactatacaccattaaaaagattctaaattgtgtttattgtaagaataattggggtataaatactgtctccagatggtatcaagcatgaaatgagtagacaacaagacccaccaagaaagctacatcagttgttgggaaccaaaagctttgaggtagaggaattgacacttagcagagacgctatatttttatttttatttttgtttactacctctgtcccaaaataagtgcagccatgagtttccgcgtccaactttaatcgttcgtcttatttaatttttttttataattagtatttttattgttataagatgataaagctttaatagtactttactcgtgacttgtgtttttaatttttttttaaaattttttaaataagacgaatggtcaaatttagacgcagaaaactatggctatacttattttgggacggagggagtagatcataaccgccctaatttactttagcatacgtggagtacaagataatagagttagtaaagatttaccatgccatatttgacattccaagccattagcttccgaaagtcatgttttactgttttcacatggaatgcattataaatagcattcacatttgataaaatttaggacacatattcttgaaagataacaattaattaaacacacaatatttttatatgtatcgcaatagcttccggtgatttcaaagtatatatagtagctatcaacaattcatatgtaagatacttttagaaaaaatgcagtaagatgcaagtcaatcgcatgacaactatattgtagacgccaatatatattgtttgaggcgtggttttaaataggtttaatggtttgcagaatttaattaaactattaatatattatgtaaattcaatatctttcaactgttagttttattgtcatcttatggcattttaagagtttttaagctcgttatattttaaaatatctgtaagggtatagcagtcaacgactgttgactaggcggcaatgacaaaagaaaaaaaagtacactagttataaaaaaagtagaaaaatatttaaagagagaattagtacaaatttttacaagaggaaagaaaatacggtttatacactttacacggaatagtaagaaaggaaaaaaaaaattcccacagtttacatgtagatccaaagtttttacactaaacaccctgaaaacaagttagttatataaaatcaccccctctctctcatttccttccatttcttccatccgtcgccggggctcccgctcctctggtgtcgccgccgcgccgcgccgcgccgcttctcccccccaactcatccgccgctcgcccgacgacctcgtcggcggccggatctactcggcggcggagcgtccaggtccagcgcctggcggagcagagcttcgcgggccagcaagcgagcctctccggcggctgcgcgcttaggcaaggcgagaagctaaggccttgtgcaagaccaggctctcctctccgttctgcgtcgccgtctccgacgactccaccgcgcacgacgagctccaagagagagggggcaaagaggaatcaagagttggaatcggggagcttagcgcacagctttcccaaccccagcgtacggccgcggccgccggctttgtctggcctcttctgctcccctctccttcctgttcggttcggccggatctaggactcggagcagaggctgcgccgcgggcttagtagggatcgatccccggcgagctcgcccccccgtgactcctgcctcctctggtacggcgaaatccaatctgttctactcttcctgctatgttcggtgcggaaaatggctagaaaaggaggctcctctcagtggtttgtgccgtgtggttttagttgaggatgcgaggtttggggggcttagcttgtggcttctgttctgattgcttgattaggttagggcgaattttgtgagggctttgctgtctaagatttgctctgtggtagtggtagtggaatgagaaaaaactatggatgctttcttgttttttttgcttggacttggggttgctattactagcgagcttgtggatgaatgagcgtaggtgaattctagatgcaaggtatgtggaatggtcagggcagagggatttatgcatattgctattatgttgattccacttaggatgtgctggattctcgggataaaattgctatttatgtgtacacctggtaattttcacgatgtgttcttggttattattgctatgttaaaaatggtatgtttatggattttcctttttttcgagctttagctagcaacttttccaagcatgtaggaaggatttataagcgatagagaggatcaggattaacttgtatcatgtagtgctgtagtagtttgtggtcaatataagcgtaggaggagctgctgtgctactcagcagcctgatcctctttatgatgaaggtataatgtgaatttatgcatttcaacagaaccattctatgttgcttctgataactagtgtgtacagttttagagcgcggacctcaaactggttcatattataagatggacaaattagttcacaaacaacttttgtaattgctgtactataatgggatctaactatacctggccatagtcattttaaatcttgctctccagtaacagaagtgtgctttccccataacctccattattgctgccattcaggttcataggatgctgatactttgttcccgtaaccgcatccatgtattttattcacttgttcttatctgtaattttgtttcgttaaaactactgtatcaatttgatgatgcataatgagttttactgagttgctgttaaacatatgcagatttttcaatattaaatcagccttgttattccttcaatagcagttcttggagatcagatgtgataaatatgcacactaaaggggcttcttctgatgttatcagagtaagcacatctagtgcccctagtacatcaagtcacggttctgcacaagatgactgtgattcttcaggtgatgtgtatgtatggggtgaagttatctgtgataactctgtaagaactggttctgatactgtagttaggtcaactgttaggaccgatgtcctgcgacctaagcctttggaatctaatttagtccttgatgcgtatcatgtggattgtggagttaaacattctgctttggtcacaaaaaatggagaagtctttacatggggtgaagaatctggtggacgccttggccatggatcacgagaagattctattcatcctcgtctaattgagtcattagcagtttgcaatgtggatattgttgcttgtggggagttccatacttgtgctgtgacaacagctggggaactgtatacttggggagacggaacacataatgttggacttctaggccatggtaaagatgtaagccactggattccaaaaagaattgcaggagcattggaaggtcttgcagttgcttatgtatcttgtggaacatggcatacagctttgattacaacaatgggccagctatttacctttggtgatggcacatttggagttttaggccatggaaaccgagaaagcatttcatgcccaaaggaggtcgagtctttatcggggttgaaaacgatttctgttgcatgtggtgtatggcacactgctgccattgtagaagttatagtgactcagtcaagttcaagtatatcttctggaaagctcttcacatggggagatggtgataagcatcgacttggtcatggtgacaaagaaccacgactcaagcctacatgtgtggcttcacttattgattatgattttcacaggatagcatgtggccatagtttaactgtgggtctgacaacatctgggaaagttttgagcatgggtaatactgtttatggtcagcttggcaatcctcgttcagatggtaagattccatgtttagttgaagagattgtgggtgaaaatgttgtgcaagttgcctgtggttcctaccatgttgcagttttgacaattaagagcgaggtttttacatggggaaaaggagccaatggaagagtaggtcatggagatatagaggacagaaaaatacctacactggttgaggcattgagagataggtctgttaggcacatagcctgtggagcaaacttcactgctgctatatgccagcataagtgggtctctggagccgagcagtcacagtgtgcttcatgtcgacaaccatttgggttcacccgaaagaggcataattgccataattgtggacttgtccattgtaatgcgtgcacctcgaggaaggctgtcagggcagctttggctcccaatcctgcaaaaccttaccgtgtttgtgattcctgtttcttgaaattgaacaatgctgtagactctagtgcaattagtaaaaagaaagagaatgtacttcgcgaaagcaactctgatggtagattgacaaaagcaattatacctagtaatctggatatgatcagaagtttggatagcaaggcagcaaaacaagggaaaaaaacagatgcactgtcgtttcttcgtacacctcaaatgaattcgcttcttcagcttagagatattgctctatctggtgggcttgatctgaacaggccagttccaagagcagtgcgcacaacggcagttcgatcggtaaatacttctagggctgtttcccctttctctcgcaagcctagtccgccccgttctaccacaccagttccaacaactcatggcctttctattggaaaaggtgctgctgataatcttgcgaaaacaaatgagatgttaaatcaggaagttgaaagactccgtgcacaggtatctctttatttatttatgcacaagtccaactttggtatcctctttattatgcgactaaagaatttaatgctgcacatatttaggttgataacctgaggcaccgatgtgaggttcaagaacttgagttgcagaaatcagccaagaaagtacaagaggccatgacactggttgcagaagaatcttcaaagtccaaagctgcaaaggaagtcataaaatcgctaacagcacaggtaaggcctattagcttattgtcctcctttattcataaaagccatgaaccgatacttaactaattaactgttggacacctgtagtattcctggcctgtgatatattgtggttaagaatgccaagctgtgttcatgcatgttattgtggtggacattttaaatgtataatcattctaccagaaacaaaagggatatgtttcagtttcacttcacttccattttgcaagagtagaaatttcttaatgttatgaattacatgcaatgtcaaaatcaaaatgtacaatacctaaatattcattttatcttttttaaaaaaactttaatctgaaagaaacttctgtatttggcacctaacctctcaaattattcatttgagttttcttcagttaagtatcacttactttagttttgttatggctatccttttccctgatggctattgtctgccttttgcttcggcttgtgcagctcaaggatatggctgaaagactgcctccagatcagggagcctatgatgggaatgaatcaaaacaaatgcattttccaaatggcacagagttgcatgctgctatctactcgagcacgaatggcatccaccagctacaaaatgagtctatcagtgctttaaacacgcctagcctgaacactggaagatccttgcatgcaaatggaatctcaagtcaacataaatcactgggtagtattagtgaacatagtgaagtgagcactcacagccatcgggtttcaagccctcatgacactgaactttcaaatcgaagggcacggatcagtagtgatgagttgttcagtgcaagcggtaaatcggatgatagcaataacagggatgctaggtcccttcaaaatggtgaagatggttacaaacctcgagggacagtatctctgtccagcaaccaagttcaggctgaatggattgaacagtatgaaccaggggtatacattacactgacaacattacgcgatgggactcgggatctgaagcgggtgcgcttcaggtaaatcaggatctctatcctctttcttaaatcctgtcatggtggttagtttttgtttgccccttagtaagatatggtatttcttgactaaaataaaaaaaatgctttcgcaaatcactgtgaacctgacagttggtttatgtttcgggatatgctccacagtataaaacagaatggtgtgttattccttaattcaactatttaatcaacagtcatactatagttgcaatgcaaagtaagctgcctcttggtgtcttttaacacagcaagtgcccctctaggctctaacgtgcactatgaatggtgcagtgtttgtgctgggatcatacaacatttcatacgcaatgcccaattcaactcacttctcttatccttgcagtcgcaggcggttcggggagcatcaagcagagaactggtggaacgagaaccgggagaaggtatatgagaggtacaacgtaagaagttccgaaagagtctcgtcagcagcatcaacccggtcagctcgatgacatgaggatggcatgctgctggactggctgcaggaagaacatgaagtgaggctccaaagccatagttaaagaggccttgcaactatcttttgcaaggccttgaagagaaaaattcttttttggccctgtagtgtggataattattcttatttttcatccatgatcgtccaaggggggattgtggttctctgccccaatgtcactcatgtacatagagctgtcaaacaaatttagggagggctgtgaaactattagggaggactagccctttcttttccctttttgtgtgatgatgaattaattgctgaatggcgaatgcagtgcaggtgtaaagattcagagaaattttctgcaaccattttccatcctttctatgtacatgatgccgatgatacgaagtgaagccttggtagaatttctggaaataaaactgctctaaaactgcaactgtctatgtacatgatgctgatgatatggagtgaagccttggtagaatttctgggaatgaaactgctctaaaactgcaactactagacacttcaaattattttttagaggagccagagaaaaactctcaaatcccgcgggaattgcactgccttcttcagaaaaccccacagtatcttacaaaattcacgtacttcctctatgaaatgtcacatccggtcatcacttatattaggacggaaggagtatgaattttggagaacccctatagaatttggttcaattttctatataattcaactaaatttcctccattcgaaagcagagcaaagttggaggaaagaattccaacaagaatcacgaactagccatacgggccagggcccacaacaaaagtgggccccatccataactgacatcccagaaatggagtaggcttcgtctcctccaccccaccccaacccaacccaacccaacccttctctccacgcaggcgcagcggagtaggtgaaggtgaaggtgaaggtggaggtgaccatgccgccgccgagctcgagggagtcgctctccgtcgccatggccgcccgctcccaatcgcagccgcacctcgacttcccctccctcttctccgacctcacctcgctcctcctccagcacccggcgcctccctcctcctcgtcgtcgcctggccccgtcttctcctcctcatctctctccatccccgcgcccgcgcctgcgtcggctgccgtcgccgccacggcgcctcccaccccgctcgcccgcgcggtcatcggggcgtgcgcgggcgccgcggcgggggccttcacctacgccgctctgctccccatcgacgccgtcaagacccgcatctcaggccggcgccgccgcgggggggtcgtggcaggtgttcctcgacatcctccgaaccgacgggcccctggggctctaccggggcctctccgtcgtcatcctcggttccgcgtcctcctccgccgtctacttcggcacgtgcgagctcgccaagtcgctgctccgcccccacctcccacccttcctcgtgccgccgctcgccggcgccagcggcaacgtctcctcctccgccatcatggtccccaaggagctcatcacccagcgcctccaatccggcgccgccaagggccgctcatggcaggtgctccttcagatcctccagaccgacggattcttcggcctctacgccggctacgccgccaccctcctccgcaacctccccgcgggggtcctcagctactcctccttcgagtacctcaaggcattcaccctcaagcaacgcaacaaggagagcctcacgccgggagagagtgtgctgtgcggcgctctcgcgggggccatatcggcggcgctcaccaccccgctcgacgtcgtcaagacgcgcctcatgaccagggtgggcaccgaggggagccgcaccgtggttgggacaatgcgggaggtcgtcgccgaggaggggctgatgggcttgtcccgggggattggtccgagggtgctgcacagcgcttgcttcgccgcgctgggatactgcgccttcgagacggcgaggcttgcgattctcaaatggtacattgaagactgcgagaggaaggctgcagcggagatgaaggctggagtaggcgctgcttgagtttgtgagtgctctttcaggaaagttggctgttgattttgctcccaatgatgccatgactgtctcaggagttttactgtacctacctagctatgctatgatgcagataatgcacctgcttaaattgtttgaaacttaagcatccttgaaagttcattgtagagttgaagtgcacaagcaataaaatcaggccattgttaatgtatcatcggttttgttcaatagccagctttgttgggcataggttccaggtaatgttttaaagtaacttttcatgcatcaccttttcttttgtgtttgtgcgcgtggttgcaactgaagcttgagaaaatggaagttttttttttcgcattttaagcaccacgaccacacaaacctttactcatgtacagcagtgtaactctccattgctactcattttctgttttgcaccgcattagtagaatatcatgcaacctatttgattcactagctcttagaagaatcagtggtagtttgaaaatttccatttaatggatgttttatgattctaccactactagatgtttcatcagcttcaaattcatagtgatatactgatatgctttgtctcaaaaagaaaaagaaatcatagtgatacgattcaacatgaaactctatataactgctaatgtttgagtgcgaggtctaggcgactaggcatcttattttagtggttgctgttaacttaaagggtacgtttgcctctttagagtaattcaacaatatagtatcagtcacaatgcaataaaaacattgaagtgtctaggcatttagtgtttttctgatgttcagtaatgagttcacagttactgaacatgtttgatcatactgaggtagagtagataagtttgtgggcaccaaatacaagttcacagttacagaacatgtttgatcatactgaggtagagtagataagtttgtgggcaccaaatacaagttcacagttacagaacatgtttgatcatactgaggtagagtagataagtttgtgggcaccagatacaagagtgcaacagaaatttaacgtgctatggttcatcatttgaagtactttctgcagaatgaatctgcagcatctgggtactgagctctgatgtagttctccaggcacttcttgtaggagaaatcttttctggatccatctgaggacatgacatataagcacctacttccatggaatacctgatgcctatcgacctataagcagcaaatgagtcctcatggttttccattttttggttcatctgacgcagaaagattcaagaaggcaagttgcttactgttatgtagttgccgttgccagctatcttcttcttcctctctgggtggtacatgagaacatttgtgacaataaacttctcatcatctggaggaagtttaataccgtccctgcaaaagtattgagagagatggactgtaagggatacaacagaaggaaccacctgggcggtgtttgaacatacacttaacttccatcttatcatctagctatcaacgtactagtggtcgaaaaatgaagatcctagtacttgtgccttttcaagtttattggaccagaaaaatacctcgattcacggatgatcctctttacattctttgtgattggttcgatttgttcaaatatctgctgctccactggtgtaaaagcacaactcgctacctgcctcatactgcctccacggcgtgatgcctctgatttccacactgctctaccaccacctcgattcctattattgccactgcctcggtgtgatgcctctgatttccacactgctctaccaccaccttgattcctattactgctactgcctccacggtgtggtccctctgatttccacacttctctaccaccaccttgaccgcgattattattcttcctgttccattcacctggtcgggatgatcctgcaatggtgaagttctgtgtgcccgcgctatttgaactataccaacttggtttatcatcttgctgtgttgcatctgagttccagttactcttggtcttcagttgccttctctggaacacctgaccagtaaattctactgcagtagaatttggggaactcttggtgtttccttcatgccaatttggcttcctcggatgtttttggccagtgctgtgcatccctgccctcctaccctcagattccatcaggaattcagcttttggtttgtctgtccaggtgatctgattgttttcttctaaacatactttatcctctggaatgcagtcaacatcatataagcagtagttatgaggaacaattgccttatctttagttgctcctgttgtttctactgcttccaagaagtcatacagaccatacccaccaaggatactcttgcttgatgactgaaaagagataagaagttaaagtgatcttcaaaagtctctgtaaatatgagtggtgttaacaagtaaagttgtcaaatgtaccatgttctcgtcattccaaaggatttcaaaagctgaaccagttccaatttctgcattattgccccaagagcaggctgatacaacattgcccagctgatcggagtaggccttcgctgctgccttctcaaagcattgtattgatctctgcaacatgttttgttatatttgaattatgaccaagacttggttctggctcatttaagtgaggatttcaaaagagatgagagtgcatgacttactgatagtgtagcctccataaatggtgcctgaaccttcagagattgacatgtggccttgtagccagagttgttgaagccatgcaaatcgcctgtgcaggtcatgctacttgcaactgttgtcaggtgctcttggagaactgattttgtaatcattccaacagacttggaaaggtactgaaaggagcacaacacgagcaatgtttcagcagaagttacctgaatttcagctaaaaggagaaaggggaataactgaacctgtgtgactttttcgaatgcggaggaaatgccaaacacctgtcggacttgctgtatatcgtacggcatagacctggtggtgtcaatcagatccatcacagggatacatgcattcattgctactccccaggcattgccactctcagcagccgcagcctcttccacagtgatttccagtgccgcctcgcctttctgttctgcaccagagctctggacccaaaatgttgattctggttcaatccttactaggttggcttcctcaactcgaggatcacctgtgaagagaaggtgcagaattgattgtaagtaagcataattgcataggacattttcaccataactgtctggatgttcctcttgcattttttttaccttttataacagtgtctaaaattatagggaaaatggcattagtcatgaaatcgataactcgttcagtagattcagatatatttttagtgatgcttccagggaggaaaaactgcaagcaggaaacctgaaattttttatcatcatctgtatgttggtcgcacaaacttgtgctgcaaagaagaaacacatgatttagtttacaacaaaaatatagtcatacttccttaaaaatattcttttactcaaaatatggatggtagtcccaaatgcataaatacctaatggaagataatatatttactagagtctgaactgtgccataaagaacttagtggtctagcactgaacatatgacttaaattagtagactactggacctgaagttcagaagagcagtaaatctctattcatactgtctttattgctaaaataatagaagtttgaagcaccttgaaatgaaagtgactgtcttcaatatttcacgcatcgatcccttcttctttatgttattcctaaaagtctcctggcatttgtgaagaacactgtccataattgtttcaatctgattcaattgcttctgtaagagcaagagaaacttataatcttagtgattattatgaaatgacatggatataatttgagttactgaatgatagaccttgtcaaggtgaatatggccaacaagatgatgagctgcttgagttgcttgctgttgatacctgaaatattatcccaacaattctgagccttggacaatgtagaactactaaaagggaaatctaagaaactaatgctggactgaactgggcaagttcaacgaaatgctctttttccccaaaaagttcaataggatgccaaatcaatagttgctgtttaattgcttgcatcacatgaaataagttttgtagatttagtttaatttatagtccaggtaaagtagaatcaataggacttgtatctttacattgcagaagcataaataattggaaagcctgatagtacatacttgatggatatctctgtggtacaatcctctaatttgatcctccttaagcaggctcgaattgtgagtgctctctccatgcattcattttcacaagagcactggttcagatacaaaatgacctttcggtgattggcatcagctttagtgcttgccctagtaagcagtacttcctataacagtaacatttagtagtaaaaaaaacatatgaatttagtagtaaaacaaaatttagtagtcaaaattagtaaattacagtctacatatgaattgaactgaggcttggagtgaattgatctggtcagcttctcaccttcatcgagtcccaagaaattatattattctgattaggagccaacactgccttgtaagcagcatttgcaactgcagtggctgccaagataccaacggggtcacctggtgtcacacaatttgatgcatcccttgagccaaactgaagaactaagttaccagacgaagttcttatggatccatcatagcatgctgtgacatctcggagtcttgacatcatgttcttgaaaagactgccaggctccactagccctttagatgcacgcattatcttctccctttcacatatagaatgaagtagagcctcatatgggtttagtccatggtaaattgagctccttacagtaccatattcctctagagggttgcaacaattggtactcccgcaacatctgtgcagagacttagacaggcaatcctccactaacctgctactgtatagtcttccgttgtgttgtagttgaggccccaggaaaccaagctgctccactactttgttcatgttggaatcacttttgggatcaaccaacagtcctatggcagaagaatgggttatgaaatccataattggttccctgtacttatttagctcaagtggattattttgaatagcttccagaattggacttgggacagtgaaatctcccaaatttatgctgaagcaatcaataagcagtgactccattagtaagggctgcagaagattcagaaattctgtggcctcccttggaccctttgtagaaaggatcgatgagatggtggtaccagtagctaaggctccaacagattctctgtcaagatggtctgccagtgttattgcattagatttagtggtctctagaatctgaggaaaggtccagtaaggtccaccaatcagtggcttctgggggtacatccctgatgagaacattgcatttgtaatttggtttgcttccctctcagaatactccctaccacacatgatcttcagagctagtgagaaatcattcttgaactgaaagttcagtttcccattatgggagctcaccagctgcttatccacagtgtatagctctttagcttcagctcttgctgaaagcgaccttgggtagaagatttggacacagtcaccatcaaaatctgctccaagtgggtcacaaatgagtgggttgatctttatggtgtgatcattgtggacttggacatagaaggcctcaactgagtgcttatcagtgcttggtggcctgttgaggaagacaatatccccgtcgaaaacccttctgttgacaatttcgccgaccttcagtatggtgtgtttcttgttcggattgtccttccctgcatccaatgagtacgtgatggaattggcatctgtatatgtcaaacatagtcctttattcatcatgtcttgcaattgagcaatgttgtggtctgtgactttttcttctactgacattctctttgctacttcctcaggcaccccaacaacattgagaccaatgtatggatcaccagtaatcacaccacgggacgagaagcttgagctcttactgatgaacaatgtcttcattttttgcttccattgcattgctgttggttgacttgtgaacgtgtcatctccgtgacccttcaagagacatacgatgatgataaatttatgaagatgcaattatgatgaagaaggtaacctacactttatttactaatgaatcatgtacctttgttgttcctccgaggttgatgtagttggcaacatcgacctgaagatcatctgcaacttgatccacttggatgtttgaggaaccaatccttgaaccacgaatctgctgtatcttacgtagtgctttccttaataagtttgtcgatgtgccctgattaaagaagggacataaatcactaggtcagtggtaatgacatctagaagggaaaaaggcaaaaagaacttctaaacttcaatcaaatagtgtttgattaggatgaacttactgaacagctgaatgtatttccatccaaaacattggaaaccctcaggcagtttggtgggacgcagagatagctcagtataaaaccatcctgaggaatatatcccctaacagaaagccaccttcttgtttcttcagggatcttctttatgatgttttggacctgacaaacagaagaataaaatgcgaagggggacagatagtaagataaatgtgtgcaacaatttctatatgcaaagctactctatgtaagttctgaaacttatgcatttatctttgctttgttccaataggggtggctttcgcaacatgagcaagagtacctcttctgggagcaaaggacgacaatgagaggtacccctcgtgcaactgccaaactgatcaaggaagctccagaatccctcttccagttctttcttgataggtgctctcaactccaagccacgggcaccattggacttcttgacttctgcaacgcacagcggtgggagctcctggaataagatggattcaagaactaatgatgcctgtttgcattacttggcttttcacagttgagggaaaagcaacattgacccctaagaaacataaatggatgatcagctgcaaattacctgacagtgtgaacatgaagtgaatttgcttcccttaagagtgctcttctgtttgagttgttaagtgcagaaacatgtgttagcgatgacaatatagtatggcttatcgcatatgctgatgatatgcctgagcatggtttttgcagttgaacctttctgttcttgatcttgaggcatctcaggcatattaagttgagtatctggctcagctcggtgacatggctcgggtggaagatgggcatgggcagctcaatgaatctgaagtgaccttggaatcaatcatcaaaaaatgcattttatttccatcaaaggtacacaacagagtgaagagtgagcactgtctctgaaactgttctttgcaatatcttttcttttttttttccagaaacagattttcagacatcatgccatgcaaaataaacagtgaataacttcacaaaacttgctttcatttgcacccgtttggaaatctgaaagttattgtccaatgcaggatcgcacaaaagagattgcgactgactagcataccctcgcattcttcgatggcgttgctgccacacgactgacagctgccgacttgcagaggcaggcccaagtatggattgttcagcagctggctttgatgcgtgatggggatcggcttctcgagctcgttcaccggctgcgccttcagctgccgaatacacaggagtcacagcaatgggtaaaagaatatgataccaaataccattggcaggtgaaggtgatgatggtttgacagcttacaatttcctcgttgctggtgatactcaggttgatgcgtctgatcgaggcctcggggatcatggcagtagcagcagatgttggatcaggatgaccttccatttctgtacgactgtacctgtggaggcagaggttagtatgcaatcactgaaaccaaatggttcgtatgatcagtgtcatgtccaaccaaaaggagaatcaaacaactagatatcaaccgaagaaccctagaacatacctttgtttctttttttttaatatggttatggatggacaagatcaagagcttgctagtcgatcaatggcgacctcagatgccaaacaaacacaggaatgaagttttttgggaactgtattatctactggtttttactgtgttatacaaacctcttctgtaactgtaaccaaccggtagccacccaaagtgtaagtgtcaagtattgagaaagctcagaactcagaaggcaggaggcctctcttttactcactcaatactcaacagtcaacacgcatcttttactctctctctctctccatccaactttggtatcttgcctactccatatgttctatctactttgtgaataagggtgaggcctacatcactgtgtattttagttgttgttgtaattacaatggtgaaagaagaaaacagtaaaaaaatgtaaatactccatgtggggcttcttttttttaccgacgtttaatttccatcctttcaattctgaaagttttacctaccaaagcagtataaaaatctgtaaatactccacgtgggaccaatattatattttaaataatctaaatatttaacatcaaagttgtataattgtatttgttatcaagagcactttactaatatttcatttcctctatcctaaaatataaccatctggcattttaattttattttagaatatatcaattaatcatctcttatttcattccacctctctttaaattctgcgaaaatcagtactcatttaatttcaccattccttaatccccatgaaaaccatcacttatttaatatcacttctctccttaatcccagtaaaaatcatgtcttatttaatttcacctccatccccgtaaaaaaaaaggaagtacagaaatgctcatatttttttaacctagcgagtacatttaaataagaaatagatcaataccccgctgcgttgctgcgggaaattaagttatataatatatacaaatatgatgcaatatgattattaaaactaaaacaaattgatacttatgaattttgagtctataaattattgagattgtatggtgttatgagagaagaaaaaaaagacaatttgaaccataaatccatcatccaatggctaaaaataattcggatgatgtggcttaataagagaaaagagaaatagcaataactatatttagtggggataaacttacaagtatacagaggattactttctttccgtgctagttcgatcaccccttaagcaaaggccgtaccaaaacctccatcattctaaattaatcattactatcgattaatatgcttcgtcgcttcttatctaataaaaatcacttcgcattgggttgaatcaatagaaattaattttaaatgttgtatgggttgaatcaatagaaattaatctttggttggttgcatgtataaagttacatatatgcagtacatatttactcttgtataaataaacaaagaaccattgtgtcatatgatgattatttttttaaaaaaacacaaataataggtgatgatcaaactgatggggggagtaactgtcaaagctcatcaatgtccctcgcaaaaaaaaaaaaaaaaaaaaaaagctcatcgatgtcaccatttagggagaagtatacccaaggtccctcaacttgtcataaaaaacatcctcagaccgcaaaatcatatatgcgaggtatcttaactatacaaaaccggtcacctgagattctttggtggttttgaccccggttttgatacgtggcagctgagtcagcatgagacccacgtgtcagcgtgccacgtcaactttcccctttcttttttctcttcttttttttt

SEQ ID NO: 16212 - DNA, 1512 bp, Oryza sativa
ggcaggcggccgcgcacgcggcggccggcggatggggagcgacggccagtaggcggaggcggtggaggtggcggccctcctagcggcgggcatggtggtcgtcggcgtcggcgtgccccgcgcccgctcctcccaatgggatcctctcctcctcgtcggcgtcgtcatccccctcgtccccgccggatcccgccgcggcgcggtggccggcgtcctccttctcctccgccgccgcatcgagggcgtgcccctcttctccctcccagccacctctgcccgggtcggcacgcacgcctccagcactttcaactccttctggccatcgtcgtcggtgcgtgaaatttcgacaatttgtacctgtttttctttcttttgttcagtttcttgtttcgagatgatgaactggtttcactgagatgatgcttggtttgatctctggtgatgcagtgctttcggtgttgagcattgctggatcagtcgccattgtttacctcatgtacagatgtgtcaagaagaatggcctcccggccgtcaatatcaacaccaacacgagcttcgcgccggggacggcccggcggcgatgtacacggtggtgccggactcccagatacgcaacgccaccatcgagaggtttcttaaagagatcgccggcgagaagcccatccggttcacggcgcagcagttggccggattcacgaacaactacttggctcggctcggcgccggcggtttcggcaccgtgtacaagggcatgctcccgaacggtcacatggtcggccgctgcgcgctcggccgcctgccgccaccgccgctccgcgcctccgctccattccgcttcaccggccgccgcgcgctcgcacgccgcctccgccggccgccgctcagccccgctcgtcgcccggccgtctgctccctacctgtcggttggcctgcgatagaagagtggcagagagagagagaggggaggaagggaaagaagagaggaaagggaagttgatgtggcatgctgacatgtggggcccacgtgggtcccacgcccacgtaggctaaaaccgggttaaaatcaccgaaggacctgatatggccggttttgtatagttaagggacgccgaatatctggttttatggttcgaggatgtttctgtatcccgatgacaagttgagggaccttcggtgtactttttcccaccatttactgccaaggctgggtgcggaataagtacatatgaggtcccttaactttgtcaatgaatccgattttcgtccttcaaccagaaaaccagatacaacgggtttctcaactatcaaaaccagtgcagatgaggcccctcggcggttttgagggtggttttggctgacgtggcgcctacgtggcaaatttgacttagtcttcttttgatgtggcattgacgtggcgccatacgtggcaatttgatccggaaaaataataaacttcatgggacccacatgtcagtctcacacataaatcaataaaagaatggtggggcccac

SEQ ID NO: 16213 - DNA, 8583 bp, Oryza sativa
gccacgtatgcgccatgtcagcgaaaaccactctcaaaaccgtcgagggacctcatatgcactggttttgatagttgagggacccgtttatctggttttttggttgaaggacgaaaatcgtactcgttgacaagttaagggacctcagatgaacttattccctggtgtgccgatggcctgttgctctgcttggcccactaatgaacttgtatgggcccaattatagtggcagtaatagttgggcctaattgtagtgacagtaataactgggccaaattttagtggcagtaatattttgggcccaattatagtggcagtaaaaaaaaaatgggagaattgcatatttgccactactttcaccccctaactcaaaatagccattataaaatcatgaattgcaaatttaccactgaaaacagcatgagcagattccgtatgccattgccgttccaatttgtacgagtaagaggacaaaaataattcatgaaattaaattaaaaaacaaggcaacgtgataagaccatgttgcccttgccagattcgaccttatccgctttcttccccaactctaccgcatcagaaacatctgctcgaacttctctcctctcccacgatgaaccctacaagcccaatcctctcatcccttcattcaaatcaggagcaaatcgatcaaaaatcggtcacttgggagtagtagatgccaatgaaagaggtgcagatttcaacgagtagtgcagtaaggcaagcagcggcttgcggcgcgcggctccggcaggtgtcggcgtcgactgccgcgcttgcggctgcttggcgacggctacagcaggctgcatcaggctgcggagggtgtcggcgttgagtgcggtgggctgcggcgtcggctgcttcaggcggtgtggtggctacgatgggcagtagcagaaagaaacgtatatactctatactgaaatggttgtgacctgctatctctgtctatcgtgtaggcatttagatgtagattttcatctgttccttgttgatctactagaatatttctccttttttttttgcttatcctgtaggaatggccgaggttcttgacagccattgttagggttaagtcttatttcaccacatcgtttttttctttttgtcaaagggcatatgttaaaggaaacaatgtcaaaatttctatcgaaatgatgctagttgactatgttcttgcttgctgcctcaaatattgttttattgatgccaaaatgttgtcaatttcacaatttcatgggcaagggcatccttgtcctaattttcatgaaaaccagccatctaacggtgttagtctaagctgttagtccagtggcagttatgttagtttcatactgtttttgatggcaaatttacaattatagtttttttagtggcagatccacaatacctgatcaatccagtggcaaatatgcaattggcccaaaaaaaatctctgtgcgtgtgactataattacgtggctttccttcctgaagccgtcctcatcgtcatcatctcgtcccccctcttcccggcgcggcggttgctctccagccatggccgccgccgccgccgccgccgtcgcctgcggcatgtctacgtccttcctcatccgcctctcgccttcgccgccggcgtcttcccacgtgcctctccctcggtctccggcttcgtcggcgcgcccgcggcgagcgtcttccgtctccctctccaccgcgcctaggccgagggcacgcgccgccggctccgactctccctccaactttgggtacgtgattctgcactcggttggctccacggggtgttgttcttcgtggctgcggttgacgtgatgttttgtggtctcccccattgtgtttgtgccaatgcgtggtaacaatggcggagaactcgtatgtctgcgagtagcccccagcttttggccggccgccatcgccctgagacatggtcagcgcgtgcgagatgcgagatatgagaaggagcagtgtcgaccacccgagtcttatccgagcggaggccggaggcctgaagctttgggcggcgagttggccaccgaggttcgtggcggtgtgtgcggcggccgtacggggtggcacaccggcgtgtggaggggagcgaaatactgtaagaaatagaggacgaggcatttccccaaatattgcggtatttgctagattagtgtcttggagttggatgctaaattttgggtaggatatgttcagatatgtcagagaaattacaatagcgctctagcagaatctgtagactagtagcatgattccccttttacagtatcactatggaatggaagaattttctgttaaaattttacttctaaaatctcaatccaagaaatttacataggaattagtcttcagtcttttcttagtgtagttcctattgatgtcctattacttgtgattttttttcctgcgctgcgcgtttaatgttcaataaaatgaattttaatctattgccgatgcaatcttgaatggcgttggcactcaccgcgcctcattttccatacatcctctgccagcgacgacgccgtgccacacatcacaaggattagagattgtaatagatagtaagggtgtcactactgagttaacaaggatgaactagtggctatttagctgttaagtggcccaactaagacaaagacactatcatctctgaaaaaagcggtgtattatatatgagcacctttaaatactattgtgatgtcttcaagtcaaacttaaattatttgtgtgtgcaatacatctgcatggttcatgttcacaaatactaaactatgactgtgacttttccttatattctgttggaattggcagcttgccatcaaaatctgaggtcaattctgtaacaatgtatgttctttcaaattctgtagtagtttctttctgatgttgaatacagtctaattatggagtgagttattcctgataacgcatctccttttatttgacagaggtcaaacatcactgatgccaccattcagccttatgcttgatgaaggctctagatctaaaaagccatatagatggcaaagggtgttgcttaaagtaagtggggaggctcttgctggagatcacacagaaaatattgatccaaaggtgaggttgcttttagtggagcattatcaaatttaaaatactgaatatttgatggaacaggtcatgtaagtgtgtaatgttgttgcagatcacgatggcaattgcaagagaggttgcttctgtcaccagactaggtgtagaggtgtgccagtgcctttcattcttttattgcttatttacccgattaactgtttgaagattgaaattaaatcaagtgaaacataattaggcatgtacatagtagacatttaaagttcaacaactaaaccgccctgtgttccaacgaagtggtattatgctatgtgtatgttcctcttgtcttctctattgtagaaacatatgctgtacattaaagatcgggaacccttgcaggttgctattgttgttggtggcggcaatatcttccgcggggcctcttgggctggatgtagtggactcgaccgctcatcagcagattacattgggtatgatgttcagttttctaatgtctttcataattgaaccatcgtaacatcctgtggttggcaatcgagaatgcattaaatgaagtggaagcgccatgagggttaacctaataatgacacaagaacacccaactcggcatgccttagtagttgcatgcaaccatgcaaatatgctaatttatgtaatccatgctaacttttttttttggctatttaaacatctataataccacgcctgattgtgcctatcggcccatcacgtagaacacatctaaatttcatagaacaaaattccataacaaatttccaagcagaatagtgtactgagtgtaaacttatagttcgattttacaaaccatacaatcaataagtatatactgttctctgtaagtgcaaacttacatgtaagtatttaacatatggtctatatcctttgcccataacgtttttaaaaatgttttttaggttttgttttaaaaaaaagaagacatcattcctgttataagtgatttcataatttctcagcataaaatagttcaccactttatcttactcttttcctaattcagcatgttggctactgtgatgaatgccatatttcttcaagcaacaatggagagcattggaataccaacccgtgtccaaactgcatttcgtatgtcagaagttgcagaaccatacatacgccgaagagctgtcaggcatttagagaaaggaagagttgttatatttgctgctggtacagggaacccattctttacaactgatacagctgctgctcttcgttgtgcagaaagtgagtttatcctccgtttctcactaatgaactggtgtaattgtaatcataaaatctcaacaaaagtagtattggagatacgtgaatacttttatattttaaagccaagtgcttataagctgcaatttcatgtcgtatatttaacaatatatagtactgcaaaacattcaaggtacttttgcgagtttgtcatttatgttagtcatcatgcccctgtcagttgctggtaatagaactagagttctacccacaatagctcgtaatgttagtagcctcacctctgagtttatcccatgaattcatgaagacccttgtgcgccctaaatggttaagctagacagttaggctagacaaggatcgatcatttattttcaaccttgcttcccagaaactagagacatgatgcagagattgttatacatgccatgttagggtgtgtttaactattctatttcacaagaaatcattagtcacagtttccattatgcatgtagaatcattttatcatgaattgagtttgaacttgtctttctataatgatttctcaaataaacatcattgtctcattttgtttattccatcttacaatggctttttttctttcattttgcagtcaatgcagaggtagtacttaaggcaacaaatgttgacggtgtgtacgacgcagaccccaagcgtaacccaaatgcccgccttcttgaggctgtgagctaccatgaggtgcaaacaagagacctctcagtaatggacatgactgccattacgctatgccaagaaaacaacattcctggtaaggagagagctgtcagtttctgagacttgatacagtgtttgatttgcattctttttaatttggcctgtaatcttgcagttgtcgtgtttaatttgcaaaaacctggaaatattgcgaaagctattgttggtgagaaggttggcacgtttataggctgcacaaaagatcaggaccagattgtggggaatgcactggatcaagaaagaagattggtgaacgagttatgatttcactggagctctctgtcgctagctgtgtagctgcattgcctattgcttggtaacatgtggatctctagagtttttaggctagaatagcttatccaaatcctggttccttgtacaacctttgagcaaaaataaaaaaaccaatggtaacagagattttccagctgatatagctgctatgttgtcatactatgtacaatggaatctagagcaatctgataaatcacatttatatcttaaaatcattgcatgtggcatgtatgatgtcttcacctaaaaacagtttcttccttacattcatgtgcagctgaagaaaaaagttagaaaagcgactacggagaaagcgagggatctaatgaaaagttcaaaaccgtagtggacaaatctggaagatggtaaaaactgcctctaagcacaataggaaatcaattaatgaaattaatataaggacttgatcattttgttgtccaaatcaaccataccaaattttgatactccctctggttctatattaattgacgttttgaacaaggttgagattaaacttttataactttgaccatcaataactttaaaaatatttagtttaaagaaactagaaaaacatatatagatttgtctttcaaaacactgtaataaaagtaaacatgcatttatttattgtatatattataatagaaaaataaggttaaaggtatatcttgtagagcgtgtcattgtccaaagcgtcaattaaaatgaaactggaggtagtacataataataaaaaagatagtgttgtctttgtttggtttaatatctttaccaaattttccgtttagaaataccaaaatttgttaaggtactaacagtacaaatgtgtttagtttgttacctcgataataccaagatttaacaaagttgaaagcggtcataaactgaacagtacctaaaatgaggggggaaatagggaaagaaaaagaggatcagacaaggaagaaagaatggaagggtggtgagaaaatcccaattagcaacggtcacctgatcacctcgggaggctattacactaaccattaaccaacctcgcgtcatctctcccatctcccatattcccatccaagagtagaggagagaagagaagacgcagctcacgcgcgaggcgagtgagcccaccaccgcccccctcctcctcgccaccgccacgtcatctccccaccctcctcctcttcctccctccgccgccatgggccgccgcgcgctgccgccgtcgtcgtcgtcgtcgtcgtcgtcgtcgacgacgaccacctcgccggagctgcggcggaagcgcacggccgcgccgcccccgccgccgtcgccgcggaggtaccgctcgatctccgacgtcatgcgccgctcgctgcccgtcgacgcggcgccccccgtggcgcgcgcctacgagagcacgcggtgcgacgtgtgcgggtccggggagcgggacgaggagctgctgctgtgcgacggctgcgaccgcggccgccacaccttctgcctccgccccatcgccgccagggtccccaccggcccctggttctgcccgccatgcgccccgcgctccaagcccgtcaaaagtgcgtcgccgtgcgtgccgccacgcacgatctcgcccatttccatccttttctaatttctcaccccctttttcttttctctcgtgcttcggattgttcttatctcactgtttttctccttgtgtcttcggtggcgtggggggtgttagggttcccgatgactcagacgaagatcgttgatttcttccggattcagaagggcgcagaggatgccgaggcggagaaatatgggctttttcaaggtaattttgcatttgggaaaagtgcaccattgttttataagtctgaattgtgataccattttgattgcttggagtgccttactgatgatacagtggttagcttatggataggattccatcttataatttgtgtggcttaagcttttgtagtagtggtgacaaatagcgacattcatgctactgctaattatctgattatcagtatgatctacctggttaggaccgttcagtagcagagattctgctattatgcaacctatatttttattatgcgtaatgtaggtcaattctagtgtagttttccaattacgctttgtaggacttgtggtgatggtgagaaatagccacatgataagcgtactgtgctacagctgaatatataagtggatatatccgggcttgtccagatttattcctagaagttgattctttttgggacggagggtgtatccaataggagcgtttagtagtacagattctgttagtatgcaatttatatttctgtgcacaatgtacgttaactctagagttgttttggctgcatatctagttagtagatgcaataggtgggaatagacaatactgtgaccctccaatatgaaatgctcacttacgtctccactggaaatacgcgggaaagctctccctgctgtaaataggtggggaagttatattgagcaagcatttaagatgtaataatggtgcatgcattcgtaatagcaacaagaatgtgtaattttgcaattgggagaggtcatgaaaagtgcaccattgtacaagtctgaattgggagaccattatgattgcgtggggtaccttattgatgatacaatggtgaggcttatggattggattctatcatatattcgtgtggcttaagcttttgtagtggtggtgagtagccacatgataagcataccgtgctactgctaattatctggttatcagtatgacatactccccccatcccaaaacaaatcaacttctagctaggttatcagtatgacatactccccccatcccaaaacaaatcaacttctagctatgtatcagctagaagttgattctttttaggacagaaggtgtacctgataggagcgatcagtagcagagattctgttattatgcaacctatatttttatgtgtaatgtaggtcaattctagtgtagttttgccttaagcttttgtagacttgtggtggtggtgagaaacatccacatgataagcataccgtgctaatgctgaatacataagtggttatcgctatgatttactctccgtccaagaaaagatcaacttttggggatgaatctgggctagtccagattcattcctagaaattgat

SEQ ID NO: 16214 - DNA, 4880 bp, Oryza sativa
gtgtgatcagaactacggatcatttcaatccaggcagaacacctttcagaactacggaaataagacacatttccagaatttctgaaagaagcacgtatcaatccagggaattacggtctaccaaaaccgccagaattcagggtattcccttacagtaaattcatactccgccatgcttgacatttgcttgggcgacgcgagtttatctatatatcttgatcgctacctctgttcctctctgtcggaaagaaacggcacaaaccaacccaagtacagagacatggtcttaagcacccacagccacaggtcacacaaaatggcaccaggcctgggagcagcctggctgctagaggcgatgatccatgaaggcggcgaatcagtcaatctgaaccccatgcgtcgtcccgcaaagcttgtcgagcagcgattcgactcctcctcgcctcctcttgtttcttcagctcgtctgacccgaagtttgtaaactgccttagccccattccatgagcaatcagcctttgtgctgttcttgcagatgtcttcggccttggagttggtggttcaaggtctgcaacgcggaagaagcaactcaagacatggtacgcagtatccatcgagaacgtaggaataaaatactcaagtacaagctatataacctatagatcatccatgcaaagaagatcaagcaggaaagaatagtcacaggatttaagatacatacctatgccatcattttttgtcaagagatcgtcatcctcttttagtggccgcactttatatcttggaggtatacaagcttgtgcctcattagctgcaagttgattggtgagaaaacagaataaggtacagaaacaaaagtaattgatagcttggcagttcatgtcatcaataataagttctagacaccaacagaaagggaaaaagatcgagaccgcattgaattgaacaagatcatgaattaagtatgcatctgacagtctggatgtaacttgaaaaacacaatgttttgatccaggtcaacatataaaaactgaaacgtacatcataagatgcccttctccttgcaagcaaaataagggttgcccctcgtattttactggtttagttatggcacagcaacctaacatatcagttcaaaaattgtggggaggcagagcaaagaatgtactgtttttcataccaaatgaaaataagtcaccatctattttgaggtaagacaaacaaaatatgaaccatccattgttgaggctgttgggttgcattaaggatggaaagaacgtaataagcaccagcactctagcaggttatgacaacctcttttcaagaaggggggtgcaatattttttccttgttcaagttactatgtttcactacaaaaggaggttgtcactaatcttgggtaacttagccttgcccaaaacgtgttgtcctccccattttcctgccatgccagtgatctggtgcactaagaccagcaacaagtcaatcacaggaacaatggatcatcatggaaggagcaatctcttgctttcgctctacacaatttggacagttttgcatgtgaattatgtcgattcattacaagaaaacttgctcaggtatgagcatgccatgtgccattcatgtatgcaaactgcaaacaatgccatgttcctcgatacaggcatgagtcaatggtatacatttccaagcaatcagaaaattctaaatttctaagtaaacacagtagccatatatgacacatgttcaatctggttccttggagagaaccacatgaatggctcatctaaaagttggaatacctaaattaagtcaataagaaattgctacaacaatcaaattaccagctgatggagtccgaaaaactgcaagtgcaacagtatcattaacccagcgaatggcaactccatggtccccaaacttgtcgaaaatcttttccaaatctgctgcgagtgtgctaggtgggaagtcataaagaacaaggacatgccttgtcccatattgtttcgcagctacaaaatcaagcaaaaaactaagttcttcatttattcacaatgaacaggctacctggacacgtagaaatggatcccctgatcatacctgcattactcttgtgtttctgctcatccacacggccctttgatccactctgatcattagactcttgttcatccatatcattttctagaccacactgatcactgtatagaacactcttgtcgtaaagaaacgaaccccttcccctcctcttgggccctgaagatggagtgctaattttctcagaagaactactaggagaaacctttgcttgctgctcgagagaacgcgctagcgttagcgtctcatcgttttcaccacgatctgcaatcgcctcccaatctgcatgcaccacagcaacaacacaacacaacagggtcacagttttgtccaaattgtcccaaagaattatagaaagtagatgctccaaaaaaaaaaaaaagaaacagtaccatcctcttcatcttctttgttcccatcttgtaaagtagcttcgacttgagaatcctttgaacccatggcaccacctaatcaacttcaggagccaacctatatccaccataagttcagaaaataaacatttcaggggagttggggaaaaaaactgttcttagtattgagagtattaaggtttaataggaaaaagagaaaaaactatagcttccagatctagaagataagatattaaaggttagggcaaattcgaaaggaagggggatgtgcgggagctcaccggagcggaggcggaagcggcaggacggcggcacccacctcgcgggagggatggatggaaatcggcgcggcggggctagcgaggagacctccggagagtgaaggtcgagaagacgaccgagccgagtatgcggcggaggcagccggacgccggcgacgctgctcgccgtcgcaggtgatggggatcggcgaggccggatggatggatcgacggcgcagaaaggcctccagtcgtcgtcaaaggggcccatttgtcaggcagcggcctcgccattttgctttttcttttttttcccctaccactccctccttaaaaaaatactttagctcgaggggttgttcggattatagccaaaacaaatcttattaaattttagcaatgctaattttaataagttgataatactaacaaatttttggtatttctaatgtatttaccaaattttggtaaaaaaaaaaggaactaaatgtaggtacatctatagcaacttagttaaaaattagtatggttagaaatgacatcaaactgaataaccccttgaatctagactccataacaaaaaaacaacttacttaaagtgagttttttttttggacggagggagtatttcaaatcggtttctatttagaagttacaaccgagtaactcaatggttttgggtacttaaacaattgaatttattctgacatttgcttcaaaaaagttacaaccaattatcataaaagtgagtagcggattgaaatatgatgaattataaatttgagaaaaccacattacattttttagcacatataaaactggatttttgatatatggccttttgtagaatacttgtggtaaaattgtaaaaaaagaatgtgtccttagctctgtggttcatgaggtggcaatctccgacaaactccaccgtgaactctcaccttaaacgtatcaaaactttcgtgagatggtgttgccagtctaaagttgttgatacgcaacaattatgctacatcaaggaggtgcatctataatcaatgccttgaaaatgtatgctactgctgaactccgttaccaaatattgtcattcatcccaacatttgtagaggtgaattcaacttgcagacctgaactaaatatggcccaaaaaatcagatcagtatatcgtgataaattatctgaatattggagtacgtttcacaattatcattcagctttttagcttttacatctgcaaatgacagcaggaaggaagtttatagtatatggcaaattaataatgtggcaaacaacgcgtaattggttgttaaatttgttcatgaatcataacgcattaattctcagtgtctctcaatacatattttcgttcattcagaaaacgcatgtcgatcgtcaggtgcacagattgctgatcattagagtcagtataggacaaattaaggatttgatatatcacaattgacagtaattaatttgcttgctgtgtgtttttatgaacttccttagctgatcatgttttcattccatcttcacctcgttttacagctgcgaacgaattcagaaagcattaattaagattcagaggctgcagaatgcaaatcaagcaacaataatgcatactaatatggattgcaaacactctggattacaactaagttttgatctacgtttttactcgtttcctgtttagtttctggtaatttcaggaagcaaacacacccatctcgttttgattctttcctctggattacgactaagttggcagctatgtcgtcgtcggcggcgccggcgaggaaagagaatggcaccgtcgccgcccccgccgcctcatccgccgccgccagcaacacgttccacgtgctcaactccggcagcgccgccgccgccgtcgcagccggacgtgcgtatgttcagtcgccgcgagcgacggcgctgcggtcgccgcaggtgcgagccatcaccaactacggcatgttcccgaccaccggcgcttcggcggcgaggacggccatggcggggcgaacgatcaatggtggcgcgtcgatgctgacgacgacgacgacgacgacgacgccaccgcacctgatccagcagctcatggtgttggctggctggaccacccggagtccgt

SEQ ID NO: 16215 - DNA, 15917 bp, Oryza sativa
  unsure (1)..(15917): unsure at all n locations
attatcgccgttgataccggcgccggaagcagcaagaacgcgtcgccggccggcggccatgcaaatgccggcgtggtggtgaaacgtttggcccctgtgctcgcgatgccgagtgccggaccctccgcaaaaagaaagaagaagcggccgncggcggcgccggctccgtcgccaaatggccgcggccgtaagcgcgcgccgcccaaagtgagcaatgatcgcggccgggatccgcaagaagccgaggaagagggccaaaaaggcggcggccgctggcagcaaggtgaccgtcccggctgacgtgatcatcgtcgacgacgacgtcaaccagccgagctcgaacaccgacgcgcaaagcaacgccgacgacgatctgaagaaggcggccgtcgcttcccctgcggcgacgcggagcaagaccagatcaaagtgcaagaccagcagcaacagcgccgccgcctcgccgagcgccaggtccagcgccatcgccgccaggaagaagaacaacgccacagcgaccggcacgacggcgacaccaccaccaccggaggcgaagaagcacaccgtgctgacctggctgatagacaccggcttcctcaaggacaaagcgaaggtgttctacgtgccgggcgacgccggcgccgccgagaaggtcatctccggcatggtcaccaagacgggaatccgctgccgctgctgcaacaccgtcgtccccgtggctgtgttcgaaacccacgccaggtgcgagcggccagggcagccatgggagaagctgctgctcatgtccgggaagccgctgtcgaagtgcatgcaggaggcgtgggcgcaggagcgggtgaccgccatgcgcgcccgggagaaggccatggcgtcgctggagcaggagaaggagaagagctcgcaggccaagaggaagctcgcgaagacgaagaagatgcagctcctcgacggcgtcgtcgtcgtctccacctcttctcctcgtcatcaggtgaagaagaacggcggcggcaaggattgcagcgacgacgcctgcggcgtctgcgccgacggcggccagctgctctgctgcgacacctgcccctccaccttccatccagattgcctcgccatccaggtcacaagactgaataattttcagacagaaactgtgattgattttgtagcatgttcagttcatgatcaaatcctggttactgttttacatttttcagttcatggtcaagattatcttggttactgttttacttttttcggttcatgtccagttcatgattaaatcttggttactgttttacaattttcagttcatggtcaaatcctggttactattttacatttttcagttcatggtcaaaccttggttactattttacattttttggttcatgtccagttcatgatcaaatcttggttactgtttgacagacagcaactgacaacaatttacggccagcaaccgtggtttttgcggcattttgaattcatgatgaaatcttggttgggtgttttgtttgcttgatttcaggctccagacggctcctggagctgccatttctgccggtgcgtgctctgcatgtcacatgatgttcagggtttatcaacatgccaacagtgtacacgaaaatgtaattaatctcattgtacatgtcccttcattttagcatctgatcaaccttgtgtttccgaatagtaactgatgagcttcactggaaacacattaatctgcagatcatcagtactgccgtcctttgcaaagccctgggttcgagatcggcgcatactgcagcgaaacctgcaaaaaggtgaaaattagttattgatatttttttcccatagcatatgctagctcagcaatagtccaacactaaccggttttccttaaaattagtgcggagtactgtatttgctacgcaactattgtgtttatttatggagacacaactgtatttctaatatggttgtagaagtgtgccctaatctaaagaaaattaatctacaccactataatttagacctccgatgatcgggaggtgtagttttttttctatataattaatgtcgtaattttctaatagatgcaatggtccttttagtactgttttcaaaatataaatgtctgatagatagactccaaattctgtacattatgcggtacaaatacagagcttctgaaattctgctttattaatggagcacatctcagttatgcttgttctgaatccgtttttcagatgtcctctcatctatcagatatgataggagtcatgaaccatactgaagatggcttttcttgggccctcctgaagattcagaaggatgagctagtcacttctgaggacatgcctgtcattcttgagagcaatgtgaagcttgcagtagctctgggtgtactcaatgaatgctttaatcctgtgcaagatcgaaggactaagatcgatatgctccaccaagctgtctacagtctagggtatgtgctgctaggcatcaaattgctaattcaactgcttcaatgtttcatcctaaaatatgcaaaccctgatatgtacgtgtcatatatttagtaattttgtatggtttagcactgaacatcagttatatgtttctctggcaaaatatatgtaagagcaagaagataacttcagaaacatatgagatagatttgtacattgtcacacaactttcatttgtactcgaacagatcagagttcaaacgagtaaactatgagggattctacaccatggttcttgagaaggatggagaaatcatttcagtagccttgctgaggtttggatccattctctcttcagttttttttctcttagcgatagttcatgtcttatatttattttctgattactttgctctagcttacttcagtcagtatcagtgtctttcacttttgacactttactgttagcgtcagtgctgctgtttttcatagtttaggatttctacatggcaagagaataaccagtatagttgcaattataaagttcagaatttgtgatactcgaatgccttggtaaaaatgcctttttgtacctttttcagctactactatcaaaccaatgtcctgccctgtttttctgttacaggttccatggcaggaaactggctgagatgcctttcgcaggcacgctgccagcttaccagaaacaaggaatgatgcgtcgccttgtcaaggctgttgaaaaggtgcataacctactgaatcaccaatcctccatccatttatcattcattcagttaatttttcactgcaaagagattcagcaattgttggtgccgcttgtcagactcatactgtacattgaatttgataggtgttggcgtcgttgcaagtggaaaatctagtgatcccggccgtcgctgatctagtggaaacctggaagagatccttctccttcaggccaatgcaggcagaggtcagggacgaagccaagaagctgagcttggtcgccatcaccgggacgacgctgctgcagaaacccatctctgctcatcagcagcaaccagttccatcccggaaaggtagcagcagcagcagaagcaagcgcgcgtctgctccggcgacggtcaccggcagcagcaaggaagaggaggagcagatgacgacgacggcggctcgcctgaccgacgacgagctggcattcctggagatggcacccttgtgcagcttcaccgacctgttggccggaggcgtctacccgacgggtctccagcttctccgcggcatgaagtgatcgacgagatgcagctctgcctgcaactcattcgtttctaaagaacattttagtactacggagtaatatctatgactgaattcgtttaatttcctacttaaaagtgcgactaatttcagtcaggtgtgcgtatgcatagttgagagtcgagactaaaatttggtgttcttgtcctgggtcacaagcagcaagtgtcagtgtgtcattgtcaatggagttgatgagatgatgattattcatcagcatggtacagacatagtacaggttaccgaacaatgttaggttaggtagctgtgatttctagctagctagagcactctcaaggcataacttacttagtgatatactccatttgtagtagttctacatttttgcacacagaccaaacacccacctaatattaatgtatactccagtatttcctggtgactcatggaggagacagcgatagatcactgcgtagctttcatctaagcgcccatctgcaaaagatctagtggaacaatttatttggcgtatactggggagtagattgcaattggaacctttttaattactaattacctcggtcctcggatacatgcaacaggcaacagaaatagaggggcttaattttctggtcaagagatcacagagcagagaagaaaaaggtccaacattgactagtgtttggtgcatgcgcatggagggggatgaaaatgtgcgatggaaatttcggatcgacataccactgtaaccctttttgttaaaaaaatttaaatttttttctaattcctttttcagcaataaatgttgacattgaataatttaaatgataaatatggttaattacggtcgatcgagcgtcgtttccgaagagatgttaccgattccgaccattttcaccccttaattccttgtagatctcccctcatctactattttttaaattaaattcaatacaaatgatcgtgaaaagttctttaaaaaaaatgacaatgtagatttcagtaacatttaccactccaacaacacttatcttcgactccaaactttaatttcctccattttcgttagcacgttttttaaaccgttaaatgttttttacgaacttttctatgtagaagttgttttaaaaattaaataaattattttttaagtttataataattaatgcttaattaattattgagcatgtgctcaatcaaccttctcgtttcgcgtgcgctggaaatctccgcgatgtaagaaaacggacgccggcctaggttcagactcgctcagtatatcaaacagacaaatccacgcacgtatatattgcagcaatgctattcataactcataagttggattttatctttttctattatttgtggatgttattttgcgaagttgtatatttatgttttatatatgaattttcaactttttttaagattttctcatgataatttgaataatgtttgaacaaagagattaaatttgtctccaacatgcgcacctatgcaactccatcaactggtgcaagctggctagcatacgagattagatcttaatcaccatcctgctcgtgcattaagtagtaacaactacactaagcactagtactaactgcactgtacctgtgcaccatgcaacctggctaaaaaaatgtcgttttgacatgagcaaaaaactaaaaatcaaagaagacaacaaaaatccaagcctgctactagccaacaagaaaacaagaaaacggtcgggtaatcatgtcgcggtggaccgtggacgaacaccagctgctagcttcaccttcacacggtggcttccggcgagtggccgccgccgccgagccggggcggggaggccggcggcgtgtagaacggcgtctcgggctccggctcctcctcgccctcgctgccggcgccggactcctcgtcgatggtgtagagcgcgcgcgagacggcggcggtggctggcccgaaccaccgatccctccacgtgttcacctcctcctggtcgggccccgccgcatgctccccttcctccccctgcgtggcggcggcggcggagtcggccggctccacgcgggtgaggcggcggcgggagcagaacaggaggcggagcagcgctcgccggagcgcgctgccgccgccgcggcgccgggccggcgccggcttcttcgggctctggaccgtgagctcggcgtcggaggcgacgacgacggctggttgctgcctgtttgctgccgctgatcggcggcggcagcgccagagcaggaggagcgacgccgcgaggatgccggcggcgagggcggcgagcgccgccgcgacgacgacgagctcgacgacagcctggcgtctcattgtcagcggctaactaatcactctcgctaaatcactctgctcgaagctcgatcgatcgagacgatgaagtgaaatgtgtttttggatatatggccaacgagatgactccctgtgagcaaagagaatttatgtctcttcttttttgattttttgatgtctttaacgttggcttctttaactttaagtcgaatatttcccggcgatggttagtgggagagaaaggaggaggggtacttttgggatttcgactttgcgttatcagagtggggcccagttgccagcgactcatatccagaatccggctgaaaaagatcagaggatatgtgttgtgtttgtttagcttgattgatgtggtgttttgccaactcatcgcctgcatggcatgaaattgaagggcacgacgaactggtcgctaaataacgtgcatttcggtgtccatatgaaaaacatctctattcatggcagttgattgctgctgctgcagactcggtcagtacgtacagtatgcagtagccaggaggtcagggaactagtagtatttcctaaaaaaatataaagctaatgctaaacagtactacatcatttttaaattggatgacaccgttaactttttttttaacgtttgatcattcgtcttaattaaagatttagtataaatgtgtataaatataagtcaaggttatattttatttgatgataaaaacaagtcacaataaaataaataatatttatatttttttctaaatgaaacaaatggttaaatattatgaaaaaattaacagcgttatacatcttgaaatagagggagtattttttcccccaaaataacttcgtttttagtcttatacgtgcaaaacaagaaagattaaagtgttgttaaaaaaacaggagtagtattaacggtaaatagattagggctgattaggcatattgaaggaatcaagctgattgatttgtgaactgaggttagacaggaagatagaaatgaaattaatctgtgtatcgatcattgcagaaggaacgacaccacactgcacacaacactttagctctttagtttgtgatcttttactactacgactacgacctctttaggctttagcgaaaattaatttacagcgcaagcaaagtaaaagcaagtgcctttaactcggatctcgtggacgcagtcgtcggtgccgacgcattcacctacacggcaaattctattcaggtgcagcattgcagcctacggcttctctgaaagaaacaatgcagagacttcacttgcagggtgtagcacagtggtagcacagtgttcccctgccacaatttttcttgcactaatttgcgctacatacaacgtagtactacattcattattgtaaagcaaacattgtactgtagtagatacaaatgatattacataatagtgatatgaggcaaaaaaacgtcatactcatctggagtacaatctttaatttacagtccacctaaaatgtactccctccgtgttatttgtatgacgttgattcgtttaaaattaaacaaaccaactttatatatttaggaaaggaggtagtactagtgaatagagaataaactatattaaacatatttttatacgggtagcgagattgtccacttgtagggctgtcggaggcgatggcctatgggtccttgccgcagcccatgagagcgtgagtgagcagcatggcgccgcggcgggtcgcctccgccagccggccgaccaccgggaagctcaccgtgtccctgttcttgagaggcttcttgtcccaccagtcttggtgcttcacaaccttgccgtcctcgacgtcgagcgtgatgagcgacgccaggtcgatggccctgcccaggaacttgtagtgctgcttgttgtcgatcagtatctgaaacagatcgattgattgttaattcctctgttagtgatcagcatgatagtcaaacactgtcgatgaagtttgggttgattagttacctcgacttttccgggcgcggtttcgttttctgtaattgtgtactccacgattttggattcaccgaataactgatgaatcatacaggcatagtatattacagagaattcagtttgaaataagttttggttgtgtggaggtggaacatgacagatatgatgttaccttggggagtgtgtagaaggccgatttgatctgcttaaccctggaatgaaagaaagaatgaaagagaagaagggatattttttttttcgggaatacgtaagaagcgcatctttgtattaagaggagtaaaagtctgtacaggttaaagggaaaacacagcaggagacgggattataggaagtcacccaagaacattaaaccctaatctcgcgatacaatgttgcgacctgagcgctctaaaggcgtggccggtatggcagtattggcgagccgccacagcgctgcctcttccgccattgcccttgccacttctgtccagcttctgtgcttctggttgaacaccctgttatttcgctccttccagatagtccatgttgcgagagtagcaatggtattgaaacctcgccgttgagagctcggtaaggtttccctcttgtcacataactaggagtggaatgaggtttcattgatgggcaagcattccgagtagggctgtcaaaaaagctcgagactcgcgagcagctcaagcttggctcgtcctaggctcgattcgagctcgactcgagctccaaacgagccgaactcgagcttgagtaaaagctcgcgagctttaccgaaccgaggttgagcttctaccgagcctaaccgagcttggctgtgtacagtctatattgcatgttcaccttattaatataataaactaatagataaatatatatatttgtatctatttacacaataaattagcatgtgttagcacaatatatttattttaatcattttctactcttttattagtgtgattaactagaaaataattagacttatcaagagattattattaaaatatatattatactacttatggccgagctcggcaccgagctcgagctcgagctcgagctcgaacgagctcgaaccgagcttgcctaaaagctcgaaggtgcaataggctcggctcgagcttgtgtcgagctcgagcttaggcagacgagctcgctcgagctaggctcgttgacagccctaattccgagcaaccgattgccgagagcagtagccaccagagctgtcttgattctgggcatgcgaccaaaatgtggttgatgctttcctcgtactgatcgcataggacacacatgctgggatggggcaagcccctgatgcttaacctgtccgccgtccagcagcggttgagtgcgaccagccagctgaagtaacggcagcgtggcggcgccagcgatttccagatcggcgtggattggaacgggattcgaccgaggaacaatgcttggtaggcggagcgggaggagtacatgcttgaactttcccatttccaaataaattggtcctggcgatccgagagctctatctcccgcaacaacgaccagagattgagatactctacgatggcctgcaatccgagggctcctcatatatcgcggatccaagctctgttgagtagcccctctgctaccgtccttcgtcgtcgggttcgcttgggtactcgatcatagagtgccggtgctagtgagcagatgcaggaaccatctagccaccggtcttcccagaagagcgtagtcgtgccatcaccaatctgtcaagtcatggatgcagccacgaaacactgttctttcggagaacaggggatggaaaggccttgccaaagaagaagagatatgatggatcgatggtgaggaaacaaacgtagacgtacccatgagctcgcataagcgggtcctcgaatgtggcatgcgccgcgtaaatctcgaagtcccgagccgtcgcgcacgatccgtatctgcaacatatgcgtgcaacttttttttttttctgtcttgtttcgtcaccgaatcaacaacacagagctaagcagagaacaggtgaacgtacatgttgaggagatgcggcatgatgtgccgggagacgggcgaggctgccttctcctcttccatggctcctcctgcagtcgtcgtggtggagaagaaggagaaccagagcccgtcgacggcggcggcagcagtcgcgcggcggagattgagcatgcaggccaggatcggatcgagcggcggtggcattcattcaaatggcgagaagagaagcgtactagtctagtctagtcgcctaccctgccgtggttgactagtccagttggcatgcgcggcggaggagggcgctacgtcggcgggacaatccggtggcgaggacgacgacaccacgacgcttttcttcttcttttttcctttttttcttcttttttttttcgtctatggaacacttacggcccagaggatttttggtagggaagtacatcaaaggtccctcaacttgtcatggagatacaaaaggaaaaggtacaccgaagagaatgcttgatggagattcttcgccgcgccgagcagacgaccaagaccaagactttcatatgacagaaacagcaccctagcttttcctgttacatctcaaattgtatttattttgttcgcctagcacctaagggagagaagaatggaaggaggaagtagaaagaaagtcagtttcatcagtacataatcacaggtgttgcttgatatattgtaggaccaggtgtgccattgtatcctgtctacagagcagtattctgaattcctgattgttcattaatgccatcatggtagattaattggttatatcatctgaaagatccaaatgagcatagtgcagttaagtatagcaccaagttcactggttgttaacaagactagtactgctacaaagcaaatactccaatggaggtaacaagagatattcaattatcaggtgcaaactcatatatcatctctaatcattaaaagaaaaccgacatgttccgtataagtttctgacattttgcatgcaaaaagctatagtaattttactttgaactctgaagatacaacgccatgaagctaaacccaagcaaatcaaactgtctgagccgatcgaattacatcagaatccacacgctttggtctcatcacagattgcacatgcgctctcagcatgtgtgcctctcagccgggctccgtgagcgcgatgtcggccttcttcagtgctagcgcgtgcgatgttggctgtgccgatgtcggccttcttcagcgccagcgcgttcatgccgttgccggtcatcccgcacaggtggccctcccgttgaatgatcctcacgatctcgtacttgtgctccgggaacatgccggcgtccaccggaaacctgaaattacacaaaggatggaacataagttgcctagctactcaataatgatggattcgatataccacatatttttattaaagttctctacctcaattaggtttttgtcaacagtgagatggttgagagtgagagttccaattttgtcacagcagagaacatccattcctgccatttcttctatggctgtcatccttttagtgatagcaccttgccaaaaattaattaattttagtaatgatatgtgatatactgtctgttaattgaagaaacatgacaacaatatcttggacacacctgttgagacaggtgatgagaacctattgcaagtgtgactgacagaacagtaggcattgcgatcggtatccctcctctcagaagaacaagaacattgttgattccatctccgtatgaccggtgctggattgggaacatgattataacctcaacaatcacaccaatggcgattgagcagatacagaacttgcctctggaggtaagaacctgaaaattcactagttagaaacagctgacagcacatccacttgcgaggttcttataatcttattacagtctgaagattgatgaatcaccttctgaaaatgcccaacaacctcagtggagtccactagatgagctgccttgccaaagaaagagtgtatccactagattcagaggtgacagaacctaaactagacattcatgcaaagcatgtattggatctcttagacggccgtctatatgctactgtgcctcaacagggtgtggtctcaccttaacattggggatgcatttgcgttggaaatccatcgtatagaactaattaatagcaaaatgcatcaaattattaggctactagctttataccaatctgtgcatcatagttttttttttcattgtattgttctcaatactcatatcaaataatttatcgtgattatattattgattgttttttgtgtagttcctgacctctgattctgtagatttgctacacctcatgtatctatatgcaaatgacattattgcttagacagaaacaacagcttgagtctccaccaagtgcagcgtaaacaccagtatggtaggagtaatttcttatgtaacagtaacatgaggagaggaaaccaaaagccatgctgtgcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcgaggcaaaattggtaaagagagtcgtgtaaaatatcgagttcgcacatcttgttgtctgattattgatttttcgcgaaaccatttgatcatatgacaagatgtgtatccaccttacttaatgatttttaccaaatcattaggggattcatcagtgctgtcagagacaccaaatacagttatcggttaaaaagataaatgattccacattactattttttttacacaaaccattagcaaaaattagtggcgtggaatacccttcttccacgaatcgctaacttagttcttactcaggatcaagataagtttcattggaatttaacccaaaatgagagagttttcagtgaagtcgcattatcttgccttggtacattcagatttgcccaacataaacaaagtaatttggaaattaaaaataccgcttaaagtgaagatcttcctatggtatttacgtcgtggggtagttttgacaagggataacctagctaagcgcaattggcaaggaagtaagaattgttgcttttgtcacaaagatgagacaatattacatttgttttatgagtgcagatttgcccgttttgtgtggtgcattatacaagtggctacagggcttttcccgccacgtggtgtatccaatatgtttggtaattggctacggggaattaggaaagacttgaagtcacttatcctgttaggggcagccactatttgttggtcattatggctttgcaggaatgatatggtgtttgacaaaagaaaaatctcttctcctttacaggttatttttttaactatccacttccttcgtacctgggctatccttcagaagcctggttcacgggatttggttgcagcggcgtgttagcgcttggagcaggtggtcagggaatgttttacccagggacatgggtggcggtctagcctgaagattggtgctccctgatttttactgctttccttctcttgttacaaactcttttgtgggtttgtgtgttttggctgtgtgcatcctagttatgcagaggccgggagttttcttagtatggttctatcaacttgatgtaatcgtctgagattaataaaagcttcctttatcaaaaaaaaacattattaagttgaacaacagtgaggtaaacaagcaacatgcttccttattcagctccaatgtcccagaagcaacaatgacagtttggatctgtatcaggcaatatttgtgcaagtttctgccttctgcatgttttatttgtggataaaagtaggactaaagaagtagaaatgacaatacccagaagcgaggtagatgatcgtccacaagaatagccatcaaggagagccaaaaccaccaccaccaggagtgagaatctgaagaatctcaccagcattaaccataacagtgttcttccctccaaggtaaactctacgaccatctttcttgacgagatagtttgcaccacgggccccatttcttcctcccttcagtcccctgggagcatgcacccttctctctgaaagaatgctcacaacaacaggctggcaaaattcaatctctctcacaaggccatcaccacctctgtggaaaccagaacctccactgttctccctgatgctaaatctatgtaaaagaacagggtatcgctgctcaaagatctctgggtcagtcatccttgtgtttgtcatgtgacactgaacaccacttgtaccatcccaactcgccccagctcctgaaccgcctccaatggtctcatagtaaccgaaggtgtcgtctccaaatgtcaaattgttcatgcaaccctgggagcaggcgcatgcttggaaagccattaggactacgtccgtcactctctgagaggtcaatacattaccaccaaccactgcagctttgtcacttggagaaaggaaagagcctttaggaattaggatcttcacaggagctaggcagccttgatttagaggtatatcaacgtcgaccaagcaccgtaagcagtatatcacagcagccgctgttactgcttcaggagcattccagttaccatacacctcaggactggtgccttcaaagtcaaaggttgcttcgcctttactcgaatcaagggtgagcttcaaatggagcacagaaccatcatccatgtaatcttcatcttcgatgacagggctgcag

SEQ ID NO: 16216 - DNA, 11011 bp, Oryza sativa
gccgagtgagattcggcccatcgacctcgggggaggcaaaatagacttttgcggaggaatttgattggaaggaattggattcggagttgaactcgacgatagatcggggattgagatcttgagatggcacggacactagacaacaagcaaagaaacaaatttcgcaattagggtttttaagagataattttcccgctaggcgccacgacggaacgggcgctacaaaccaacccccctaacaagaatctcgaccccgagattcaacacctaagggagcaggtccgggaactcggcgcggagaagatcttctcgctcccaggttgcctcgtcttcggaatgattgctccattggactttatagaacttgatggtcttccttcgagtctgacgttctacctcttcaagaaccttgatcggtctttccttgtaggtcagattcttttccagctcgatattacccaggggaacttgctcttctggaactcgaagacatttctttaactgggatacgtggaacacgttgtgcacatctgcgagaccttcaggtagctcaagctgataagccacttcgccatgtctggcggttatgaggtagggaccgatgtagcggggtgctaacttgccggacatcccaaaccttctcataccacggaggggtgatactcgcaggtacacatgatctcccttttcgaactcaaggtcacgtctccgattgtctgcgtaatttttctgacggttctgcgctgtctttaaacgctctcggatcagcttaacttgttcttctgctgacttgagtatgtcaggaccgaataccagggcttcgcccacctcattccagcacaagggggtgcggcactttcttccgaacattgcctcattcggcgacatctgaatgctggcctgataactgttgttgtatgagaactcagcatacggcaaacaacgatcccaagtgccttcgaaatccaaggcacacgcacgtagcatgtcttctaggatttggtttaccctttccgtctgaccatcggtctgtggatggtaggccgtactaaaatttagatcagttccgagggcttcatgcaactgcttccagaaccttgaggtgaactgagtgcctcgatccgacactattttcttgggacagccaaatctacatacgacatgagtcatgtagagttctgctagtttctttccatcataggtggttttcactggcacgaaatgagctgacttcgtgagtcggtccacgattacccagatggagtcgtacccgctgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacgtctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggtccgcaccaaactgtgcctttatcgtctatggagaaattggtgtctttcttctcctgtattctttttattaattcttttatcccttcgtcgtctttctgagcctcccggatttgcgactctagggtaggctgtactgtcaagctggcagggacacctgactgtaccacggtcagtcttaacttctccaattctctgcacaggtgatcttggtcaggccgtatttgagctacattgcaataggccttgtgacttagcgcatcagcgaccacgttggctttaccaggatgatagtggattccaagatcgtaatccttgattagttccaaccatttttctgtctcatatttaactcggtctgagtgaagatatacttaagacttttgtgatcggtgtatacttcacatctgttcccgattaaatagtgcctccagatcttaagagcatgaaccacggctgccaactcgagatcatgggtgggataattggcttcatgaggcctgagctgcctggatgcataggccacgaccttttgttcttgcattaggacacatcctaagccttgtcttgatgcgtcacagaagatctcgaaatcttttcggatatctggcaaggtgagaactggggcagtggtcaaccttttcttctattcttgaaagctgtcttcacaggctgcagaccattgaaatatcttttccttctctaacagctcggtcataggtctggctagcttagagaatccttcaatgaatcttcgataatatcccgctaagccaaggaagctgcgaatctctgacacattcttgggcgggttccaagcaagtacagcttcaaccttgctgggatctacttcgacaccgttggacgagatcacgtgtccaagaaatgctactcggtctaaccagaattcgcacttcgagaattttgcgaatagttgatgatctctgagcttttccattatccgcctcaggtgttcagcatgttcctcctcgttcttggagtatatcaggatgttatcgatgaataccacgacaaactggtccaggtattccataaagattttgttcattaagttcatgaagaatgctggagcattggtgagtccgaaggacattactgtgaactcatatagaccataacgcgttgagaaagcggtcttcggaatatcttcagatctgattttcagttgatggtaacctgacctcaagtcaatttttgagaagactcttgctcctttaagttgatcgaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaactcttcgatttgtcttttaacttctgctaactcattagctgccattcggtagggtctttttgcaattggagctgtgcctggtgccagttctatggcgaactcgatctctcggtctggtggcattctttttaattcttccggaaatacgtcgggatattcacagactatgggcaccgactccaaggaggtgacttgtaaacaggttaggatagaccgacttgcggtaggggtgttaggggtaaagcggacttgctttcctccaggtccttgcaaggtgatggacttttcggcacaatctatctgtcctttgtgcttagccaaccaatccatccctagaatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttaacagagaacatacccatcacaacgtctggagcatcctgagcggtttcagcttgaatgtgattcacacggcctcgaccaaagttgttggaagcacgtgaaccttgtccacttgcctgagagctaggacgagactgagctgccgctggagtaggagttctggcagtgctgccattagcatgccctgagttggtgttggtaggattctgaggacactgtctagcatagtgacccatctggttgcaccggaaacactgaactgctgacggtccctgcggtgacttgaaagagataacactgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcggaaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctttcaagaatttcctgatcttcttcttgtctgtgtccacttcctcaggggcataccgagccaacttgttgaactgacttaggtactcattgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcatcttctcaacaggagtacactgcactaagttgagttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtgggaaagggaggcgttcttctccagaattgtgactggcagtgcggtgagagcggtgagactgtcccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatcctcaaaaccaaagcgggctggtgcacgagctgcacggcgggggcggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtaggggagctgggtagtggaaacggaacacggtggcagaaccaacaacacgcttccgcgcagtgcggataaagcgtgggccacggcaggaggaagcaactggggtgtgtcctggggtgtaggaagggctaactgggtgtgggtagggcgagtacactggtgagtacggcgcacgcgagctgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggagaggtcctggtacgcgatctggagagtgggcctggctacagtgaagtggtgtgggcgaaggccagctccgtgtatacctccacgggggtaaaggtacacagagagctcacagtgagggggaacacggtccacggagtaccccgtgtactcgggacacgagaagccaaggaaacgggcgaggtcacgaagctgagcgacgtggtgaccctcaccaaaaccgtgggaactgaaactggcgttcactgccatctacaattttgaaagagggagaaagatcagtaaccattttagaaacaaactattgaaaataaagaagacaaaagaaaccttagcttttcgcaagtagttttgaacttagtatccttagggtcgtcctaagtgtcgggtttcgccctagggccaagcctgtgctctgataccatctcttgtcacgccccgaactagtcccgaccggaactagcccgtgacgctccaaattaacctgttaatcgataccagtcccaggaaatagtgctggtatcacagggagacagagtatcacagcaacagaggtctctttattatagagtagaagtacagtcatattgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggaggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacatttcaaacggccacccgggcctagctgatcccgtcagctgctgatttttcaaacatcgaacccagtttcacaacagcaatttcacaagcagtagtcagacaaaactacactaggaatcacctcacatccgcccatgaccgtgagcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctcttggcatcaaggctcccctgataagctagttactcagccaggggtgtcccattccacccatgtggtcgtacttgtcttatgtttggatgaaattctaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaatctgccttgcagacgggacaacagattaagtgtgatcctatcaatgcataatatttcgcaagcaaaataattaaatttcaaatataggctcaagatgttcaaaggtggcttgccttgctcgagatctggagcttgatcctcgaaatccttgcactgcgggtcttcgggctccgaaactacacgcgaaacgggacaactcaacaaaacggcgaaaatagagccctattaaagacctctaagcgtgccactagatagatctcgagatttgggaaattttagaagttgaatggagtcaaatggaattacggttgggaagatattgaatttataagattattggatttttggtctaaaggaaaaggatttaattaaatcctttttgaaaaagaaaagaaaagaaagaacagagggatggaaattagacttttcctcgggcggctagggcgcggtccaaggtaaatggagcggctcggccgagcttaacgggccggccggcccaagacggcccaagcacgcgcgcgcgcgggagggaggagagagagtccggtggaccgggctcaccacgcgcggtcccgggtgggacccgcttgtcagcggctcggctcaccatgcggagggagtacgtggctcatgcgcgcgggcggggaaaggacgcggtgcacgcgcgcggtccgtggtggacgcaggtgcggcgggcccacgcgcagcctcacggctcgcggtggaacgcgcgcacggggagggactgaccggggtcggctcgatccggtctaggctgagctggcgccgacgtggcgcctacgtggcggccacgtgggctggcgggaggtagacgacgacccggcctcgaatggacggcgggcggcggcggcgagcggcggagcgaaccacggcgatacgggcaacagcgagcacaccgggcggttgcacgtgacaagggaaggcgagccatcggctcggattcgccggaggttgctcgacggcggcggattgcggcggcggcaaccggcggcgggagaagagggaaacggcgacgaggtcacgagaggtcgattcccggcggtgagagcatctacgtggcttcgggaactcgacgctagcgtcggattgggcggaactacgccgagcgaggccggcgacgagcgggtgctacggagctcgagcggcgacggcggcgaacacacggcgagcgacggcagcggtcggggcggcgccggctaactacggggaggctactcaagctactaccgaaagctagggggaggagatggagcgaggaggaagaacggagagagacatcaccgagaagaggaggggcgctgtgacgagaggccggcggcgcgggagtaatctctccggcctcgggccggggaagaggaaggagagggcgcggccgaagtccccttccgcgtcctcgaacgcaccggctctcccggcgcttggcgaaggacggcggaggcgagacagagcacgggggcggcggcaacggtgaggaggcgaatgggagaggaagggaaagggggaggcttgggtttataggatggcaatgtcggtttgggaaccgacttagggcggtcaagggcgcgagctggcgctcggcggtcgcggccaaagcggcgacagggaggatgacgccggcgaggagggaaaaggggaaaaggagggggagaaagggggcttgcccctttgccgattcgggaaaaagggggaggggagcgggggcgacgcggcagagagaggaggggcgcggcctccttcccttggcggcttgcgcgcggagtggcgggggccgggcggtgacgacggcgatgacggcgggcggtttggagcggagcggcgacactggcgacaggcgcggtagacgctgacgacggcggcgaccgggcggtcggccactcggcgcgcgcgtgcgggaaacaacgggcggcgtccgcgcgggcgcgcgcacgcgaacacggcgcgcgggaagcgtctttgcgagcggggagctcgcgcgaggggaggggcgctcggcgcgggcgactcccgcgcacgcgcgcgcggcgcgcgggcggggcggagggggggcggggagagaggcgctcggggaggctctcgcacgcgcgagcagcgtgcgggcggggaagagagagagagagagcccaggggggagagggagagatgggccggggaagaggggaagatgggccgagcgagattcggcccatcgacctcgggggaggcaaaatagacttttgcggaggaatttgattgaaaggaattggattcggagttgaactcgacgatagatcggggattgagatcttgagatggcacggacactagacaacaagcaaagaaacaaatttcgcaattagggtttttaagagataattttcccgctaggcgccacgacggaacgggcgctacacttcacaattatctatactctttgagataaatctagagaatatccatacgaaaaaaatatcgagaagcaaacaaaaggtacaacatccagattctaaaggcttcctaaaatatcgttccccttttcaatctatctatgtatctcatgttggttggttttatgccagctaattggctgagcgacatgtggcgagatacaagcgacagaaaaagcaccgggtaagaaaccctctctataaaactggcgagcgtgcgagttacaatggtgaattgaaataaaagagaagaaaagccgctccatgtgcgtagttgggccacacaatgcgtgattgggccagtgcaaatacataaaataaggaggaaaagaaaaataaaaaagacaaaaaatatgaaaaattaaaaagacaaaaaaatattttttataaaattctttgcaaattataaaacccgcgaatttccgaacatcggatgaaaaattccttgtctcttatctcatctaccttatttcatgtaattctatgcaatttacattcatagagacatacttaagccctatcaccctaggattgcaaaagttaatctagttgcttagttagtcttatccttcacaaagcctagtcacttaagttagttttgattaggtgtaatttatttttaatattgcttattcacccctttagtgattgattcttatagaaagggaacatgtataatattatttcataaaagaagaaagaatggaacacctagagagtgcagtaaggtgaaaaaaca

SEQ ID NO: 16217 - DNA, 2933 bp, Oryza sativa
agatatgattctctacatcaaccttgtgcacatccaaatccaaaagagaataacggggtgcatatccaaatccaaaagagaatatattggtgtaatttcgattggcgacatcttagtgatgaactctcgtcgagatcgaccacaactctcgcgaatctcgccgtggaactcaataaagcatcgctaatgttagtggagacgatgcgatattgtggatgcaagacgagggtttccttgttggaataagttcatctaaggtcccttaacttgtcaataaatccaattttcgtccctcaaccagaaaaccagacacaacgggtccctcaactaccaaaaccagattaggtccctcggcggttttgagggcagttttggctgacgtggcacctacgtggctaatttaactcggtcttcatctgatgtgtcattgacatggcgcttacgtggcaattttgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctgacaaacaaaaataaacagcagcggactagcgggcctatggctccatcttcacaggcgctcaactggggtataagctaggactccacctaagacttcttctccaaagcttctcttactgaaggggggaaagatagagcaagaatgagtacaaccacagtactcagcaagtcacaccgggagatgcatgattaatgcaagggggtacaaggggataataatatgggttaagttttgcagtaaacagcatttaaaagtcacttagttgcccaaagccattttaaaaagacgatcctagagctacacagtattattaatcaaggccgtgaacccgcacgaacctgccttaacccaaggcctatgatgattcagaccgaactggcaacctgaccctaggtcccagctcgtcccaagccaacccaggccaaccattccacattttagttgttaagcaggttttaagaattaaaacactaacttgggtacattgctaggcttgcccataaccgagggcgcggctattcgaatagattatactctgatcagaggtgtacatctttacccacaagacacgtcttcctcacgtgtaaccacgtgccacataccaccacggcatacggacggaagacgtgacatagtttccaacccatcctagccatagacaagagtgccgacccaaccccacctacggccggaacctccgggacaggtaggcaggactgagcccctagcagcaggacaccagccctgtgccatgacatctcgactaccgggccgcagctcgtgtagccttcatttgtcctagagatgtccatcgacccccgacttcatccatctccatccgtgtacttttgtttataaccagactgagccacaaactaagccttacccactagacatgtggaagtacggtagtgctttgcaacagaggcccgaagaccggtccttatgtggccgaggtgctactatcaaatccatgcaccccgagcctagcctaaaaccattttgagggttttgaatagagggggaggtgtgaatccaattccacaataatccaaccattccacaatgtccaagtgaaatggatattcccaaagtctagagttataaaaccacctaatgttgcctaattaaacagcgaagcatctacctaaattcatactagtggtactatgaatagagtacccactagttggggttttgtttattctagggtgaacaaggtaataataacaataacaataataataaggtcatagcaaaggtaaataggcatggctaaataaaacagtgataacgcgggaatttaaataaagctataatgcattaattcaaataaaaataattttataaactgggattcaatatattcaaggatgatgtgacttgccttgctcgctttcccaaacgtcggcttcaacctgcacgtagagcggatcttccgaagctgcagcgtctacacgaccaacggaaaggaaaaaggcttttactctaataaactccatataacaagtaggaacaaagcacaaaaatgggttcttgacttcttgaggaaaaattagagacttgaacggtccaattccgagttcaaatggccaagttatggccatttgaagtttatatgctctttaagtgaatatttgcgaatttctttatttaaattttaatttaaaaaggatttattgcgtcagccgaggagagggggcgcgcggaccgggtccacgggagtggggcccacgcggcagcctcatggtccacggtggaccgggcgcacccgggctcacaccagccggcgccgtgggccccacgcgtcagccgtacccgagggcgcgggcggctgacggctaggccccacgcggcggccacacagtgcgcccggaggcggccacgacggtgcagccggcgggaggcggcgcccgcgcccctatggtcaccggcggcggccataggcacggcggagcggcggccgagagaggggaagggaagggaagggggaaaagaggcggcggtccacggcttaccccgggtcgacggcgacgacaaaggaggcggccggagcggaggaaggcggcggcgcggctcgggtggactgggacgatggcgctccggcggtcggcgagctcggcgaggtggtggacggggtcagcggcgatgcgacgaagccggagaaggcgacgccgaggcgggagacggtcccggcgagcggagagggccggccggaggtcgtcggcgacagaggagagagaggacgacggcgcgagctcgattctggcagggagacggtgcggcaagtggcggaaacgggcgagagaggcgcggggagggtttaa
